United States Patent 10,724,096 (METHODS AND COMPOSITIONS FOR INHIBITING AND TREATING NEUROLOGICAL CONDITIONS) - sequence listing, part 60

SEQ ID NO: 1386 - DNA, 452918 bp, Homo sapiens
attgttaggctagaaaaagattacacttcataaaaccatgtttattcaaaaaaatctattcagaaagtctggaaagcgtaataaatatctgtacagtggccacccatctcaaacatgaattacaaagcaggaacataaaaatgatgtgtaaacataactgctgagccagtgaacaaagtgctgagtcaggagcgaggcagagaagcgtgctcagtagaacgacacagatgctgcagcctccgtcctcagcccctcaagctgcgctggagtccaccttccgccctctccacaccgctcagggaccggcagcgtccttctccattctcgaatttgcatgacgcttagaaaggtaggaggcagcaaaacgtgtcagaaatgaacggagtgcaaatcaaactttgccatgtgcttgagagaatcagtaaagcgttaggtaaaaatcccaagtgcagctttaggataacaccatttaatgaacaatactggataacattaagtactattatcactttaaaattcaaacaatcttccaaacatcaatacatacacagttagtttaaaatcacagacaaatcggacttgagggtaaaagtgaaatcctcacctcttgcccatgtttgactttgggatggaattcagcaaagctctcccactgcagattgggagaatcaggtatttctcccacatggggggctgccagggaaggaggaccctatagggtggccagcaaggggccactggcggtaggtcaggaagcctgagatctagggttcaatgtgtttataagttctgtgattttcatgacccgggggtggggggttgggttatgatgaactgtgtgaggaaggagagccagttaacttttggggaggtctatgtcatttgtgcaaatcatacggagcatttcattcgttgtggaggtgcgctgagctggcaaaatgcgaattctaagaacaccttcatttacatgtcgactgctgcttgaaagcagtcacttgctatttcactaaggtttttgaaagcttagtttaacatatgataccataacttctttaggctgacttttgtggaaggatgtcaagtatcattttgttctggatatgggagggaaagtagaggtatttcacagacactcagcggagcagggccaagccagtgttctcctccgctgatgcacatcaaatacatgtaaggacagagctcgctgtgatggggagtctcgtcggtccctttggcattcttagagttcagaagctaagtctgtacaaactgggatgactgaaaaagaccatgagctggtgccccatgggcacacaaggagggaaaaccgtggccgctttctcacggatgctttccctttcacttcccccacttctcactccctgcaccagaacccactgactttaagcaaacagacaggcctgcacaccaagccaggccaaagggtccgggcagctgatgggggaatcgttgcctgtgtagcaagcagaaaaggtgatgacttttgttcatttctgggaggacagattgtgtgacctcaggattatccacttcttcctaagtttctaaaaagaagtgaaataattaagacctaaaaagcaaattcatcatggtggaagtcgttctagccttgggaaaaagcatcttctatggagaaaatgtgaggaataccctgtgggcactatggaaacaggtattcagtccgacttgctccttttatgttttgtggttctctaagaaaaaaaaaatccacatggattaaagcttgtgaaacaagtttatattttaaggtctgaaaacaatcagaccaagctaaggagttatttttcagaacgcagcacattttttctttatttttttttttttagttgggtacgagaatcgagatggagggggaacaaaacccaacaaaataacatcttcttagggaaaacctggctgtggccagcgggcacctcctgaagccctgcttgctgcagaggcgccgctcttcagtgatgcagggtgaggggctgagcggcgcctcctcccatctagtctgcttgggggccgccagggagcatcttcaacacccttacaggacaatgaaggacccgtgtgttccctctgccggctggactgggcgtcgatcctgctgcccggaacctctcactcgattttactcaatgaagtagagcacagcatggcctaaatgccccacacccgccctgtgtgcacacccaggggaatacggatcagtgtgaaaaaacagatctgtgcaacagagacacaaaacgcaacacaaagccacagcatctacaaagtgcatcgctcctgtccacgctgatctccgctgccctcccacctgtgcctctgcccctcagtctgctgggtggggcctgtgtctccctccagcctccagctggactgagaaggtttgggtgggaagccacagagctccatttctccaattcacagtttctccacagaccagaaaaatcgaagtgaacacagcaaaaccacagctttaggtgagcacacaggaagccgacacagggctgagcaggtgcgagaacccacgactccctgcaaagcctccagatagctgtgtggccacgggagctggggacagacggcagcccagtgcgcttggccccccggggaaagccgagactggaggtggacacaggctcctccgagaggcacccccttccatcctggtgacacggagctctcaaggcaaagatccagcctgccttcctctcgtctgggctcttactcctcatttgaatctgggacagaggaaaggatgggctacccagcacctcaggcaaaaactgaagggcgaggaggaaacggctctttggattattttgggcagaaccaggcatctcctcctggacgccacagtgccaaccccgtcatccagcccgtggggagccccgggatgccaggtcaccccagccctctggggccctgcaaccaccaatggctgcgccctcgcactgccactttcccaccgggtacctgggacgtgggtgtcgggagtctgaccaaaccgaccggcttcataattggaaaacagatctctcggcagaaacagaagccatgtatgagaggacccgcgggctctgaaagaagcccccggcctcgcacgggcacgcgaggtgaaggggcgcatttggtttcgcttgggagaaaagagagcgggcggggaggctggcgcagtgaggcttggagaagcccccaggtcaggaccctctccggggctgaaaaagaaaacacggacacggcgagggcgggcgccgcctccctgctggacttgtggtcactctgggtgccagacgggctccgaggccggggtctgtgagcccacgaggatgctggcaggggacgctggggccagggtcccacccgctacagccgcgtggacgtgagtctcttcatgcctctgcgctgagccaggttggatgacagcacgggctccagccgcggggcctgaggtgttctgtttagagcaaagtaggtggcggccatcgcgccctgcaaaacagaagacaagggtgagagccgcggcgcctcactccaggggttgagccggagcccggggcctccatgggcctcagctgcccccaggcaacgtgggagaaaccagagcttccccagggtccctggagcatggagtgctgttagcctgccgccaggggccagcacacgtgggccccaggagacaggggccctgtctcctgcacctgccccccccaccccatgccaccctggcactgtgcttgtgccttgggggaaaatgttttggacgcttgtggagcccccaggctgaggtcacgtgatcccctgcattctgacagtgaggccaggtctgttttggggctcgctgggtcctaggggacacagcgaatgccagggccagtcaccctggactttggccactgttgaggagtctggactcatttggaggaacaggcatatcctggagtgaatccaaattctcagaatggatctggagggggcggctcttaactggatcatgcctattcctgctggggtgggacagtctacacttttcagaaaaggagtcccacccagaggatggggtgcctgagaggctactgctgcctgaatgtaagtcacttatgaaggggactttttttgcatgtgtggcctagaatagaggctttgaacttgagtggaacagccacaccagctgccaccacgtcagcagaggctgccacctactcaggtaggagccctgtgcaatactgcacgtgtctggtgaagtgcacgaaggtaggtgggccggcggtgcagtttggggctgctatgggctctttctctgcactctgtggtttcttcggagtgattgcaaggtatcaggctcttttctgggtttcccattcccaccactctgtcctcactgtcgcctgccggtaccttcaccaggtgcacgtcctgtcggctgagctggtttggggacaggtactctctgttgaccacccacgggtgtttgagcacttgcatcgccgtcaggcgctgatgagggtccacgtggagcatcttggacacgacgtcctgccagggaaggtcatgagagtcggggggatggttggatcatttgtgctgggtcagagagcctccccagcagaactcctctccctctatggcaacacccaaccactatgctgagtgtgggtctttgcattttggggtcatgttcactttcaggtttagaagtatgtcaatggtttttagctttaaatattaccaaacttggaagttcactgaaggtttatcttttattaaatatttcatgtctaaaaagttaaatgtggaaatattagatgatgcatgtaaatcgatgaaacactgtttcttgtaacaattatatctttccaaagggaaaagctgaaataattaatattccacaggtagaaatcaattcataatgatgcacatacttacattttttatcaggactacccataaatatttactacaaataatcagaaaccgcaaaatctacaatctggagccatcagatatgtccagtgggttcatgtgcaataatggtatttttccatttcattgtaaagtcgtagcagtaaaaacctctaaaacaagattctacatgtgtgtacacatgcacatacaatacagtgcacattctattacagtgaattacatttgcagagtacttggttacagtgtgaattacatttgcggacaaacctgatgcttctgctctaatcaccataatcatccttgaggtaaatggggcaaatattacttttcctaatttgcagatgaagacattactgcctgaggaagatccaagatgagaatccatattctctccactagcctaccctccttccttagtgttcccaccacatttgaagaggtaataaaatgaattagaatgcggctgggcgcgttggctcatgcctgtaatcctagcactctgggaggctgaggcaggtggatcacttgaggttaggagtttgagaccagcctggccaacatggtgaaaccccgtctcttctaaaaatacaaaaatgagctgggtgtggtggcatgcgcctataatcccagctacctggggggctgaggcaggagaatcacttgagcccaggaggcagaggttggagtgagctgagattgcaccattgcactccagagtgggttacatggcaagagtccatctcaaacaaacaaacaaacaaaaaagaatgcatatagaatgtgaagttgaattactcattagaattttgggtcatgaaacaactaagaaatactatgcacaataacaatatcttttttatacagaaaaatctaatgccttttgatatttgataacattgaccttggtaatttcttgaaacaagtatctcctagaaaaatgagtgttgtcattttcaggtgtaaaaacaaaagcctttagggctttaataactcttttcacgatcttatagtcatgacactgagagaagcagtatttttacttcatacctgtaggatgtggagaaagacatactaatttgtagctttgctggtgtttggaggactggaggttctgttgtgtgctaagtaagagaaaggaagaggcacaggggaaagacgggggatgtggtggtggtagggactggtggtgaagggcaggaagggttggtgaggccctgtgaggcggcagagacctctgcctgcagcagcgatcttgacaatgtgcccttgtccttgactttgctccttttccaacaccttctccctgctcccatgccagcttccaagatggccttccagacacaccaccagcacccacgtcctagtctgaggctctattttgggaaccagaactaagacatctacactcatttaagacaaagtgagggtgtggacaggagcatttggactgtcagggtctgacatctgggatatgctcactaaatgccagctgccatcacctctgccaccacctccaccatcacccttaccatcattcctccatcacccccaccataatcttcaccatcacctccacaatcatcctcaccgtccttcctccatcacccccaccattaccctcaccacaatcaccttcaccatcatcttcaccatctccaccatcatcctcaccatcctcctccatcacccccaccattacgctcaccatcatcttcaccacctccaccatcatcctcaccatctccaccatcaccctcaccatccttcctccatcacctccaccatccaccctcaccatccttcatcacccccaccatcaccctcaccatcatcttcaccaccacctccaccatcaccctcgccatcctttctccatcaaccctaccatcaccctcgccatcatcttcaccaccacctccaccatcaccctcaccattttttctctgtcacctctgccgtcacccttgccatccctcctccatcacctctaccatcaccctccaccatcatctctgccattaccttccattatcttcaccatcacctccactatcatctctgccattaccctcattagcctcaccatcatccccatcacctccaccattacctccacaatcactaccatcatctctcactatcatctcccaccactcccaccgtcacctccatgatcactgccaccacctctgccacttttgccatcccttcatcacctccatcatttcctaccatcacctccaaaatgatcacctccacgatcactcccgccacctctgccaccacttctgtcatccctccaccatcagctccatccctgctcccaccattacctccaccatcagctccatccctgctcccaccattacctccaccatcatctccacaatcgtcacctccaccatccctccacaatcacctccatcatcactcctgccattatctccaccatcatttccacaatcattccctccaccatgccttcaccatcacctccatcatcgctgtcgccacctctgccaccacttctgccatccctacaccatcacctccatcatcattcccgccattacctccaccatcatctctacaatcatcacctccacgctcactgcatgaagttgcactgagatgtcaacagcagaattggaatcagagcccctgactccttctctttcagcccttttacatgaacacgggaacagctgttggtgctgcttaccagtggctggattatgatttactattggattagagaggaatttgatgatgccaagtaaaaaagcgtctgatgggcaaacgaaataaggccggtcataaactgtgtggactgcagacaaggccaaattcaaagtattttacaagaacagaagtatacctctggacaagagctctacttgtttgtttggtttatgaacatgcagggcaatcattctgcaatatcactaaaagcatggtggttaattttatatgtcatcatggctgggttatgttacccagtctagaggttgctgtgaaggtgtttttcaggatgtggttaacacttaagtcagtcgacttgagtaaagcagttaccctgcacaatgtgggtcagcctcatccaatcagtggaaggcctccttaggaaaaagactgctcccctgaggaagagggaattctgtggcagatagcctgtggtgggcaactgccccatccatttctccttggggctccagcctgccggctgccctgcagtcacagacttccccgtccccacaatcacgtgagccaatttcttacaaataaatctctctctctatacacacacacacacacacacacacacacacacgcacgcatgttctgtttgtttctttggagaaccctgcataagataccaagatagtggaaaatgtgaaaatgctaaaaatgtttttgaaaataatgtttttagatgaaaggcttaaaagatgccgaggataaggccaggtgtggtggctcatacctgtaatcccagcaatttgggaggctgaggtgggtggatcacttgaggtcaggagttcaagaccagcctggccaacatggtgaaacaaaaaagttttagtacaaaacttttttgtactaaaaatacaaaagagttagtcgggtgtggtcgcacacgcctgtagtcccagctacttgggaggctgagacaggagaattacttgaacccaggaggcagaggctgcagtgagccaagattgtgccactgcactccagcctgggtgagacagagcgagactccatttcaagaaaaaaaaaaaaatatgctgaggataaaatacctatactacttacataaaacctatcccctggcttcctcagaaatcatatggctatttcagaatctgaatatttaaaagcaacgctgggacatgtactcactttagctgcgtcagatatcgagtcccagtttcccccagaaagggcatacttcccactgccgatccgcgccagaatctcctcaggggtatcgtctggcccatttgcaaaaggggtaaatctgtataattagacaaatttgtggtaatgagcttgtattttacaacctaaaataaagtttgcaagttgatatcaccccttggctgttcaaaggaatagcactttgcttctccctcctctgctctgaagccaggattcatgggaaagcggaacttacctctaacactatgcccgttttccttccttagcaattgggtggctagaggttgatgggcaagtgggagagccctgtgagacctgtgctgtatcccctccggacccaggtaaactgggatggggtggcctagtgagttgcctggtgccgtggtttccacggtgatggtgtggcatcatgcgagagagcctgagacgtggagtctgagagacccacggtggatgtattcccaactctgtgttctttgacaagttaactttttgagcctccactgcaaatgcagagtgtatgcacaaatacacatacatgcttggtgcagctctggccatattccaagcgcgtgggaggtgttcatggtgtcccaccttaaaacacacccacacactcctaggaaaggaaggacacgtgtgctgccagcgcttcctctagtgggaaagtgtgtgatctagttttccgtataggcaaagtgagtattagaagcgtcacaaagtaacctgactgtggtattggtaagaaactgaggttccttcctttgctactgcagtcctcagggtgcggcttcagggcctgatttactctccttctgctgtggacactacctgttgacttatgatgaaataagtgaaaagcaggccaagctcattcattctcatgagggcattcaagccattttgctacagcaaacaggattcgatggtctagggttcttttctttttgcctccattcaagtatttaataaacgtaataggaaccagcggatcttgtaagatcctagaccttcctgcctagaagcaaccatggtgtgtcctcttctcactcaggggagagggaagggaggctggtacaggttaaagtgtttagcccagagtcacggctagtggcgagtggggctcagatggaagtcagctgtctggatggcaggcccaggccactttctgtaacaccacgtgtcttaccacaatgaaccggcccgtgcatgactcatgaccacgaaacccaggtacagatgctgtttgaccctgaagctgctatggggctttcggtttaagaggatgtctggaaggcacatctgttgctaccttttaaaacagtggcaggtgcagcagagagaatggggactatgctggcaaaagacttgatgttttgttcatgagctgagtttaaagaaaatgggtggctacatttcttgtccttgttgttcagttgtcctgaggggctaagaaagtctgcgagtgttcactcaaggcctgggagtgtttgcatacacgttgggtttgcccacatgcgcacactaggacagggctggccctggtcccctgacagatcagccactgaggctgctgccctgtgtctcctcctgacacctgtttgaggtgactgcttaccctgccagcatggtgtacaacaggatccccaaactccagatgtcacacgccgcatcatagccttgacgcttcaggacctaggagggaacgacaggacaccggcacgcccttcactaaggacattcagattgacagcacgtttctccagcggcatcctacgccggcaagctggggaccaggaggagggcggtgccatgtcttcggtgtgaccactgtttcttaaggcaaagccaaccctaaggtactgcagtgggactcctcccaggccagccacatggtaaactagtactctttccagacacatgacagacaggctgaaaaggagggccttaatttttaaggcagaaggatttttctgttacggtaaaatatgtatgacataaaattgaccatcaaagccctttttaagtgcacagtttagcagcattaagcccatttacattgtggtgccaacatcaccaccatccatccacagagcatttcaccttcccaaactgaaactctgtccccattaaacaacaactccctgtcccccagcccccaacacctacccttctactgtccgtctgtgtgaatctgactcctccagggacctcataggagtggaattatgcaatgtttgtctttctgtgactggcccatttcacttagtataacaccctaagcttcctccaggggtcagaagttccttccttctgcaggctggacaatgttccgctgtgtgtgcatgccacgttttgcttacccattcatccaccgagggacactctcgtggcttccaccttttggctgttgtgaatagtgctgctatgaacatgggtggacacatgtctctttgcgtccctgccttcaattcttttgggtatatacccagaagttccattctgggctacgtgataacatttaatttttttgaagaactgttaaagcagcaaaacttgtatgcatcctaggattacatacttcagtagagggcaatcctctgatatagttacagttgaataacaacaaaggaagccacaatggtgctcatggattactgcagatgactggatttagcattaaatatcgagtcgggagagctcggctcaatttccttagagatgagagcaaggagcctgtccttttctctgtatcgctgctaccatgtgtgagcctgcaccatggaggggaccagccagcgcatgctgaatgaatgtggtgctcatggtgcaagcctcacttcctaatccatcagcggggtgaccttcagaagtcacttacacacatggagcttgtgctttctgactctgtgaaacatggttaatagattttaccctgcctactttgtatggtggatgagagtgaaagtaaaaaaagttggtaaaagtgctttgtaaatggcaaaggaatatcacaacctagggcattctacaatcaataaaatcaatattgtgggagaccagaatatgccaccccaaaatatgctgcataggcgtgaggggcgctgagctgaagatacataagaagcagcagatgcaggagagctctgtgtcctccatttgtctaaaatcaggacatggattaagacaaaaggtacctacccccaaccagagaggacaaaggcttcccctagggacagctttggatgcatgtggtcccacctgggaccagcctccataggccagccctgcacctccccaagctgcagcccctggagaccctaaccctcttcctttgtcttgccaggtctctaaaaattctctgttctttgttgcagataccatgtaggctggattcaaagccacctctgtgaggatgactccttctctgggcatctcgcatgcataaatgagaagatgtgtgttaataaacttctttttctcttgttaatctgtcttttgttacaggggtctggtccagctaagaacttatgagggatgaggaaaacgtcattttcctcccccataatattatcaatattaatattgattaagtaaggcatgaacagaggcttataacctggttactttcattttttttagtttttattttttgagacggagtcctgctctttcaaccaggctggagtgcagtggcgtgatctcggctcactgcaacctccacttcccgggttcaagcgattctcctgcctcagcctcctgagtagctgggactgtgggcacacaccaccacacctggctaatttttgtatttttagtagagacggggtttcaccatgttggccaggctggtctccaactcctgacctcaggtgatccacctgcctcggcctcccaaagtgctgggattacaggcgtgagccaccgcacccagccaaacttggttatttttaaaggggccacaggttgctcaagtgtctggatgacccctgcataacctaaaacagcctctcagtccagcccctggctgcacatccgttcacgtctcagcacgcagaagcatctttgcaatggaccagtggccctgggtgacctcttaaacaactccaagacccacagtgagatgccaggcgcctcagacctggctgctcgcttgactcccctcccatcggagcagctctggtccagttccatcaagaacccacgggatccacacagactctgaagtccgccttccttcccagttccctcctcccctgtcccattggcaacatcagccacagcccttcccttcctctctttaccactggcttttctcaaaggcaagaaattgggcttagatttataaacacatccttgaattcagaacctaatggaacttgttcccgggaaatgtgaaaagagagaagttcaccaggtgcctgctagctgctccgagcggggctgggagcagacacagacactgaacaacgtaagctttcagtggcaaatcaccccggagccctgcggttctcaatctgacagctgctgacttgctgctgtcggggaaccaatctggagtgagaattggggtgcagagaaaatccgtaaacttagttgctccctgcgctatgacggatccatttcccatcccaggtgaaccgcagctctgcgtcctggttgtataaggagactactgcatcatctctctaacttggaataaatatgcagatttcatccaaattgtctacagaagacaattttacataaaaatgttactgttgaaaagttttttcaaatgggaaaatgagaatgataagaacaactacgtttaagcaagattggcccctggctcaagagactgaaggttctcgtttctgtttcccaacaccactgctgacgcagctcaagccgcctctgacatccccgctgtccggtggctctgcagtgggagggggcagagcctgtctttgcggatagagaggcctgggtctgcagtcggggaatgctcacctccggggccacgaaattggccgtgtagcagggtgtcatgagcagcccgttccccgcgcgcagctgcttggcaaagccgaagtcgcagactcggatggattctgggctccccgactcatccctgtacaggatgttactcggcttcaggtctcgatgaacaacctgcaagacagaaggcacagtgcctacttgggggctgaggactgagcaggagagggagggcaggtgcatttggaggggagggtgcatttgggaactgtcttcctagcaggtcctgcaagcaggcaacaggccaacagtgtcaacagctgctgtcttctccagagggccccccaccttctcccattctcctgtggtggtcactcacttctgagctcctggtgtcacctgcttttacagtgaatgaatatttgagtaaataagtgagcacctctccaagttgaggccgcagcttactggagctgtcacataaaaggaaatgtggtgagctctggagataggaatgaaaagcattttaaagatgatattcattcaataactactccctgtgtgcccacccccatgcactgtgaggtgttggagcagcaccagtgagcagcacagatcaggcacctgctgtcctgggtgcagcaactcgttggggagacggaccagggccacgcgatcatgcagtcactctgcaatcatgctctgaggcctcccatggaggactgcgctggctgcaatgatggtggggccagcacacctcaaagcaaagcagctatttagggcacaaagcaatgtgttctgaggggacagagggccattgtgaggacgtgtggcgtgcctttgtacagcttggatcctgaacatctcaattgtcctaatgaaatccagtgggaggatgtagaagggaattaaagggacacactccagcagtcaggcctggtttacagaggtcctgatggcaaggcaatcaaagactgtggctttacttccattacctcccctcattaaatacaagcagatctgcagaaaacatcatccaaagggcttcccctgagtttgactgtactgggaaaacctggaagtaagtgcttaatgctcaagactgggtgaccacacagaaaagaccccagtgtgtggtcctggaagaatattcccgtttggagatgactgcattctgaaaactcaggactacgcacacagctggctaagacagtatttcctgcttcaggagaaacactgggaagagatggcgcacagaggaaacatgtgatacggtgcagctgcctccctgtgaggccagggctgggaccaagagcactgcctggaaccagagagtgggagtccaaccccactggccacctactcatgtgtgaccttggccaagatactcaaactcctgtgcccctcgcctgcacagtgggtgtgatctagggttagggagtcagtgaatgaagagcttgaagtgcagcctggatcacggtgaggcccacgtgaacctcaggcatcaccgtcatccctgcctcagcgtccctgcgctccggttaatgaattctttacccgttgcaagtaacgaaaattcttaatttcttttgattaaggccaaagtatttttttggctaaagttggtaaaaatgattttagaccctcaaagggtagcagagtcagccaccccaaaatatgctgctttggcataaggattatttggagctgaaaacaactgaaaagatgcagatataagcaaagctctctgccctccccttctttacctaaaaggaggatataaatgggtaaaggtgtccctcctgtcctctctgcctggaaggatggaagggaaactcctctagatgcttacagcctggagaagcttccagaataatctctataacaaatgttcctaactagccctcatcttctgttagtttcccatagacttagcttcccacagtctgctgccttagaaacacagtcctttttctttgtcttctttaaaaattattattctttttaaaatttaaaaaattttaaaatttgagctcttttagggctcctgaaggaagcactaaacatggaaaggaacaacaggtaccagccactgcaaaataatgccaaaatgtaaagaccatcgagactaggaagaaaccgcatcaactaatgagcaaaataaccagctaacatcgtaatgacaggatcaaattcacacataacaatattacctttaaatgtaaatggactaaatgctccaattaaaagacacagactggcaaattggatagagtgtcaagacccatcagtgtgctgtattcaggaaacgcatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgaatcacctacaaagagacttagactcccacacaataataatgggagactttaacaccccactgtcaacattagacagatcaacgagacagaaagttaacagggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaagagaaattataacaaactatctctcagaccacagtgcaatcaaactagaactcaggattaagaaactcactcaaaacctctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaaggaggaaagatccaaaattgacactctaacatcacaattaaaagaactagaaaagcaagagcaaacacattcaaaagctagcagaaggcaagaaataactaaaatcagagcagaactgaaggaatagagacacaaaaagcccttcaaaaaattaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaacagcttaccaaccaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcatatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatcgatgacaaacccacagccaatatcatactgaatgagcaaaaactggaagcattccctttgaaaactggcacaagacagggatgccctctctcatcactcctattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctctttaagctgataagcaacttcagcaaagtctcaggatacaaaatcaatgtacaaaaatcacaagcattcttatacaccaataacagacaaccagagagccaaatcatgagtgaactcccattcacaattgcttcaaagagaataaaatacctaggaatccaacttacaagggacgtgaaggacctcttcaaggagaactacaaaccactgctcaatgaaataaaaggatacaaacaaatggaagaacattccatgctcatgggtaggaagaatcaatatcgtgaaaatggccatactgcccaagctaatttatagattcaatgccatcccgatcaagctaccaatgactttcttcacagaattggaaaaaactactttaaagttcatatggaaccaaaaaagagccgcccgcatcgccaagtcaatcctaagccaaaagaacaaagcttgaggcatcacactacctgacttcaaactatactacaaggctacagtaaccaaaacagcatggtactggtaccaaaacagagatatagatcaatggaacagaacagagccctcagaaataacgccgcttatctacaactatctgatctttgacaaacctgagaaaaacaagcaatggggaaagggttccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaaatcaaaaccacttttcattaaaaagttaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgttcaacaatgatagactggattaagaaaatgtggcacatgtacaccatggaatactatgcagccataaaaaatgatgagttcatgtcctttgtagggacatggatgaaattggagatcatcattctcagtaaaccgtcgcaaggacaaaaaaccaaacactgcatgttctcactcatacgtgggaattgaacaatgagaacacatggacacaggaagggaaacatcatactctggggactgttgtggggtggggggagggggggagggatagcattaggagatatacctaatgctaaatgacgagttaatgggtgcagcacaccagcatggcacatgtatacatatgtaactaacctgcacattgtgcacatgtacctaaaacttaaagtataataataataaaattaaaaaaaaatttttaaatttgagacagagttttgctctgtcgcccacgctgaagtgcagtggcgtgatcttggctcattgcaacctctgcctcccaggttgaagcgattctcatgcctctgtctcctgagtagctgggattacaggtgtgtgccaccaagcctggctaatttttgtattttcagtagagatggggttttgccatgttggccaggctggtctcaaattcttgacctcaggtgatccacctgcatcagcctcccaaagtgctgggattacacgtatgagccactgcatccagcaaaattattgttcttttgttaaaatgctatataagctcaagttctaacaactccttggagttattcatggctgggtgctcccgtgtgtatgtgagatgcacatgttaataaacttctgtttttctcttgttaacctgtctttggccagtcttgtttatagggcctccaccgaagaactaagatgggcagagggaaaaaagaatttttcttttctttttttttttttgagatggagtctcgtcctgtcacgcaggctggagtgcaatggtgctatctcagctcactgcaacctccgcctcctgggttgaaataattctcctgcctcagcctcccgagtagctaggattgcaggtgtgtgccatcatgcccagctaattttttttttgttgttgttatttttagtagagacagggtttcaccatgttggctaggctggtcgcgaactcctgacctcgtgatctgcccgccttggcctctcaaagtgctgggattacaggtgtgagccactgcacccggctgggaagagaatttttcttcccttgcaccgtcactgagcctccagacacaagagagacgatggtggcacggaaggaattccaggacaatccgcgttctcagctcttgaacccataaacccttgtggttttggttcctgccctgaagctccctcctccccgaaggctgccccaggcatggctcctaccccctgggaatggaggtagtccatggtcttggtgatggtgcacaggacgtcactggcttcgcgctccgagaagtatctctgccggaggatgcggtccaggagctccccaccacgcatcagctccattaccaggtacacaaacttgccatcatcatagacctgcggagtggagaaggggcgcacacgtcaccacggctggttgctgtgaaagagcaactactccagaggggacaggagagggaagtcagaggggagaggctgggaccacagggtcctatgggagtgcaaacaaggcttctgcagggtagaagcaaatggccattcctgtcataccatatgtgctctttttaggaagaaaacggctttaataatctgctgctaagcagggactgagtaaggacatacaagatgggcgtgtccttagctgagatgaatggcttcatgactctgccaggagatatttgttatttatttattattattattttttgagatggagtctcgctctgtcacccaggctgaagtgcagtggcgccatctcagctcactgcaacctccagctcctcctgggttcaagcgattctcctgccttagcctcccgagtagctgggattataggtgcacgtcaccatgcccagctaatttttgtatttttagtagagacagggtttcaccatgttggccaagctggactcaaactcctggcctcaagtgatccgcctgcctcagcctcccaaagtgctgggattacaggcgtgagccatagtgcctggcctgccaggagatatttagacgttaagaaatgcaaatgttggcaaaccaccttgcaagagcagggcctcaaggcagtgcttttcaaactgtaacgtgcatccaatccaatcttggggatcttgctaaaatgcatgttctggtcctgcagactgaggtggggcctggccctccgcatttctaaccagtttcccatgatgtctgtgctgctaccgcatggacagcactgagtggccaggcgctgggagcacagagaggctaggcagagtccagggcgaagttacatatcagagccgtgctgttgcttcagagaagcaatagaaaaagatagttttctccatactggcttttatctcataaactaaataaaaacaatatgctctgattattctttttatgtttcgattttttgagatggagtctctctcagttgcccaggctggagtgcaatggtgtaatctcggttcagtgcaacctccacctcccaggttcaagcaattctcctgcctcagcctccggagtagctgggattacaggtgtgcgccaccacacccggctaattttgtatttttagtagagatggggtttcaccatgttgaccaggctggtctcaaagtgatctgccttcaggagacctcaagtgatctgcctgcctacgcctcccaaagtgctgggattacaggtgtgagccaccgcacccggcctgttcgggctattcttatgccaagcttgcatgttaagaccgtttgcacgcagcagtcactatgcatgagggaaactgaggtaggcccaatatcctgtgactctaggttcataatgctagaatcagtttggagttggagcgtgaggaggaaaattgtctcctgtctgtgctcccggatcccaaaccctgcacccccatgggcctctatgagagactccgcctgtggactgtaattcacacaagctctctcttcctctgttttacttgctccctccatgactggggcggtggctgtcaaaaagacttgagtacacagtccagcaagtcagctccaagtgactgagatatgtgggtggtggaaaccagctgagacaggcatgagatgtgagaaagcttgctctgagtgaatgggagttttgtgtcagttgaagaaacagaaggaagtggagatgctgttgcacggggaccactcacatccttgagggtgatgatgttcgggtgctggccgtaccgcaggaggatctcaatctcttccgaggggtctctcttgctcttatcaatgatctggaacaaacacagcacatggcagtgaggggtctactttaggctttcgggtggtatctgctggtggaccattgagtttggataaagtctggccccaggtggcccaatcactacaatctcacacccgaccaagagataacctgagattgtctggagattcatggcaagtcctttctttgacaactagtgtaagatttacatctacaaagaggagtacaggctgggcaaggtggctcatgcctgtaatcccagcactttgggaggccggggtgggcaggtggcttgaggtcaggagtttaagaccagccagcttggctaacatgacaaaacctggtctctactaaaaatacaaatattagccagacatggtggtgtgtgcctgtaatcccagctactcaggaggctgaggcatgagaatcacttgaacctgggaggcagaggttgcagggagctgagataatgccactgcactccagcctgggtgacagagcgagactctgtctcaaaaaaaaaaaaaaaaaaggagtacaagacttcagacatgaattttaaggtgttataaggttgggtggagacacgtgtagggagctcatgcaagtgccaccaaataacagactgtgtcccaccctcgcagtgggcaccatccacaacaagcctccagccactgtgcaccttctgccttgttccgggaattacaaaccagccacaaaatgaggtgaggcgcatggctctcaccaagagatgctggggatggtgcgcaggccagacctgccttgctgtttagacatatgcaagctcccctcccccgcccagcatctgtatccgatgtcttaggataacagataaagttgcttcaaccccatggagacatatggtttctgaggacagggtgttgggatttaagcctaccttggaaacaggaagtcgctgttggtccctggtggctaatccctctggaggtgcctaagtcccgcccttgccgcccctgctgtggggacgggaccagtgggaggagggcaccacactcatgggaaattggcaacatgcaacatgtattttgcaaacaacactcagagcagaagaaaagcgattggaaacaccttcctaaccatgatttgtactattctcacattagttcaacctaattttaaaatagtctctatttggagaccgtgcagtcattttactactagaatatgagggtgacttgcttttaacttctatcatgtcaaagtctctaggcagagctttgcataaaactctatttcgttaattttttttggagacagggtctcactctgttgcctaggttggaatacagtggtacaagcatagttcactgcaacatcaaacccctgggctcaagtgatcctcctgcctcagcctccagaataactaggactacagaggtgtgtgccaccctactcagctaatttttaaattctttgtagagatgatggggtcttgctgtgttgcccaggctggtctctaactcctggcttcaagtgatcctcctgcctcagcctcccaaagtgctgagattacaggcatgagcaactacacctggctatttctttactttagagaaccaaacgcttgggtagcatttgactcactgctcataatctgtcccctggtcacccttcgtccactccccgtcaccgttataaaaactcaccatagtgccagttctcaccccattatagtttcaaaggatgctctgccacggccaccattcagctgtgactgcatcagtggcccatgatctgtgagtcctaatagcctgcgttgtaaacaggcagaagagttagggtccctttctggacatagaatttctctccttctgctgcatttaattctactgaagttttagctaggacactaggactaattctattgccaacataaatgcatcattctcaagtagagacttttaaaacgatcattcaaggaggggtgggggactttccctaacatgccacagcctaagcaggtcctgggaggctggtcctgcactgcttgtagggaagctggctgtcaggtacccaaactcctctgctcctgtctgcctgtgggcatcccgtctatcggggccgggatcctgtctttgcaattagagaaggttaaaatacatttataaatttataaaagaattcagtagaagattttttcgcaaatatgatttcatgataaagggatgtgttcttagcatgaatctgttttatcactctcacagtggaacaagatgcagagtaaacaagaaagtgggagctttttctccaccgccacggaccatcttcaagatacaaggagtaaaaaaggccgacgcgagcaggtgcatcctacgccatcccttgttttaaaaatggagagaagaatgcagatagacgcatccatttccttgtgggtgcataaaataaccctggaaggaaggaggaaacatttaattgccttgccttcctgtgaggaggggaacagggtgcctgggggcccatgggtgggagggaaactttgctgtatccacatgaatttttaaaaattttgaaccacaagaatatattgtctattcaaaatatgaaataaagaattccaaaatttcagcttactattttgtaagctgaaattgcaggacaacgtgactattattttaaagaatctgggactacagatggctgccctctcaaccctagtatctattttatttctatgtgttcttttgttgtgagtcttcagaaaaattctgacttacaatgataagtatttgtaaacagttttcaaagacagattaccttaaactcttgcttactttaaaaactatcttaaattgtaataaaagctagcatgtatgtgcacatgtgaggcacactggatttcaacccatcggagccagtgtcctggtcatttgctagaatctgatacacatttaagcatgcatgttgactttcattacattttcaacatattagttacgcctttcaaaatcatgtaattgcttggtggaacccccaaagcacctctgtcaacaaccaaacaccacacaccagctgttcgctgaggtggcatttggggaaatggaggaaaatgaaagaagctcccaggctgaggtcctgtggggacaggagctcatctggaggagactccaaggggcccacgagtgctgctgtttctcaccacagggtagagccagcggtctttcagcaaacatctggtttgctcctgaggggaagtcacgtttgctgtctcaggcgacaacactgctgtgggtgtgggtggcttggcctgtggccatgtcacttgctggtacttgaatgtgggtgtctgcaggctcagctcccgtggagggctggaaaggtggaggaaggcgttgctcctggggaggccacgtgctgcgtggttggcggcccagccgctgagccagtctgagccccagctgagacctggcctccctgtccactccctgtggggttgcaggagctccctgggcctctctacacctagctttcttcatctgtaaaactagaaaacaccaggcactcctctggctcactgttaagattcaacaaattaatatgaatcgatcccttcatactctccctggtacacagaaagcacttggtacaagtgagttattcctattacagagataaaatagaattaccctgacaccgccaggcaagggactaagcagctgtgacctgccacgtttacagccctgaaatgctgctttcggtcctgtctgaatcctcactgcgagtccgtgccatgaagcagtgtgatgtttaaaactaatgtcagcagtagagcgtgtttcagttaaagccccagaaaaaaaaaaaaaaaaaaacctcagatgtcacaccaactgggtcaacccagaggccttaattaaaggatcgtttgcaaaggagtagagtggctggagggtcactggccggccagcaaggcacagtgtaatgccttgggggcagtcctggctctcaatgccaaagagctgcgcagggtcagtcacaggaccagaaggggctgcatggggtggggaggtgcgccctgacaggggctgtgggcagaaaggcctcggcccgacacttctcttcccactcttgtcctgtggtgtctgtctcgcactagcagaactgcccaggagccagaggcatggaagtggtccctaacagtcagcctcctggcttccttgcctcctggcctcccagcctctgaggcacagggcagcgaggagggtgggtttgcatgggaaatggcgctccccgtcctggaagggaagtcccacagactggggtctctcctgcctcagcctcccgagtagctgggattatagggcacatcctggaagggagtcgtggcgggaataggttctcacacgaccctcctgggctcccgccttcccctgacccgggagaattaatccaaatcaagccaaggctctgagatgaagtggcaaggcagttctgacccagcgtttccgtcccggatgctgtcaggaagtgctggctgcttttccctgtaactttttctgaaaaaaaaattttttttttttgcttttgtttttatttttgcatggagggtgagctatttgagcaaggtaaggctggagagtgctaacgcaggagtgggcagtgaggtgtggctacagtcctggagtacatgacctggatctgctgcgggcagccggggtttggacacactgtttaggagcaccagggagtgggccccaagtgcctgccagcgcacttcttctctatggggtcggtttcttggggttgaccgtgttggtcttactcttattagagcaagctctggtggacggcgttcctcattctgagaataatattgttttataatctttattatgcaacaaaacagggaggccttctcagcaagcgtggtgatgaacaaggcctcccctccaggctgacgctcaaataatgctgacgcgccacggagtaggagtggtgtcgtggggcgggggacaagctcgctcagctttctttttctcatctggcaacagctggttagaaaggactcctacaacctccagagaagggcattctccaggggttggccacccaccacagccggtaaataaactttccatggtgttgccaccgagcaggctgaatatttccaccttccttagagatgctgagtctaggggtctgaatatccacgaagcaattctgggttcaacatggatggcacaccaccatgatcttcctgagcacggacacatgcagccatgtgccaaacaaacactgccattcctgctggccgaaggcgacaacaggagacttcgctgctcttgataacacctttcctcctgctggccgaaggcggcaacaggagacttcaccgctctcgatacacctttctggtctttgcgtttctctaccttccctgtctttcttgtctctctccatcagtggagacaccgtctcccgggacactcagcaacctgagcagatggctttgaggcagtaactacgcgggcagtggcatgagctcacaggcttgcagaacactcccactaggcaggccatttcccttgagttgccgaaaggatcagtatcgtatttgacacaaaggtaggagagcatgtaatcatttgtaaaatttaacagacaccttctcctgtaaaattaatttaaactaatgacagagagaaagaactcctgttttatcctggtagaaaaagttaaaatttccaagctcatcagttctccttctaaaaataagctctattcatgccgaacatctgtcttaattccgtttctttttttggttggcaaattacacacacagtgtgaagatgggcacagaaacaccacgttcttttcaacggtctcacgtgagtacagactggagcctcctcaggaaggctggcccgcgctccaggcctgcgtggtcacgccgcgtcactacagttaacagctgggtgacacatattcttgcacagttctaaggatctcactttatttcttatcagattctgttgctaaagcaaactaaggtactttcaataccataacaacaaaaatttgctaccgaaaagggagagtagctgcatcttaactcatgtgcttctttctaggaaaacccagccccactgagcttgtgcggtcttcttctcctgcacgagctttcagacaattgaagggaaatttacaagtgcaacagtcagtgaacaggcacgtatattggtaccatgtgtttgaagatacaacaggccaagagaaagagccaaaccaactgtaaagctcatttaatttcagattccggagatgcactccactttttggtatagtttctggttctgtcattgacacaattcctaaatggctaagctgtgagctccctggagcaggtttgtgttctcaccttgccctgcgtctgttgcagtaaaagcgtccaattaaaaaaaaaaaattctcaatgaatgaaaaaagtaaccagcttcctgaacaaggggattgctgcagaaagaaatggattccaaaggcacgaagtgctctgttgaagaattatattataaaccccgattttaaaaatttgaatttgaaggaaagctcctgattcatattttttcttgtctttatttttaattaattaattaattaattatttgagatggagtctctctctgtcgcccaggctggagtgcatggcacaatctcggctcactgcaacttctgcctcccaggttcagatgattctcctgcctcagcctcctgagtagttcggattacaggcacgcgccaccatgcctggctaatttttgtatttttagtagagacggggcttcgccatgttggccaggctggtctcgaactcctgacctcaggtgatccaactgccttggcctttcaatgtgctgggattacaggcatgagccaccgtgcccggccatatatttttcttttaatcaacacttagcctttcactaccaaatatttatgctaaatgaagataaggagccccttcattgtgtgctgaaattgagtgagctcctgccatgtgcccgactttgttgaggtgctggaactatagcaaaagcaaagcctttgttgccctggagtggctgccctcacagggccgtgcacacagacagtgaacaacccatgcagggggaacgtgccatagggaagatgatgtgggtgaggggggctgctggctgcaaaagatggaggcggggaactaaaatcagggcatcctgtgggctttgggtgcatatttgtgttctctggttggtcctgacttggaagcagggacagaacttaggaagctgtcagtcattcatcaagtcctggccatgtggggctgactgtcacagaatttatagttcagcttcctgggctgtcactagagatagcaatctggcttcctgcaagcctgacacagctgctggcctcccgagctatgtattgtagataaaggggctggctgcaggtgtgggtcagacttctgtcgggcacccagcctggccaccatctgctgtgtatccactctcagcccccagagcccgcggaaggaaccagccttggggacactggactttagcccagtgagacagatttcagaattctgacatccagagctggaagacaataagctcaggttgttttaagccactagatgtggggtaatgtgttgcattcctaaacaataggaaactagcctgtgttgaaagaccggggagaggtttgcagtgggagagttgagagccaagttttggctggtgggtgggagcctgtgagatgggctcggggacccggtagtgggcagaaggcacatgctacatcttattgctgatgaccgtcctccgccgcatgcctgctgggaggggctgagcatacgagaaacaaaaccataagccaatcacattaagcctttctcgtttcgaaaaagcaaaagtgcagctcgctgccagcgctcatttgattttacataaacatgttcattaaggctgaaacaaatctgattttccatgtgaaaataaaatttaaaaactgttactggagttatttctaaacagaactaatatcagaatcatctgaatcatcagaattgtctattttggaaaaattggattcatcaaatgaatctttggccaacaactgtttgagaacgaagttaacatcccatgtaggaatgctacgttttctaggatttgacattatcagcaatcgattatgactatattttgtaaatggaaatgccactactaaaaacagaatgctatcgatagaatgatgtcctttgtttccaaagttggtatactagagcggtgcaaaaataataataaaagtgagatatttcgcggcaaagttatctcggggcaaacgctgcagccgcaagtgccgccggtgagtattcttggggaaaacgggcaaagggttaaatcatccagaaaggcagcttcccagtgtgtgtttcgaggagatacaaatgcccaaccaattccactgaggagcttctttgattagagaatgcctgtgcagagacacaggctggacagagcatctattctggcaggcgatacagtcattttcccgtcttcgagtctctctcttctggtggaagagaaatttatgccaccgttttcctcagtcatgcaatctgttaccaaagctgccccgtctccttccttgtccatctaaatgttgctttctttcttttctattttctattttatttaactgctcctagtcccggcctctgtgcctgtgaacgctcctttctctgtttccactgtggctgtgaaggcatctacagcctctgcctgtctctgcaccactgctgttcttgagatggttcatgttgctccttcacatagctcaactctcaactgctgtttctctttgcttcaaattttcacatgatttctatgaaaaatgcattttgatccctaaagacaggactggcctggacctctctcttcccaggtttggccacagtggtttgactcagctgcacagccacctctgttccccaagacgggtgcagctaacaccccacgtgatactgggaagccccatggtgaaaccatccactgctttctcaatggcttagaattctttgcaggacctggcactggatcctctggagtgaacttgaacacaagctcccctgagtcctctccttctccggccccgtgcggctcactgcagcgcccagcgttaggccatgggctctttcaagatgtagcttctgcaacaagcccaggtgctgccctgaggacgagcaggctgtgatccacaggagccggggctagtgctgccagtgacctcggagcacagactgaaaacagaggtctacatgaacgcagaccatcctgaatgctgtggggaaggaagctggagcagctgccgggggccgggggccgggaccctggctaggggcctcgcagctgagtgctggaggaaccaggtgcactgtgcctttggaggtgaagttagaggaagcggtccggctgccgctcagcacttacacagctgaaccatggcccacttggtggcagcaggacctttcactggggtacacccagactcataagaccaggagactcaggtgcgattttacatagagctccacttgcacctggcacaccttccccttacagcctagggactttggctatttatcaaacaatggatttttcttgcaggtcccatgacttgagctttccagctattctgaagcccagccttactgcccagccccatctgctctgaatactgcctcattctttcatggtttgggtactctgagatgcatagagcatctggctgaaacagaacactggggctccccgccttatgacgagtgagtctgctggacaggggtcgagagtgtgcactcggggtctgactgcttggacgggaacctgctctctcactgaccggctgcgacttctcgcatatgtgttgaaccgttctgagtttctgttccctcatggggataatgaaaataattacaccgtgggatgctgtgaggattaaatgacttcacacatacagagcgcttatagcagtgcttggcacgtactgagtatgaagtatttactctcgtcatcctcgtaactctcgtcaccatattctatctaacgcctgcagctcctggtctcaggaacttcagttctcgggcagtttcctcttcatatgtgtactgacgttggtgttttgcaaaagagggtcaaggtggcaaaattggcactcgaatgatgtaatgtagttttatgcctattatgacatctataataaataaaaacttcagtcattagtagagatggccaagagctctctcaaggtatgtgtattaagcttatgagaaggggagatactagtgacacaagctaacatttctgtagtgaattagctatgatatgtgtagacagttgacccttgaacaacatgggggttagaggtaccgacccctcaagaagttgaaaatgcacatataacttttgacttcgccaaaacctaactaatgtcccactgttgacttaaagctttaccagtaacataaacggtccattaacacatattttgtatttgtataattatatactgtattaagaataattatacaattatatactgtattaagaatacagtatataattctgtaataatacgatctagaggaaagaaaatgttactaagcaaatcataaggaagagaaaatacatttagtgtatgggactgtatttatggatatagtgagtttatgccatctgttcacaagatggatcgtctgtctgaaaaggggggcactcacagctgcagacctcaacctggggtacgtatcatgcaattcaacttttgttttttttggtcatgtgatgacttttctctgcctcttgggagcactcacagcgtccctagtggcacgggacttcttagtggttctatggtgttattcaaggtttatggaactgcactaaacacggtgaaaaatatgtgagaaccacaagataccattttttactgctattcccaattccctggagagacagactcctcacatggagacgaggagtgtcacaggacgtttaaagcggatccttccaacacctgagcttactacagcagcaatggaaggctgctgtgaaattcttacggtagtgccatattcgccacagttaatttgctgcagctatgatttaatgctgaatctatgtttgtttacatttatctcaactgcaaatggcgccacgtatggtctatgcttgagcacataaattttgatacattttaagtttgtataataaatctgtgtatattttatagtagaaaatgataaaatagactagcatctatgtatattttatgcatcctgacataccattttcttaactttttaaatatttctaggctatgtggtttgtctgtgagtttcttcaaattgtaacaaatctctaaaaaattttccagtatatttactgaaaaaaatctgcatacgtggatcctcacaattcaaccccgtgttgttcaagggccaactgtatatatttacatattcccccaccaatataatgccaggaatccttccatttatacaaatcagcactatctagaatatgtacctaattatgttaagcaacaaagtcctaagaataaaataaaaacaaataattccctctctcaattcttataaagtgaatacagcatctttgatggaataggaatattattttttctttcaaatacacctctccccttccttttaatcctcctggatcacgattacctccaacacttaatagtcacttctattttaatcttattttaaatgaagggtgccctaatgtgcggacagcaatgcagccatccgtcatgctattttgaagccctatacaacttcatcgcccaccactagtctccctgggttggttataaaaacaaaggcggactttagttttccattagattacttagctgttttgtcccaataaaatggcttgtagttattagaaagtagggcacatctgttcacctacaatgtgtctgataaaaggaagaggaagcgctgagggaacataatagcttttctcattcaaccatcagagcactggctgggggcaccggcagaatgcgctgcatcaagtccagcctgaaacagtgccgtgcgcgtgagaaggaagagggtcggtgtcttcccgcccgaggccggactgccccagtgaaggatcttggacgttctagtgttgtttgccgaagtcgagagggagggacaagcctgggaatccaggttgtcattcagcccacgtgaattgagcccctgctctaagctgggcactgtgttggagactgcgatagctagaattggtcttaattttagtcctaattttaggaccgattctagctgtcacttcccacaacctttggcagagtacccagcatatagcagggactcaagttaaaaatgcagctgaaaataaatgcaaagtgaacaatcttgtcgtttgatttactcaggtaaactggtttcagtagaaccttaaatgtagtttacgttattcagggtaattatggtggcaaaattagaaacctgcaaaaatgcagaaataacttaaagcaaaatataatgatattctaagaatgtgagaagtactatgattccatactcactatgaacctccatacctgaccgtcatagaggtgaagagctggccccactctcctcttagaaggacctgcactttaagtcacggcccagtcacagtggggtgggggtggggggctgcccgcagcacgtggggaacactgagctgttggtcggtcatcatcctgttgctaaaggactcaccagaaactcaatgaagaagaaaaactccatccccatctccaaaatatcaacctcctggcctttatctacatgagacctgctctcacccacaaggatgctgaggctgggcttctcaacctttcgttggggcagcaggttgtgggggctgtcctgtgcacacaggatgctaaccagcttccctgacccgtattcaccaatgccaggagcccctgtcccagctggaaaaaccagaaagtctccagacattgccagtgtcccctgggggccacagttaccccaaatgaatatgactgccctgggcagaatccatcgattctggtcactctcctcattgcttactaaagattgctgcatttctctttctgtcattactcggtggggacatttctgggtcatccctgccattgaatgggaggatgccctgtctggctgtgacgggactgcttctgaagcagaccccgtttgtatccatgagccaggggtaggtgggatcgtatacggctcaagcggcaactgggagtggtaaagccggattctagtgacaatctcggctggacatctgctgagctgagatccaactcacacatcagataatcagctgccacatgcttagttctgggtcatgttagaagtcaccgaactttgctgtttcttagtccatcaataggtggggatgctgcttctcatgaacaagtcagcagatacagacaaaggccaaaagtatttcaactacattccacctggaaatgctgaaaacaaaaccgcacagtgctctgcactgggtcaaagcagttttggtaacaagtggacccattctaaataacaagctcgttgcacagaaatgccaattcgtccatcttggaaggaaatccaaacaaccgtgtctacctgcagataattgaacttgttgtcaccgctcccttgaccggctgaaacgtgcttctgaagtggctctggtcacaggagccttctggaccacgagccacatctctctaaaaagtcccgggccgttcatggggctgcaccttcccgtgctcggttaatttatgcatcttccagactacacattattacccactgtagtctcagaagggacaagggaaatccctgccatgtctgctggccaactttgtccagggaacttcagggtttgtgaaagagaaacaggaagaccgggctctttcttctaccatcggccagagccacagtgcctggcttctctccccgagagctgttgctgaaattccacagagtttgacctcaacaagatctttgaggactgacggactgagtttaagctgtgtaacaaagctgaattcagacagtgtccatataagagctggatatgggaatattaggagaaaacacaccatcgcctcgtcactgggggatttacttgcagaggcacaaaatgggggctgatccgcaggctgtttctggaagggcaccgcggctgctgggctgaccaaaccgtaggcttgtttctttgagctcactgggaagcagtgattgtttctgggattgctgtctgtcacctggtaaataatctaaagaaatcctgtgagcaatgactcaggcagaaaaaaattccaaggagcctatgtaggcttacgaagcacatgtgaaatacgtttcaaagtacaagtgaaattctcttgtctaaggcagaatacaggtctgctcttcaccactggaacatctggacacaggaacggcacctgggtatgcagatggtaggcgcccatctaagtgctcctttaaaaaactctcccaatgggatggaggagcaggacaaaccaatctcaacaatccaaatcctagaaacgcatgaagcctacgcgccccaggctgcagaggcaaccacttcataacaaaacttggttttctcctgcccttcacaccacgggtggacattctaccatgacagtaaccctcgctgcagtctccacccaattacagttccaggaactgtaaatcatgatctatttccttccattcacccttcctggatgtgttcaagactctgggcagactaaacacagagatggtatcagagcaaatcacaaattgattatttctccatatttaaactttctttttttgtttgagaaattcaagataaatttgtcaataatccataaattcttgacccaaacaaaatcaagggacctgagattttttttcggctggcgtcttctatgacagcaaagcgttttcccagtgcaagaaacacggtagacgttcccagtgaatatgcttgaggatcccaggccatgcttgaggatctacccttttgaaatacctgttttcacaaaatgtcagtggagctctgggcaaatgaggatggaactgggtcatctcaacattgtcattattttgaacaatctcttcagagtgtaggagaatcacagttgatgaaaattactctttttacacgacttgctggctgggcagatgttctttgaagggcaagcgtagcaccgtgtgctacagacgtgtctgggaataagccgggagggtcctggtcatgatggcaacacaggctgggacctcgctctgcgacagcctggggtttggctccactggaaaggggcagagtttcaagtgtctcttgctgtcttttggagaggatgtacaatgtatctttttttaacataaatttcattctgattttagcaggaagctttacctttaatccacattttactaaccaaaaatctctagaaactggtattctggattcccagatcaaatatttaagcagcaacaattacgaaagctaaagttactatgtagagattgccaaattgggttacaaagaattgtttctctatactgttcttgacggttgggagtaaaaccattagctctctgccaaagtttgttgtaagtaatacaagcttatttatttctttgagtattttcttcctcccttttttctttccttcctttccttgccaaattctatacctgtcccccaactctgttttctcaaaatactgggggcccaaaacttttgctcttggtgtatgtcatacaccaagctacgaaaggtgctcagtccctgcgtggtacatatgactgaaaatattcatgatttgcaaaactaccttttaatgggtgacctcatatcaaagcaaactgaactccatcatatcagagcttggaaaatggcaaatggagagaatgttcactcaggctcaggtgtccctgctggagtcactgcacagctgagcacgtgagcacatatgctgtgctcctatgctccgtgctcccatgtgctgtacatgctcccacacgctgcactcacacagggccctgctatgctcctatgctccgtgctcccacataccacacgtgctcccacgcgctgcactcacacagggccctgctcactcagcaggcctgccttaccttcacggcatactcggtgtctgtggctttatgcacacatcgcttgcacactgagtaggagcccaccccgatgtcctccttgatctcgtagccatcggtgaagtggatgttgttcccgtgtaactgctgcagagggaccaagagaagaagagttgtcggaaccctcacacgaggggacggtgcagctacacgcacacagaatgtggggcgaagagaggcaccgactgtgaactgagtgtgtggaggcctgggagctcatgggtccccctgcccaaggctgcagagctacttagtgatgttcttgacctaaatgccagcttctctgattccttgggctatgactcttaactttgagacaccaggccgttctgtgtccactggctggtatgtttctcgcaaagatctgagagcaggagaatgtgaaagtgaaaaggaagtgctggcagctgctgggtgcgtggctccaatgcctgtgtgcagagcaagactctggatggaaacatctcatcggaaatctgactccatggtgtccaagtcacagcctgctctgacctgcatgcagcagccccacccacccgctcttaactaagacagaaagccaccatggcagcctgcactgtcatgacaacgtctactttacacacctgtatttctccaaaggccagggaaggaaataggatggaaatccaatgccattcaacttacccggatttcattcttaaataagtttaatcataattagaattaagtttaaccccttagaattctctgtattctggttacatttattaggtgggaaactcattatgaaaataccaccttccaaagacctcccaaagattccatttcatcatgggaaaatgatgcccacaaattaaactgctaccctagggtcctggctgggctccacacagtgaagatgctccagtctctggccatagacaccatggtgacattcttcccagggctttaccttccctctttaagacgaatgccaagtagggtaggagcaagggctcagaacaccatggaataccaccacggagaccattacagggaccaccatgggagccaccacggggaccaccatgggaaccaccacagggaccaccacgggacaaccacgaggaccaccatgggaaccaccacgcggaccaccatgggacaaccacgaggaccaccatgggaaccaccatgacagactaccacagggaccaccacaggaaccactacagggaccaccatggagaccaccacagggaccgccatgggaaccaccatggatgtcacctaagggaccaccacaggagccaccatgggaaccaccacagggaccaccgtaggagaccatcatgggtaccaccggggaaccaccatggggaccaacatggagaccaacacagggaccaccatgggaaccaccacagggaccaccagggagaccaccatggggaccaccacaacagggatcaccatgggaggctaccctagggaccaccacaggaaccaccacgggaaccaccacagggaccaccataggagaccatcacgggtaccaccagggaaccaccacggggaccaccatagggaccaccagggggaccaccacagggaccaccatgggaggccaccctaggcaccagcatggggaccacgacagggaccaccacaggagatcaccacagggaccaccacagggaccaccatggggaccaccacaggaaccaccatgaggaccaccatggctaccaccccagggaccaccctgggagaccaccatggggaccaccagagggaccaccccagggaacaccatggggaccaccacaggggaccacccaagggaccaccatgaggaccaacacaggaggccaccatggggaatatccatgggagaccaccacagggaccaccccagggaccaccctgggagaccaccatggggaccaccacagggaccaccacagggaccaccacaagggaccaccccagggaacaccatggggaccaccacaggacaccaccatggggaccaccacagggaccaccacaggaggccaccatgggagtatccatggggaccgtcacagggaccaccactggagaccaccatgggggcccacaatgtgagaccatcacaggaaccacatgaaggagcaccacgtgagatcatcatggggaccgccatgggggataaccacgagggaccaccatggcagacactcagaacaatgggaagtgtgagggaagaattggtgattaaagtccacccatcctaagcacccaacccccgggtgactgaggccacagggaacaccagagtcacccatcatccaagtgccctcttacccccaacccactgcaggcaaacacagttacctgcacgattgggtgaactgggactttgtgcagatcttgctgtgagggctcctggatcaggcttgaggccacaaagctgaatcctctaaacaggtgatgagcgtttgcactcggggggacgccaggagagtctgtaggtgacaggggcagagttcagatgccacgaaagctgggtgaccctggggtgaagtgatagtgtgtgtgtgcatgtggtatgtgtgtgcaagtccgtgtgtgtgtgtgtgtgtgtgtgtgtgcacgtggcgtatgcctgtggtggaggaaaaggtaaaacagacatgtagaaatgctgaaccagatgaaactacattcttttggcttgtgctaatggtttgatttttaaatggcaaaaatacccagaacaaaaacttcaggattatcattgatggcatctgttagtttgccaacttctgaatttactctatattcttgaccacactcctccacccctacccactccagactcagttaagaaggcaccaatgacctcaggatggaattgtcagtgaacatgaatcctgtatccttagcttctggtctctaggttcgacaggtcccacccctgtgcccacagctgcataactgcatgtgtgctgtgcacgtgctctgctctccaaggacatttgggcaacgtttctcctgtccacagcaaggcatagtacgaaaggagtaattcccttccattaagatttttctgatctctgtaagatctgtgttcaaaagcatgactgctgtgagattgatcccatttcaagtttatcattaagaaaaacaaaaggataaatccctcgtggggaaaaaaaatctgcatcatacataacagatgagaggttaaactctctattgcccgaaagctcccagagatcaatgagaaaagagcaaaatactcaaaggaaggaattctgatagctaccataggcatgaaaagatgcccaatctctctaaggagtaagcatacacatatttaaataggacaacacttttgtctaatgaactaacaaaaatgaaagaaatcaatcacatctgggtttggctgggggtggacacttataattgtaggagggagcataactggcataatcttctggaaagtcaactggcaacatttaaagccaactttaaaatttcaaaattaaaaattttgaaagtaattctacagaattactttcaaaagtgcacagtaataacaaattgtagatgacgcaaacaaatggaaaaacatcacatgctcatgaatcagaagaattaatatcatcaaaatgaacatatcacccaaagcaatctacagattcaatgcaatctctatcaaaaaaccaacgtcatttttcacagaattagaaaaaacaatcctaaagttaacatggaaccaacaaagagcctgaatagccaaagcaattttaagcaaaaggaacaaagctagaactagaagcatcacattacctgacttcaattatatcacaaggagatagtaactaaaatagcatggtactggtataaacatagacacacagattaacggaacagaatagaaaacccagaaataaagccacatgcaaagtcaacaaaaactttgtggggaaaagacactcttttcaataaatgataccgggaaaattagttcgtcataagcaaaagaatgaaactggacccctatgtctcaccatatacaaaaatcaactaagagattaaagacttaagtgatgaaagacctgaaacaatgaaaatactagaataaatcctagagaaaactctttaggacatgggtctagcgaaagacttcgaaagtcttttaagggctgggtgcagtggctcacacctgtaatcccagcactttgggaggctgaggcaggtggatcactaggtcaggagttcgagaccagtctggccaacatagtgaaaccctgtctctactaaaaatacaaaaaaaattagccaggtgtggtggtgtacgcctgtaatcccagctgcttgggaggctgaggcaggagaattgcatgaacccgggaggcggaggttgcagtgagccaagatggcgtcactgcactccagcctgggcgacagagtgagactccatcacacacacacacacacacacacacacacacacaaaaaggctttaagaccagcataagaaatcatcaacagaatgaacagacaacctgcagaatgggagaacatatttgcaaactatgcaactgacaggggagtaatatctagaatttacaaggaactcgaacaactcaacaacaacaacaaaacaaataaccccattaaaaattgaccagaggacataagtagacatttttcaaaagaagacatacagatggccaaacagcatataaaaaatgctcaagatcgctaatcatcagataaatacaaatgaaaaccacaatgagatatcaccttacatcagtcagaatggctattactaaaaagtcaaaaaaataacagatgttggtgaggatgtggagaaaggtggtgggaatgtaaattagtacaacctccatgaaaaacagtacggaaatttctcaaagaactaaatggaactatattcgatgcagcaatcccactgctgggcattgcccaaaggaaaagaaatcgttgtctcaaaaagatacccgcacttggaagcttactgcagcactattcacaattgcaaagtcatggaatcaacctaagtgtccatcaacaggtgattgggtaaacaaaatgtggtacatatacgcaatggaatactatttagtcataaaaaagaatgaaatcatgtcttttgcagcaacatggatggaaaagaaggccattattttaagtgaaacaactcacacgtggaaagtcaaacatcgcatgttctcactcataagtgggtgctaaattgctaaataatgtctgcatgtggatgtcgagtgtggtgggatagagaatggagacgtggaagggtgggagaaggtgagggatgagaaattacttaatgggtaaaatgaacactcctcaggtgatggttacactaaaagaccagccctcaccactatgtactctacccatgaacaaaactacatctgtacctctgaaatttacagaaataaaaaataaaacaggctgggcgcggtggatcacacctgtaatctcagcactttgggaggctgaggtgggcagatcacgaggtcaggagttcacgaccagcctaaccaacatggtgaagccctgtctctattaaaaatacaaaaattagccaggcggggtggcgcacgcctgtaatcccagctactcaggaggctgaggcaggagaatcgcttgaacctgggaggtggaggttgcagtgagccaagatcgcaccactgcactctagcctgggtgacagagcgagactctgtctcaaacaaaacaaaacaaaaaaacaagcaaacgaaaaaatcccaaagtacttagacataaatgtagaaaaagtctgtttcagtgatatgtgttacagaaaagaaaaaggagacactaaatactcctcactaagacaatcatggtcatggtcaacagtggcccatctgtatcaggatgctttgtaatgattgcagtgtgagtcctgccagcgagaccagggccatcagaaggagccacagttgcatggactgacagagacgtggcttcctaatcgtttgtcaaatcaaaaaagcaaaaagctgttgaacaatatgaagaacccagacattacttaaaaaattaaatatattttaatatatttaaaaacagaataggataatagattaatatattaaaatagaatatatattacactaaaatagaatactataatacattatataatatgtaaatttataatatatgaaaatataatacgtaatttttcctgaaaacacacatatgtacaaatttaaacattcttatttatatatcttttaagactccctgtatgtatagttgtgtgcatatttgtatattcgagaattctctacccgcaggcctttgtctctcagcacttcttccccccctcgtctgtttaggtgctgtactttgaaaggaagaaagtgcacctagttctcagttttatctccacacggtgcggcaggtgtgtgggggtgggaggcagctgcagagaacacgtgttttgtttcttagcatcatattttggggacaacggttatgagggcagccgctccgaagcccaggagccgggccccacgccgcgtgggcctctggtgcaagcgggggccaggccgtgggcagatggacgacgcagcgtcccactggtgctcttcctggggtaggaagcgtcatggacccgggctcatcttcagtgtcctgaaccaagaggcagctagagccaggtgtcggccctcaaaggggccaaaaaaggggccttcacagtcaccccaggtagatgcccacgcgacccctggactaatgtgaccagagtcggctgtgtttggaaataaacttccaacgctccagactagcgaagcgtcgttaaaaaaccgaaggtaccctgagtggtttttagaaactgaaattctgcagcgcgacccggcagagaagctcggggctttctgagcggctctgcttcgcggcacacggagccgctcgaggaggaggcgctcctgctacacccggtttgctctctgcacaaagtctggctttgaggtctgcctcctcccaaagatcccctgagctaccacgggccgcagattctcccccggaaaaatgaaacacacatggctacatcatggtttaagaaatcttcaaacctggaggcactttgatgtcttcccttagggatttagactcagagcttgagcttattctggggaatccgcagagccacacgagtgtgaagtgctgagcaaggattgggagtccaatttacagcctgtggaggagtgtgtgcgggggtgggggcacaggccatgttaacttgacagacacagtttcattggtgaatggaaaatctgtaattccaataagcaatgtcttctaaccaaccaagaggcacggaagacacagccacaaccttccgtggccagagaacccatgcctctcctcacacagaccaaggagagcctgcggaaagggtaaaagtaacagcaatttaccgaaggccaagtggatcttcaccaaaagttaagaggctgacatttggtcggtgtggctagctagtaaggaaatgacaggtggcctaaatagaatttaaagcactttataatcacctgagggatgccgattttcagcacagtatttaagaagagcaaaattgtgagtcagataaaaggagatgtagaactacagtaattacaaacaacctctcatggtcctgtgggtatttcctgatttgtggagtctgcctgatcggtttaaaatcttagattggcatctcgggctaagcagcatgctctagggggcagccaaggtgtgatcagggaatagaaaccagcttgagcgctggctgaagtttcagaaaagactgaaagcctaactgtaagaaattcccactgtgagtccaggatctaacatagaggatttgtagcttatccattgcttcagagtcacatttctacagctgctcattcacccagccatgtgctcagctcacatgcttagaaaatcctactctcctgtacaaatcagaatgagtttaatgtgtctttagcacttcaattactacctacctcaaaggcaaacagtggtgtgataaattaactgaaactgattggagaactggaaacactaaggaataaaaaaggcaattctgaatagcactggagtgcattgtgtctaattatgttttccttaggctattattaaaatacaatggaattctctagaagctcaaaaaaagcttccggttccactggccaactaggttggggtttaaattcttcacagataagataaaaggcatgtccatatgaatattagagttgactgtattaacattttcttaccaagcagcacaaacatagactttctttccacattttaaacacacagccccacatgttggcacctcacgaggatgtgtgcacgttctgttagggaccttatggtccttgtggacttagggacaacgatctcgtggtcagacctaattgcctctgagctccttttacattcaggccaacaataggtggagaaatatcatgacttgcttgggtgacctgtgggcaggggcaggagggaatccccaaatcctgccccatcttttcaaactcagaaactgaaaagtaatcctgttctgtgaattgggttaagtttgtcaatgggaaggaccaaccccaacacacaaatactttctaaggaagctgagaatggggtgaggtgaaaatcccacagtcacttaccggagagagcagacccagaagtgttctccaaggcagcctcattacatcatgaatcagtgatgaaccaaagctataatgatagttttaattctacctggggactgcaggatgacccaaaagaagtaactgagcagccggtggcatgactccctggtttacagtgcccggaatcagctttcttcctgttcttggtaccaatgtggcctgggtcaggagctggcctaggcccatcaaaagtcccgctaaaagccccgcaaccctccctatctgcacacgctcacaccctcctcaatgtgttcatctgggtatatgggaaacagggatttcaccaacagctgaatctggaggaacaaagtggattctctaacttcatctacctgacattttgtggttgaccatatatttgtttcccgattatcttttaaaaaataagaaaatttcagattcaaaagcagcgagaaaaaatacagtgaatccccgtagatccaagatgcagcctggccaaccaccagctccctggacttgtcccacttatgtctacagaaggagcttgtggatggttttgtacataaccagcatactgttagtgttgtggactgaattatgtccttcccaaattcaaatgttaaggccctacccccaagtgtaactgtatttggagacagggccttgatatggttcagctttgtgtccccacccaaatctcaggctctgtgtccctacccaaatctcatcttggagccctcataattcccatgtgttgtaggagggacctggtgggagatgactgaattatgggggtgggtctttcctgtgctgttctcatgatggtcaatgagtctcatgagatctgagagttttaaaaaggggagtttccctgcacaagctctctctttgttgccatccacgtaagatggggcttgcttctacttgccttctgccacgattgtgaggcttcctcagccatgtggaactgtaaattcactaaacttctttcttttgaaaaattgcccagtctcaggtatgtctttatcagcagtgtgaaaacagactaatacaggcctttaagagaataactgaagttaagtgaggataaaagtgtggggccctaatccaagaggactagtgtccttataagaagacagagagacaccagagctccatcttgctgtctttgcacacacagaagaaaggccacgtggggacacagcaagaacacagctgtctgcaagtcaaggcgagagctctcaccaggaaccaaccctgtcagtaccttgaacttggacttccagcctccagactgtgagaaaataaatgactgttgtttaaaccacacagtctgtagtattttgttatgatagccctatcagaccaggataattaccatatataaaaaagcagactttaattcattaatatcccaaaaagataacttttaaagggagctgaccagttctgatgaaatttgctagaccccaagagtaatttcagacacaccaggagaccaaatctatgcatccaattgctgtgctatttagtagccgatactacttttcaaatgggtttctgttttttgcatgaataatatctatagctcataaatctatagacataactgacagccttccctctccgtaaatgcactttaattgaaagagggattttaattgcctccagtttcttttcttgctcttgctgtgtgtctctctgacacaggaagtaactggaccggtgtcttggaataaggataccttcatcatttccaaggtggaggttatatagggaacaacagagaactggggctatcacttaaacctttatcactgagcagagaaaacaacaacaaaaaacccaaacagaatggacagttattttccatgaaaagaattctgaggcatgggaatttcttgttcctagatatctgtctctaaggggtcaggtgggagaagccaccgatagagggaaccactgtggcacacacctgtgggcgtccgcgctgtgaactcggggtcaaagtggaaggtgtcctcaggcctgcccactgctggtttgaacggtggcttgatctccttccggtacagcgtctattaatacaaggaaagcaagacagggcactgaggatgcacagacattgccacagaacactggggacagagaaacctgctgtggggagggaaggatgttcttatcacagactgcattggccttgtggattacaagggatttctaaatactctgaaatatagatggcataaaatatattatgtgtagtatgatagatactatggcatatataataacgatgtattatagaaaggtatagaaaaggcatagtttgaggtatgagggtttggggacatgccaagtgttcttcattttagggcaatagttttctagcttcttcttggtagtagaatcttcttttccaagtaaaatcatacaggacagccaccacttgcccccactggggacagcagtgaagaggccgtgtggctctctcctccctgccctgggactttggggccagcaccacggaacttcagctctgcggggcactgcaaaaaccgccgacccagagccaccccagggtgctctcttgccagtgtctcagggcctgtgctctggggccttggcacctctgccagaaacctgccttgggtgtcagaatgagggcgcccaggctcctcgacaggaggacgcctgcatctgcagagaaccggcccttcccatgccccctctgggcccaaacttatttccccaacaggaccttggacagaaggcacagaaagtccacagccctctgtgctccggtctcagagctgcctgcctgacaatgctttccaaagctgagatgtgttgttttcaatcctctagggcaacaaggcattctgttgggaattcaatgtaaagaaagcacacacaggtacctggaacctggcgtagtcctcaggcgggtgatgctgcaggtggtgcttagatggagggagccgggggagcccagtgctgagagaagtgtggagggggaggggcactggagggaggactggggcctgaggcctgactggaaggccgagggacctccgggcagattcagtagaggatgctgggtttagtcaaatcaccctgacgacagaaggcacgggccatgccagtgtgctgaggggccagcctggtagttagcagggcagcagcagggcagggccaggctggggtcttgccccccactgagcatggggtttccttaatcctgcctagggagggtccccacggtgttcgcagaaaacatccagcctggagtcctgtcctgggcacttgtgtgtgaccatctagagctcagttctggactcagggaccctcatggccgtgcagctctggaaaatggacacagtgactccagctaaaacctgttctacatctctggaaagcaaatttcaacacctcctccgatgaggcccgacgggaagggagaggagggaggagggcgtctgacatctgggtcccacctggggcacaccctgctctgcttatccgggagcacctgggtcagagcccaggccagaaaccagggcccacagctactgcaggagggcgaggtgccaacagacgcccccgagctcccccgggggcttatcaggcagcaggatgtgccctgatgtgcaagagctcagggcgtgcacgcgggaaccatcggaggagaaacaggattgaattcagccctgaattatttgctcatttcctgccttgggggcatagatttcattagcaccgagttactcttcaagccattttcagaaatgaaaagacgctgctttctgcagtgaggcacaggacaggtgggaataatctccccagacacatgtgcttgcctgaggaagtctcctgagctgggaagcccaggccatcgggtgccacgaacaggccagtgcagcccattccccacccagagagtcctgagagccgggctattaagaatcctgctgaagtcaaaatcacatcctccctctgtgtgagagcaagcgagggagagaggtggagagagagagagagagagatggggagagatggggagagagggggtggggggagaaagagacggaggggaggaggggagaaatgggggagggggaggggaagggggtaagaaagagagagagcacgcactagctcgatccagcacagagccaggcctcctacttttattatgaggaggaatttatttacacaagagatttccattaaaaacaaaataaaatacaaaactggttgtcacgtattcattccagtgtgaagtgtttacctccggaaagcaggggcccacatggcccctctagctcctctcctccgtgccagctcttcctccatcatcctggggacccatcttgcccacccctgcccctgccccaccacagcctctgataaaaccatccccagagcctggtgcccagtgcttcttcatagaggggttttgcccccactgggacatttggcagtgcccaaagacactgctggctgccacacctgtgtgaccgctgcaggctcccaaggggtggaggccagggtgtgcagaacccagccacccataacagccccaccacacagcatcgcgcaggtgccacccagggtgaaggtgggagaccctggccctgcctgcttccttctctacctcacccttcctgccttgtttctgctccaaccctcaaaagtgcaacgtcaaccagcttcttcaagaaggaggactggatgttgaggcgactggccactgtccttggaaccccttcccctccccatggaacccccggtggggcagggctgcaggctctgcctggcttcctacaggccacatccttctccctcctcgtccaccgatggggcaggcaccacagcctcgcttcacagctgtccaggaaagcacaggctctatctgtgaccaccctgcctctggaggctcacatccagaggctgtcaccttcctgccttctaagtcagattcacagcccagcactggtactgctgtgacctcctctgggctgaggccatcccactcctttaatactaagtatctgctgctaagtcaggtcccggttccctccagcccaggacactgcgcctgggggctgggctcagacttcccctgtgctctgccccatctgtgcctagcccggtgctgcgagtcacctgggatgcccagtgaggaggtcctaagcccaggtagtcccgtagcacttttgtaccacacaaatagctccccctcacacggcagcaggaggaagcccgcctctgctttccccgtgctttccacccctcggctgtgagcccaggctttcagctcacagaccccaacaagaccagagggaggcatgcgtgtgagagtggacggagcgcttgctgagggccagggccttccttctgtgccgcgggagccttcaggcaactggccaccccgtaacatgggtccgtgtgccaaccgcagctatgaacacagcctgttcactggggcctgcagaccaccatgccccacctgctggaggctgctgcgttctcactctggtctgggccaggcagtgaggttctgtgcgggccgccggtggccaactggagccggtcactctggccctttggacggcttcctcgaggcttgctgcaatcttaaaggccggtcaatgtcttcctgatgctgcgtaaacatttggaaggtgctaatatgtgttattactgtgtatgctttttctttccatgtgcaaacctaagaacgggtttgaggctttgggggagaagtcatccggcctcttgctttgtatgtaaaccactgtaggcagggttgtgttgagagtgaaacagcagcagcatctcacctgggattctgagcttaacgagacagacactggcaattctgccctggatcccccctttctgagactctgggacaattcatgccgaaaccgacgagagaaaatgcagtctcatgatcaaattcgccaggcacatttaaaatcatctcatttgtcccaggatgtcagaatgacacagtgtggccgcagggctgaaacgaatttcacgggaaacaagcgcacgtgaggaagcccggagcaggcccatcaggattctatttatactaaagaccttcagctaagtgagaagaggaccgagacagcaacagaaaaacgggaactgggtgatgacataggaaacagatgctagtttggggtctcagaccctaacatctgccttctgtagacggttttggcttcaggcattttggaattaatacgctccaataaggcaaagggcacatttatagattattcctaaaataataatgcaaaaatatgcagaccagagagaagacaggatcgaaagcgccgcaggaagaatctaaacgattttcaaagcgtcacgatgggtgtgacaggtcagtggctcatggagcgggactgtgcctgcagtttacccggctgtaggtgggtccaacagaagaagcacctgaagggtgatgattcattgcacagagtccttgctgggttccctgaagggggagtgctcctagtgtatataatgtaggaataaaaggatagaaatctcgctgctggcaatgggagcaacagctgcatggagacgcctgtgctgtgaggccctgacccgcagcctacagctcccacacccccaaaccactctctgcgccatactgcaaatactccacttgtgggcaagaagaccaaagtggcctgaagacccggaacccaccctctgctcctgccaggacacacaacagccaagttcagggcacaccccacgcgctgccagatcaccgagcgacctcaagcttctcattgtcctgtgcctcagtctcctctacaagtttctcccatctcacagcatcacagctaatggtgtgcttggaagggtttcaaactgtacaaagaacataaacatgagctactagtattgatcatgaataacgaataacagtaataataagagtcagtgcaatactaagggtctaggccctggacagagttccagaaacaaagatgtccctccctggtgactgtgtgtctccagcatcatcattcactgcctgtaataatatttgcagttccctgggtccccctgcaagggacgccaggctgggctgggagccgtcctcagactggcttgtgctgtctgcagtgattaacttttacgaagctttttttgggttcgtgctaattctgtgttctcagcatgcttcagccacgggggaaaaaccaacacagcttctatctgctggactctgccgtatcctctgcagaggtttgtagtccgatcattaactcgtggcttctcactcagctcatcaagcagagctggccttcagaaggaatggctcccgtgcagacgttcactcgctcatctctgaagctaaattaaaaggcagcagcccacacctccaccgtccccacacttactgtcagcagatgggtcctgctccagcaggccactgaagaccccggggacagcagtgggatgacaggtgtttacttaaaaaaataaataaataaataaataaataaaaagatctgctggcagtatcggatcacagagagcagcagaaagcaaaataaatatcctaatattttcccagttggatcctgaggcaagccattgggtgaagtacccaggcagaaatctagtggttaggaaatgtcttctcattcgtcattaaggagtgtctgcattgcagagggaacggcttttggtgttaacagttcttgcaaatgaggctgaactgtggttttcagttttctgagctgccgaaaagcagaatgggcacatctggacaaatacatcacggagtaaaattaccccttaaataaatacctttaaacatcttgcattttagcccctgctttctgaagaatgggttgatggcttgcctggatgtgttattggggtttgaggttagccatgaagacacatgggctgctactggggccgcagacacaggagaacacacgggcaaacttgactcatgagagaggatcagctgagatggggggaccactggactcatcctagcaagatgttgacagcttctaagaccatcacggagcgggactgtgcctgcagtttacgcggtgtcctgaacacggtgttttcatgcctacacatctttgctggaagcatccttcttctcctccttctgcccctctgctggttaattccactcgccctctttcaggcatcatttctctctctttctgctggccactttcactgtgcacaaacctcttccatcggtggatgatggcgttatgggacagcagactcctcagtctgtgagcagctggaggacggggctctgcgttccagctgtgacgtcatggacatggacactttgctggtgcaccaccagggtgagcaccaagcgttatttatcaaatgcatgaattaatgcaaaagtggcatttctgagctcttctgccactcacgggctgtgtgggttcagggcgctgggcagaacaagagcctgccattcctctagcactgctgcctgccttcctctgggaagtacagacatgaaggaaacacgcctggttctgatcaatcacaaggacctctctcaaaacgaaaacaaggccaaaataaaatcaaattaagtgctaagagcaacaaaaggaacttctcagctctgattctagtctgattcctttgaaatcacgcagaaatgccaccttcttgggttgtgtttgctttccagccacagggagaccagagcaccctgagcagaggcgctgtgtagagaaggctcttattgccacaggaaaaaggcggcttctgctcagagctcgccggacctcagcattctggaatgcacattaatctaatgtgtcatagttttccaaatccatcgtattgttaaaattccaggcatctcacaaggttgtcttagcaagtgcgtaagcccttctgggccatgcatactttggagtggctccactcttggctgagtgctctgtgttgcactgtgtcacctgggggttcggtgtgaagagacttctctttcctaccagctgcagccctcagggtctcccatcccaggatgctgccctgcccacctgcagctccccctcccagcccagcaatcctggttctccattctcccaggcatggtctctggaggaaggactagagtgtgagagtgaggaaatggagggggcaagtctccctcgacagctgtgactcctgtcttgagagtctcactcattcattcactgattcattcactgacttactgactcattcactcacttattcactgattcactgactcattcacttattcatttgctcgttcactcactccctcattcactcactccctcactcactcattcactaactcactcactgactcccttactcattcactcactcactcattcactcactccctcattcactcattccttcactcactccctcacttgttgactcactcattaactcactcccttactcattcatgcactccctcactcattaactcactcactcctttactcattcattcactcattcattcacttcctcactcattcactcactcattgactcactgactcattcactcactccctcactcattcactctctaactcactccctcattcactcactccctcactcattaactcattcattcactcactcattaactcactcactcactcccttactcattcactcactcactcattcattcactccctcactcattcactccctccttccctcactcatccattcactcactcagtagggattcataaagtgcctcctttgagccaggccctgttttagagctgtgggatacacctctaagccacagattcctgatcttgcagcttacattctagtggcaggagacagaaaataataatatacatcagaaacacatggtattttgaggcgagtcagaaagtgataagggatatgaaaacagagcaaggccgggggctggggtgctgggagaggagctgcagtttggaagagccgcaggacaggtctcataagatgacactgaatggcagactggaaggaggagaccagtgagcccttgggagacttgggcaggaggggccctggaagccagaccagctggagccagtgcttggggggaacctgttccatggaggcatgggaaggaggctccgtgaggatgggaggggtgaggtgtggctgtcctgaccactttcgtgtgcttctccatctgtcccctgctgcatcctccttgtcagcacagtgtcctcctgtgacatgtgcagacccatctgtccaccgcctttctctgccaagtcatcacaagacccacgggtgcaggactttgttccatctacggctctatccccagccctggaaagtgcctgagactgggacgcccagcagaaagggctggataaatggagaagcagatcatacggggagaagctgtgtggtcccaccttaaccactggcaggcaggggaggggatgcaacatgctgtgaccccctgaggggcaggcatctgggttccaggcacagtgctgtgctaaccatccacaggctgacacccaggtccattcttcatgaaacaggcttgcctgagatctaaacgccgtgtaaggtgaagtctccatagaaaatacattccaacgcagagtcgaatgacagtgaccttaggtgcccatctgtgaggtgagcacagcctgagcttctgataagcctaaattttcagggaagctaagtaagagactccaaagggaggccttggttttcatttcttggaggtcctggttgggaggcacagatgtcctgaaactttacactcttttctctaatcttactttcgaaaagaagtctaatcttacgaaagttctttagtcagaactgtaaaactaggttttaaaaagttatcactcttccccagtttgagtgctttgctggggctcaggctgaaggaagaggagagctggctggttttatccagcactggtgttacacattcccagaggagaggtctggggctgcaggtggggcccacctcttaatgaaatgcgtggaggccccggactccatgaggacataaagaagacagaggccgggcgcggtggctcacgcctgtaatcccagcactttgggaggccaaggtgggtggatcatgaggtcaggagatcgagatcatcctggctaacacggtgaaaccctgtctctactaaaaatataaaaaaaattagccgggcgtggtgggggcgcctgtaatcccagctattcgggaggctgaggcaggagaatggcgtgaatctggcaggtggagcttgcagtgagccgagatcgcgccactgcactccagcctgggcgacagagcgagactaaaaaaaaaaaaaaaaagaagacagagaggaaagcgaaagcagataataaactctatactgtagagggcatttaaatcttaaaaagtgttccattaaaatcttttgaggttaatttgttaggtcaggaaaagaaaatcccaacatagctgtttttgtgttaacctaaaggaaagagctgaaagcaactgataggaaaggaggtatcgccttcctcagatggaaggaacagcctccgagttttagccgcgagaactccctgtgtgggggacgcgtcagacgctgactgcttcaccattcggagttggcgtcttggcagaaataggcaattgacacttgtagcttggtgaaaagtgagatacgagaacttctcagacaatgtccagcctggcccagagaactggaaatggaggctttaccaataactccactaacagaagctccagtttattccaacaactcggcactgttgttttttttttttttttttaaatgtgacttccacgtgggcatcagcttgactaacgatggaaaatgcagtatcgaatctgggcctgcccatagccctagcactaaagggtcctggttgagcagcttgtcatgacttttgtctgttcagcccttgaggttagaagacagtcactcctggagcaatcgggaatatgcagggctcggagaggccggggagtgggtgcagggaggacagaagcctcgactctgatgggcagaggagagtagaaggaggaaagctgaggggacttcaggcctcaagctggagggaggggcactcacgtgtctgtgcctcccaagttgccagcccgctcagcagggtcctgggggctccctgcctgcaggtggcttgtctacattcacctccgacctacttgtgacccggacactgaggaccctctgcaccaagccgtatgttccctccacccacttctgtgtcacgcgtgtgcaggtggggactgtggcatgcaacttacgttccagtctatggtcacaaagaagggatggcgcttaatttcctccactccgtcaatgccagcacctgtcaacaacacagaaatgatcatcagaacaaatccaagatggggttctctgacagtttccaatgcagcagtgtggagggtggggatgtgcagaggtggggccgtgggaaggagcccagaggctgctcactcctgcccaaggcacctgcgcacctgccgatgcccccagctcagaaagccacgactcagccccgagggcttgtgaggcagaggtggcctggggttggagtgagcaaaagaggtggtcaagagaagcatgggacaggccagccaggtgctgcctgctgcatgtgacggctgcctagcaccccactgtcacccccaggagcttgaggtgcctgtgagtgtgagcaccaggtggacctcccaggaggccggaggggaaggtgcagagcagagttcctggcaaagctgctgcagttaacccgggagggaaggattccaggaaatgaagaggagttgacaggactgagtcccggaggaagccagagcccagcctcctgcccacacctggccacccctgagcctgctcagacaggtgactgtgtttacctggaggctgcttacaaatatctctgctttgttctgttatttctacctaacctcctcccttactttgttgcgtacaatcctaaggccctggggcagaaaggaaggagggaggagtaggcggagcgctgggggccctttcaggcagcatgattccctaacggtggatacatgtccactcatctgccagaaatcgccactgtccccccagaacgagcccagtgtggacaaggcctttagtcagtagctcagctcaccgactgcagaagcgtgcccattcacggaggcactactgttcgggaaagcggtggggcagggagtgaggggccgtggaatcttgctgcagtttctgttcagtttttctgtaaacttaaaactgttctgaacacaaagtctattaattaaaaacaaaaggccctaaagctctaggactctgtgttttctccaggatgggacggccacagaggagcccatcctcccgggtcacgaatccgagaagaggcgggcttggctggaaggggcagtggcggcggtggctggggaattcctgccagctccgggcccagggctggggagggtctgatccctggggcccggctcccctgttctgcaagctgtgttcctttccgctgccaactcctaacggctgtgctccaaatcagagcctcctgtgccatgtatgccccttcgtggagcccccctcatgtccagctctcactcctggaagagcggggctgcccggggatgctgtggtcagcacaggtgtggcccggcctgtccggctggaagctggcctggagtggcgcaggtcaccgggagtcacagcagatggtgccatcgttggctggaactgcccgtgtcctgacccctcccacccctccattccgcactctgggcagtgatgtggaggaggctcgggggctgtggtggcctcagaaagcgcctctaggtggtcaacggctcagagacagtccccttaccctggaagcttggccagggccatggtgctaggaacgaacccacatactaaatgcccctgaaggcactctcacagcactctcagctttgtgttattcacactttgacgtgaaagtccatctagaaggaattagaggaagggcacacattcaggagtttctccttccatgaggacgcagaatcataggacagacatagcacacggacatctcagtcatccgatgcacaattgctgttcccattttacagacgaggacactgaggctgacacaggttgggtagcttgttcaaaatcagaccagaggttatgagttacaggtactgggtttggaggcacatgtctgaaaagcagctgaggtgccccaccttctgaagtgtctttcccgaggactccctgctgaggcccctccgggtccccagtctagctcccttgttctcctctaaaccctgagcccagggatctgatcccaggcctttgcaatcgcagcagctggcatgagccttcgcaggcgcaccagtggctgctgtaatgaaatttccagagcgacagtctgacttccaaacagccctccccaagcgcccatcctgtgtgcaggcctcctttgatgatgaccagaactctgggttgaagagtccttctggtcacgatgattaacagaaagaccctcctctgaagtgtgcctctcctctactcttttgtttggtgactgttggacgcatggccagaggcactctcaaaaggctggagattggaacaaacagttcagaggccctggtacacgcacaggtgtggcaacttgttggctgtacttctttggaggatctatttcacattttgtacccactgtatttccttcttgttcatcatttgcaaatatggtctgcaggaattttagaaagtgagaggcagaggaaatacaggtattggtataactactatgtaactggtatatgctgggtttacctggatcactgcaatcaacacatttctatctttacctcctttcccctaaggtagtaagattttgcaccatgtttgtattttaagccctcagcaaaaagagtcaacaggggaataacactttggttatcactaaaaaattacaggggttccaattacagggggaaacatgaaacaggaggaggacttttgcactcagcaccttgaaacctgtgtcaaccctcccagggcagtcaggtttattattcttgttaaaataggtgactttgcactcggctccccctttttatctccactgaacccactggacaaatgacggtgagtggagttctgggcggggagaatcggaaggtatcaggctgatgctggaatcacggctggctcgctacgggatgcggatgacacgcactgaaggccttccttggttctagaggactgctgccactcatctagatcatgaagcactgacaagaacagggacagaaactgtgagcacagaaggccggaattccctcctgtcaggcttagcaatttgtcgttaagttccttaatgcagggcaaataggagttcaaggttcaggggaacagaagattcaagaatcacacttcttctcggtagtaataacacctgatcctgtttgtttaaatggcttgtggtctatctccaaattggggcgtcacctaatgtgtttatctgggtctgtgtctccaattgctgttctctggttaagggtataattttgcaaccagttggaactctcatatcaatgactaaagtgcagtgcagtgcctgtgaatggatttttttttttattttggggggattcattctgtcgcccaggctggtatgcagtggcatgatcgtgactcactgcagcctcgatttcctgggctcaggtgatcctcccagctcagtctcctgagtagctgggactacaggcatgtgccactacacctggctaatattttgtattttttgtagagatggggtctcaccatgttgcccaggctggtgtcaaactcttgggctcaagtgatctgcctgcctgggtctcccaaagtgctgggattataggcaggagccactgcacggatgatttattctttcattgcaccgattctgtccagctcttctactccatatttttcacgaggtaagccattcatttcattgtggggattctaaattctcagcaggtgattcccaaagggttttggtatctgccaaaaatgtgtgcattgtgtctgtatatccacagatagctttaggagatggttaattcatggtttgggactcctttgcaatattttcatttttgttgtttgagagtcacacaaacccatctccgacacttctgggaacattcagtagaatcttactggctgcctccttaggtttcttacatactgcaagcttctcctaaccagcccaccatgtccagcctataaccatccagggcaacttccatcattgacttaaatactaggtctgctttttcaatttcttcatcacttaaaggttatctacacattatttgtttaaaggtttttttttttttttttttggccaatttgaaatttcatctatttcatgtttacaccctttgtcagggagtcgctcgtgtcccacaggactcagccggttaggagtcagggatgggctaggggctcaggcttgagcggtgtgggagtcagatctgcagacaggccctgggcatgggtctctagcggctccctagggctggttgtgagggtggggctgcctggtcttcagcaaccatcaaagcctggcttatgacaggcagtcccagcaatgccagtagaaactgggatgaggatcagaatggaccacgtttgaagtcattaaaaacacatcatctggagatcagttctggacaggaaaacagtaacaagagcaacggaaaacctctgcccgtgcgtcagccacaggcagcaggtgtgctgtgaagacagcacgcctggcttaggtgatgggcgttgatttgctgtgctatttttgtgctcatcagcacatcgaattcctttctaacctttccctcactttaaacttccccctgggagtctcagaatatctcatgagtttctaggagaagctacagatgctcattaggaatgagctagaaagctgtcagctttggaaaaaaggaagatttggaggtaggcttaggaagttttatactcactgcaaactcctgtcctgggggggaagtcgggagataacaaataacaaacactggtgctgaaaaccccagcagttcctgatctcagtgcaggatacatttacagctgtttctagacatcactatggtataaacttccatcagaaatggaactcacttaagtaatgagaagcagccaacaccacacccagggtctagccctacaaagcctgttcagcagaagcatcacccacaaccgcgagcctctcccatctcagccgggagcagcgccaagcacagagggaccaaatgtcctgctgagcctgttcctgcagagcttcatcccggagcctacccgtgatgctgccttggtccgtgcttacagggtgcagtgccgagggcgctggccaggagcccctttctcacctttcttttattctattctttgaagtccctggatttgcaaatcactcagagtcaccgagtcctccacctgggaggcgttttcctcgcacagacaagaaagcagacagcctgagcaggggtgtgaccctccaaggcctctatcgtgggatgtgccccagcctgtggtgcttctgcttagactgggtcaccccatgctgctacagccaccccagggtctttctctaattcacaaccacacaaccaccagaacaacagtgcgaagaaacaagactggtgtcccctcggctgcacccttgagagcccccacgctcaccacacccactgcgtactcccgagcgtggcccggcccctggctgctctgtctcctctccactcacccgtcacccaggcatggggacattgcagagtcacacgtgcccccaggtgtgccattcttccttccttcctcccactactctgcacgtgacgtttcttgggcccagaaggcccctccccccacaccccgtccagcatctgggacatcttctgagacccaacccaggcgtcctcacagagcagctctgtcgcccccactcaaatagatcagtggccccaaaccagtggcctctggaggtcagtggcagtgccatccaccttcctaagccagcacctgctacgggcattcagtacacattcactgaacagatcacacacgaaggcagggggattcagtctagaactcttttgaacgaagacattttatcttcaggggatgtggaggtgggagaaatgccagtcttagactcagaagcctaggagcctggagcaactcacacgggggcagagggccgttttctcacctgcagagtgtaagagaggaatgagatgcgtctgtatttctggtagtctggacatgtataaacacattatgccatctcttccagctgtcaatatctgtgcagaaactctgggaggggtcaactcccccaaatttgtatgctgaagccctaatccccaatatccccaatgtctcacaatgtgaccacatgtgcaaaaggggtcactgcaggtataatgagtccggcatcagcagggcaggcactcatctcctatgactgctgtccctagaacaaggggaaatttggacacagacccacacggaggagaaggccacatggagatggaggcggaggtcagggtgtggcattcacagccaggggtgtcaaggctggccagcaaagccccggggtctaggagcggccagggacacattcctttcagtgggagcacagccctgcagccttgagcttggacctctggcctccagagctgcgggaggacacatttctgctgttcaagctgcccagtttgcagttctttgtcaaggctgccccaagaaactcacacagaggggcggccaacgaacagctcagtgttcactgtggtccgctgggcattagagacgtgtgtttttatccgtgtttctcgctacactgtgcgcacacagagggcacatttttcctttgatttcctaatttctagcttattgttttgtccactgatccctctgtcaactggactgaacggaactgtctggaaatccagaggcttcccgctggtgggggctcattaaggaagaggcaggggtgaggaggtcgagaggcagagagggtcccctctctccctgggggaggccatagagagggagagtctacagctcgaggggactcacactaggggagacaccaagagaggacaggtgggaggcaatgaagacgcatttgctcctcctcccagcccctcaattgggccctgaggtcctgtgtggcgagtccagggcgggagagctctggcattgagagctcttatcagacaggctcaacacaggggcagctggaggtgtgcgattgccttgcatatccatgcgagggcccagggttagaacgaggcctctaacagccaccaattccccagatggtcaaagggagaactcaattccaggctcttttggaggaacgagaataaggctcacggcagtcagaagcagaggtaagttccagccacaaaaccggccgcctgtgcaggtgaaggtgactctgcccagcggggttttcagactacctggctccagctccgcaggcaactaaatccagcgccctccctggataaaggctgggcaattaattctgactgtagcttcttcatgttgagcctgggcatcttaggttgtaaaatacacctgtgggagggtccacagctcctcgaaagcttgatgataactcacttagacacggtttgaagggcgatcttggcccgaggtgagccattctccatgcttgtgtgagcttccagggggctggtatcttttaaccaatactcatctctacacctagggaggaggtagctccatctttctctcatccataatttaaaccaaatactaaaacaatattttaaagaactatgattttagtaatgttaaatttgaagggttttaatttaaaaaataggttatttagaaaattatttgcttctcccagaacaaggggagaaaaagtacaaacaccccaatactttgtcacattcacccaatttactgtagcaaatcctctcccagcaatataataatgtttgaaagaaaatagtgactctggccaggcacagtggctcacgcctgtaatctcatgttgggaggccaatgcaggaggactgctttagtccaggagttcgagaccagcctgggcaacatagcggggccccttctctacaaaacagtaataaactagtcaggtgtggttgtgcatgcctgtagtcccagctactcaggaggctgacgtgggaggactgcctgagtccaggcaactgagactgaagtgagtcatgattgcaccactgtgatcagcctgggcaacagagcaagaccctgtttaaaaaaggaaaggagaggaaacagtgactccaagacaaagcgcttcgattgctgcaagaatagatctgaattgttggctctcatgtacgtttggatgaataaatacgtccagcatctccacttctcctttctgactccaattcgcatttccagggggaggccaagcaggggaggggtgcacagcaaaccctcacgcatgtggccccacaggtggtgactgcggcagctcggctgggcgggggcggttaccatgcgtcacctcagagggagtggcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctggcagcaactgtgtgaagatgttaccctctgagggatcagaccccgggcaaggcgggcatgactctgtgctcttgccagggtggatttcccgggtgagcttcgggactctggcattggcctcaatgttcttctggctggtactgcaggctttccatttacccttccattctgcaaccagctcagtggagggtttaacaacatctattaaaatgcatctcacaaaacgatggttttctccagaaaacgctcagaattgtggctcctcggctattgtgcaccagataacgttcctctgttctgtcccacagccaagtggcagagaaagaaaagtgtcagatgagcaggaagcaatgaggccggggggttggacacccttcccggccacaggcctctgcacaccggtgctctctgcttgtttatgtgtttactcgtcagacccattacagtgcttcccacccatcaggcactgctctgcctcctcaaatcctcctacttcacgatgtcggtgctggtattaccctcagttcgtagaataaataagcaagcacagagaggtgaagccatccgctcaggcccacacggccaggaaggggtgcgtggcgtgggtctgagcacctggctctcgcttcactttgcttctgtgccctgccctggactccagcctctcccacacgctcccctctcctctttcgctgctgctctttcttccccttccatcaggccctctcccctcttctgagatccattttgtgcctcatctgcttctctgccctggctgcaggcatttgtgcgcgtctgggctgcagctggccttgctgtttgctgtcagagagcccacgagcatgagggccacactttggcttcacgggtccccagagcctagcccacgagtgagggaaggcacgggccagactgcccattatccactcacacttgctctggacgaaagcacccagtgtctgcccaagagccatgagaaaggggcagcaggcgatgctggggacaggcggtggccccagccacggcgaggtggcagtgtggtcctgcaatctgccaggggggcggccccggccacagtgagatggcagcgtgactcgccagctgcccgaagagcatggtgagtggcagcatggtcctgctaactgccaggtgaggtgaggtggcagccatggtgaggtggcagcatggtcctgctaaccgccagggggtggcccaaggtggggcgtgtgctagcacgtcacagagaagtctctggcatcaaatgtttctccctaaaacaactttttaaaaactgggttttcaatcataaaaataatacatattggcagaaaaagtccatattggcatgaatgaggtgaaaggaaaagctccccttctgcccgtccctccggggagaagcacccgctgtaggagctgcttgcctgtgtttgcagaatttttctttgcttacctcccttgcttccaaaaacacaaacaggataattctgaacgttctgtgctgcaatgagctatttttacttaacacttctttttttaacttacacatccttccatgttagtgcatgcagaatggcctcactcttcagtactcacatagtatcccctgtgtagacgacggtaattcagttaaccgtccctgggtgatgtgggtttcagcttccatatctctctgtgcacttgtgtgaatatatttgaaggatatattatttgaggtggaattacttgggtgaggtgcatgtgctttacttttgcagagatttttcaggttgacttatgaaaagtgggaaaaacacaccccttcacccggaagttgggaaactgctctcccatcgccaacagtgaggattgccaaatgtgtgcctctgtgctaacttgagaggtaaaaatgggctagacctccatgaagacagtaaggacatgaaatatcacgaagaaatgtacaggtactggctgattcgaaagcacaaaaacattcacggaaagcaacaagtgccgaactttcaatagccccttcgtaagacagggagggctttaggaaaaatcttcaaccctcgctagatgttttggacctgacaagcaagaatcttatattccttaagattgtgattttatatatatatatatatatatatatatatatatataatatattttttttttttgagagagagttttgctctgttgcccaggctggagtgcagttgtgcgatctcagcttaccacaatctccacctcctgggttcaagcaactctcctgcctcagcctcctgagcagctgggattacaggcacccatcatcacacccagttgatttttatatttttagtagagatgaggttttgccattttggccaggctggtcttaaactcctgacctcaggtgatccgcctgcctgggcctcccaaagtgctgggattacaggcgtacaccaccactcctggccaatttttgtatttttggtagagatggggtttcgccatgttggccaggctggtcttgaactcctgaccttagctgatccacacgcctcggctgggattacaggtatgagccacaatgcctggccaattttatatacatatctttcttctagtgtttttctaaaccttgatgcttttcgcccaatttttctatagaataaaaattctatataaaattcaatgaaaacaaataagttgggatttttacaaaattctgaaattaagctacagtgaaattctgggaaattctctgcaggaaaagagaataattatacattcattccatattaaagtataaaagaattgagttgtgaattaaaagatagttcatttttcaagtttaaaaggccaagtcaagtactcttatcagaaatacaagcatagctatagggaattttcctgaaaagccttttcaatttttaattaagactgagcaaagctcaaagtggtctttgttgttgcaaagattagaaataaataagccatgaaggctcagctctaatttgtggctttaaaaaggatactgatgtctgacattgctctggaatcaagccaaggtcccctttgaaattgaattaatagatcttaaagtatttgctgcagagtggaggcctctgatgagatagtagagtgtacgtatacctctctgatcaatcttaaagtatgtgctgcagtgtggagagctctgctgaattctctgatgagatagtagactgtatgtatatctctctgatcgatcttaaagtatgtgctgcagagtggaggcctttgctgagttctctgatgagatggtagactgtacatatacctctctgatagatcttaaagtatgtgctgcagcgcggagagctctgctgagttctctgataagatggtagactgtacgtatacctctctgatcaatcttaaagtatgtgctacagagtggaggcctctgctgagttctctgataagatggcagactgcaggtatacctctctgatcgatcttaaagtatgtgctgcagtgtggagagctctgctgagctctctgataagatggtagactgtatgtatacctctctgatcaatcttaaagtatgtgctgcagagtggaggcctctgctgagttctctggtaagatggcagactgcacgtatacctctctgatcgatcttaaagtatgtgctgcagcttggagagctctgctgagctctctgataagatggtagactgtacatatacctctctgatcaatcttaaagtatgtgctgcagagtggaggcctctgctgagttctctgatgagatggtagactgcacatatacctctctgatcgatcttaaagtatgtgctgcagcgtggagggctctgttaagttctctgatgagacgggagaatgcacgtgcatctctttgttttggtgcaggcacacacaagtacactggaagtcttggttctttctcattttacttgggttgtcaccagtttctggcaggaaattctgcctcagctatcggggcccaagagccaaatgtgctccaaatctgggccctcggtgactgcagagatgccaccctttcctttcaaatgcaactgcccttgctgggggaggaatgtcccaggaaattctctgagtaacactgtgtctgggacaggtatctgtgctccgaggaaagaaatagttttctaaatagtttgtttttgtctcagaaaccagagccaggagcaatgacagggagccactcagttaacgcctagaggccttgcttattctggctgcgatcacagaaggcttcgggcgatgatgaggaaacgagtgtgaccctctcaggctggcttcacagggttagccgttggaggagagaaaacccacccaaattagtgaagtggaaaggtttcatgaacttctccagtttcaacaagtgaaatctgtgtgtttgggtgggactggagacaagggaagatgagggagaggaaggaggagagagggagagagacatcacatcctattgcatcttccctaaaacccagagtgcttcgcagccatgctacaggacgccctcaccataaagcaaatgtgggggatcattttaaattagttgcctcccaaaagggactgttctaaacaaaggtggccgtgcagccttgaccttcaacagggagtcccaacacttttccaattgcctcaaaagcagagattctggaaaaccagatgcaacaagatgccccaagactcacagcctgaagactgcggggagcctttgggccgatggggccgcttttataggacatgtttgtgccacaccaggtaagagaccacctgggacgtctatgtgtgtggggagaggacacgcgcagctgcatgctgtcggagctggaaggaactgcagggaccatcaaccccaccttcatttcccagagaaaaggagggacagggcccatggctgtgcagctggccacagcccagtagggtctagaactcagaatccggacaacccccatgccactgtgggccgcagaccagaagctcacagagctggggccgtggcctcctggatcctgctctcacacatcctgctgccacaccaacaccagagaatccaccgcttctagcaggaggacggcccgcaaacgctcaggggaaaggaaaaatcaggcctgatttcttacggagttggaaaaaattaagaaaagcccattttgcattttgaagaccaaaaatgtcgtgctaacgaagaatgagaagagcagggcctttttttcctctttttaagattaagggtaaatcgcatcctcactaaataagagaagctcatacatggtcttctcagaaacccacagagaaggaatgggtttgtgcttccacattcgggaagggaggacccaggcctctgcgacagctgcactgctctctggctggtcgggtgccaactagagccgactcctgcacacatagggtcccgggacaagcccttgtaccttggaacagagcctcactcaaacagaaaatgatgaacacaattttacagtcttgtcatgaagatcggaggagatgacaggtgcgcatgcttggcaggtgtgaagtgctaagagaatgcaggactgtgcaagtcactagcagaaaaacactttgtgaacaagaattctgggtaagcgcacagaaacagcatgacgtccatgtccacaggcagagcccgtgcatctgagcaggcactgcgggggccaaggcgtgacatgcccgcaaacctgtgctgtcttttctgctttaccacttgacagggaaaatggatagagatgaagcaggagcaccaagggtcaggctcgactcaactccacacacttcagggcaaggagcttttcagagcaccttaaagaacaactacaattccttcaattcactttagttcatgcatattcaccaggggctctgcgtggtccgagagctggacacaaagatgagccagacacaacctctgccttcgtggatctcatcacttagtgaatacctgtggccggcccagctgcctggccagtaaagccgccactccagccctcatttccttcctccaaccacagatgcttgttctcctgccttccttacggtgccatatgtcacgagtgccatgagacagggttccagtcaacaagaagtacagagaactcccaggggcttccagaaaagctttgtttttgtgaaaaaggggacagaggcagctggcctcatccagttcctttttctcctgcagtgaggatgtgattccaggaggtgttgtagccgcattgccatcacaaggcaccgaggataaggatgaaaaggcagtgcactgaggatgggaaacagaagccacaggaagatctgggctcctgacagcagtagttcagctgccagtgtctacaactcatccaccaccacgtggtgtgttaataagagaatgaaaccgtgatttggaaaactaaattaattgaacaaaaaaattaaaattatttaaaggttctattccttgcagctaaaagcaattcctatggatacatctgttttcataagtgaatttcgtaagtttcttgtttgacctgctttgaagtactgtcacgagaattcaagtcagataatgactaccttagtgcagtgccaaggcatcttctcatcctcatcaacagcaccgtgccgggggaaacctgaggctcgaagaacgacctgttctcctggttcattagaaatccgcccaggcaggggaacgtcggagctgtccacccaccctctgccaccacccatggggcctgccttccagggctgtgtgggggaggctgtgcttacacccagcagcatagagaatgaggggaggagagccacagacacaataaaggtgcaacctagggtcacggaaaagaacagctctggaccagacactgaaaaggctgatgaaatgagaccaggggctccagacatgggcaaacttcagagttgagagatgagtggaaatggcatgcaaagatgcttctgtgcattttgtggcagtttacagcattgcaaactcgattctaaggcaggcgtgtcctgaagtgggttgagatctgctgagctggggagcaagcccctgccagcgagcccctgatcccctccagctgggagggttacttcctcccagaaggattacatccacattgctcttagggctgacggacactgcaatggaagggactcaatttaattcacaatctggaagactcagatcagaaacatgacctttgacatagcatttggacaaaccagggcaccgcgatgcattggcttagctgagacacgcttctcaacttgcatctgtctccaaacacgccctcagagttaagaaacaccgcctcccccacctccccagacgcacggtgatgaacgggggggtctgtaaacaaaaggccagaccacacccagatttgggaaaactgcagtgaaacggcaacttcgggacacagggtgggacacaagcccttcctgccttgcccagcccaggctgtccctctgtccaaggctgcatctcccaccactgggaccccaccctcagggggtgaggtcttgcccatgacaggccctgtgtggatagggactctgggcactaagggtgagcgctgagcccttgctgcgtttcctgagccgagtcactgtgtaaccgtgggtgtgcaccaggaccagcgagtgaagggccaaggtgcagacagctttaggagctgcacatctcttggaaatgtggctgtgaccctggctaacgacgaccgtcaccactgatgaaaaggaggagtcctgatgactcttggttggaatctcaggtcccatctgggactttgctgagggggtcccagtaacaacaacgtggcaaaaattgtttggtcagtaggttcctctaagccatgaaccccacacacagctgtgagcacacacacacacatgtgcacgcacacgcatgaacacacacacacagtgcccctgtgtgtgctgcagcatgggccctctgtcctgatcaggcgtcctcccctctggtcctgagtgctctccatcctgggcctcccatctcattgtcgcccccagctggcatctcagtgacttggggctgctctgctggggccttcagctttgtccacagcactgttggtgaatacccctctaaggaagctgcctctgtctgggtgacagttccccagcctctcagacccttgactggggacagcgctataaaatgtgtgcagtgacctgctagttagttttcatccaatgcactggacacagtcctttccacagacaccagcatggggccctgccaggtggcattgggggctgggtccatcggtgtctccatgtgccctggcatggatgcactgtggtgtgggtggcacgggctccgctgcggggtgagtctacactctccagccatgtgggctgcaattcagtctagaccctggcccttccatgtcagtaacagcaacgtggagattctcaacagggggactttgccaatgtcaggagacgtttgatcatcacggggtgggggtggggatgcgctaaacagcctcaatgcatggcgcagctcccaaaacaagaattaaccggcccaaaatgcagacggtgcagagccgtggccgagacaccgtcctccagccccaggctgtggtgtggacgtttcataattgattcaatgatttccttattgattgatgcttacttcatcttcaggtctttgttaaacaggaagaccttcggcaaacaccgtttatttgtaccccttttacgcaggtatggctatttctgttggagagatttctggaagtaacacttctgggcaaaagggtgcatacatttaacattctgatggttttaccaaggtgctgaaatgttgcagggatttactctcctgacacacacccacgtgccctgggctttctggattggcctgcagtgactggcagacagtgacggcagaacaccctgtgacatcacccatgccacggggagctcaccgtgtcacctgctctgacgtcaccagtgccacgggagctcactgtgtcacctgctctcctggtagccacgctcggcatgcagaggtgctcggtgacaaggaggaattgctttactgtgttgtgtggaagaatgaaaacaggctgagtggacaaaggcgctgacagtgggttatcaccgagaggtctgtagagtggaataaaatatctgcttacacagaggagaactgcctcggaaatacaactatgggacatctttatatgaagtaaagaattactatgaagatgaatctgcaggaaggaagagtggtttacgtgataaaaatctggattagaagttggatgtaaatgtgtttaattaggtgaatacaactatgacaattcattacaagatgaatctcatggggattagtactcagtactttaaatacatcaatgttgatttttaaaaatcaccttaactccttttttctaagatcacagttatacttcaattatctcacattgtgaaatatgactgtggagtaggaaggtacttttgattagcttcactttcaatcactgaaggattgcaaatgaatgcaaaagttccctgcaatggaagctgatgtggggaagaagttaaatgggtccttctttctttggggttaaggcatgcagagaggaaaatctagtattttttccgaaatgaagtatttcctgatttaacttttgccttcccctctggtatgtcttctatctatgaggttagagtttaaaaaaaaacagaatttaatgtgttcctttcgttttcttgttaaaataacctgaaacaccctgctccagttgctgtctaaaccgtaaacaccctgctctagttgctgtctaaaccggaaacaccctgctcttgctgctgtctgaaccgaaaacaccctgctccagttgctgtctaaaccggaaacaccctgctcctgctgctgtctgaaccggaaacaccctgctcctgctgctgtctgactctgagacaacacggccgcgccaactcgctaagaccggcccagcccacggagtaatcctcaatacgctgtcacatacacgaaaagaaaatcaatcagtagttaaagtagatcctgattttaatagatgtggaggtttctcaatttagggagaattaaattagaagcagcttttcaacggttctgtccttagcttagagactttcaaaactcagggaagtcagattggttgaaggatactaccattttgggtaaaaccagtggcttttagaaaacagcttatggtattttggcagcaactatgtgttttagaagctgtgaaggggccttttttcctggagctcagatggcactggtactatttcaacctctaggtgaggtctgttttcagtgaccttggttggcattgggccggagcaggagggtggccctccacatctccactgtagcttgcggggcagcgccctgcacgttcccgtggtggggtgtcccggggaatcttacccagccggttgcaggggttccgtttgaagagagctcgcagcaaactctgtgcctccccactgaggaactgcggcatccccagcttggctctgaaaaacaagatcctattttaggatctattttaggagaacaaggacaagctataaagagggccccagtcagcattcagagacctcaatcgcagtcacccagagcagcccgtgctctaccacgtgggtcttaggacccttttatgctttaaaagttactgaggacaccaaagagcttatgtttatgtgggttacagctgtgatatttaccacagtagaaagtaaagtgagaaatttgtataatttccatttcctaattcactttaataaatttttattaataaacattatttaataataaaatcattaaaaaacaataacactcccattaacacaaataacattgttaatggaaattatctatgttttctcaaacatacatataaaaaagtctttagtggcattgttctgcacttgggtgcgtctcttcctggctcataggagacagctggaccctgtgctcggtctgttgcgatgctatgaagaaaacctgcgagaggaggacctgcaaaccccgggagggtctcaggaccaccggagtcctcagagcacactgagaaccccacgcgcagagcctagtgctccctccagaaattctccatccctcccaagtggaatgccctgaggccacacccgtgacttgctgtcagggattattccagctttagcaaaagtaaagaacatgtcctcccttaaaattcaaacaatgagaatcactgcaaaggtcctgacttgcagctctcagtgtctgctgcaattcaaggtcccttgatggaggaaaaggctgattaaataaaaagacactccttagcttgacaaaagggtcctcacaatggggcttccttcactcccctctctccttccatctacataaggaccgagcttacaaaagctgagctggtggtgttttaggtgattctcaattttataaaagttatgtgtccatttgcaagcagagttggcaagagcagctcatgaggacaaacagctttatgactcctccaccgagtggcctcacttaggaaggaactgattaggggctcccagcctctctgtttcctgccctcctgctgtctgctctgggacagtgatagtcagtggtgtctgctcacatttaggatgctatggcaaggtggtatggggatcaggcttcttcctacagtccaagagcaaaaccttggcttagtaaatgatttttcatgagaattaagcagaaaatggtttgtatccagtcacatggtaaaacgataccgagtcctgccaaggtcaaccaggagtgctatatgaatggggtcagcaggtggggagggaaaggagacccctgctcctgtgatctctccggacaaggccctggaggccttgtgtctttttccgtctatcctttacttctgggaggtcaccaaccatcacgcttgaaaaccagccactacacattctaagtgacttactgatggaaaactatctatggtagaagagttcatcagaaccactcagcaggatgagacaaaccagcaactgctcccttgacccactgtcattagaatgcccagcaccctattaccactgctactggcggacgagcgctaccattttgtgtaaaaccagtgacttttagaaaacagcttacaatactttggcactgtaagcctagcaatgtaattaaaacttcacagttccaggttcagaggcagcagctcttgatatcagaaggtgctcgcaggtctctggggtggctcccacactactcacttgaggatgagagccatggtctccttcctgtccttcccctggaacggcagggaccccgtgagcatctcaaactgcagagcaacacagagcacagtgagttcattcatccagatggacccggcttcacggcagagtaccccagcagggcagcctgctaccgtgtccatttcctcatgcaaaatctccatcagtcaattgtagccactggcctacgtgcttggggtacaacagtgactaaaactgcctcgcagagcttgccatttggtgggtgagacgggtaaatgacagatgtggtagataatcacactctgtggcaggccagcaggccccgagtacgacagagaaaagaggcagagcagggtcctgtggtcaggcagtttggacgaacacatcttacacgcggtttaggaacctgtcctgccctggcaggtgttgtggaagggatgagctaggaggaggaggaggagaacagctagctcatgttgaacacccatgcatgcctggatggtgggggctagagtgcttccagcatgagatagacctgaccacagccattagcctctgacgaggacaatatggcacagcaacctctcagatacagctgccgcaccctacatccttattttgttattactggacacctgccaggacggaacttgagataaggaggggatggagcacagccttgtctgagcatgggtttctttcttgcaccaactcccccgggcacatgcagtggtgattacacacactctggaagcagtggcctggaatggtctcatcagagcaaggtgcacagctgaccgcttctcacaaaagaaactagggctgcagcaggaaccaatcttttcataaaataagaccctgaatctaagtggaatgtgcccaaggatcaatcctactcggtgtctttcacgtcagtttaaattacggggaagcaggtgtttccatggtcttattgaattctctctcatctttattttttgctgcgtgtgtctctgcccttttagaattcatcctccagcattcgtcctttgcagttcgaaaatctcaggagatacacaaagtagaaagaccaaaaaaatcacgcagaattccattacccaaagatatccaaacttaacatttgttagttcctcctagtacttttttcaagctgttttttattttgttttaaaaacacagataaggttttgtatactaacttttcacagaataatataaaactttcaatggttatgatgaaatctttgtaatatcacttaacaaacatggatatgacaaaatgtatagtgagtgtatttgttgctgtacacttaggacatttccaattttctgctattgtaagtactactgaaatgtgcacagatgatttcctaagatttattcttatgataggctgctaggagtgaaattataatcttaaagaaatgaatgcatttaaggttttattaatattaccagtctgctttctgaaaacaacattataaaagaaatggaaactcttccaccagttctgacgtttgaagcctgttctgtcacattaaaatgtgctgtccatccggtgcacagagtaagtgagggaactcagagcagacaggctgcaggcaatcaatcaatacaaaagtaataaaaagcaagcggaagggggtccagatgagaactgaaaaagagacaagtgtaattaaacaggaaaggccagaatgctctgactggcagatgagctgtttgtctggtaaaacaggatgaaagtttataagctgatcatacacactgaaatatctctcagaatagaatggtattagcaaagggaactcctttcctattctgctctttcttctttctttcttgagtctattaatagcactatgaaatcccatttccaaggacaagccttctggctacatgaaatgagaaagctgtcatcccatacacaccgtttaatccttgttacacaaatggtgcctgtccagatgcccggatatcatttattttttgctgatggactggtatcttgcatacatttgtttggtgatttctttttcttttctttttttttttttttgagatggagtctcgctgttgcccaggctggagtgcaatggcacaatctcggctcactgcaacctccgcctcctgggttcaagcgattctcctgtctccacctcccgagtagctgggactacaggcgtgagccaccatgcctggctaatttttgtatttttttttttttttttttttagtagagacagggtttcaccatgttggccaggctgaactggaactcctgacctcaagtgatccgcccgccttggcctcccacaatgcttggattataggcgtgagccactgcgcctggtctggtgatttctttttagcttttgaagatgattcccttgtgatcagggtccactgctttgtggttctctctcttcctccccttcttcctccatccatatggtaggaggtccccaaccatctactcagccagagaacacccagcacagcacccatgaatattcaacaactgcttcttggtgatgaaggtgctgctgacggtggggatgatgctggggcggaggtgtggactttgcagcctccaccagccatggggttctgctgcctttcccatccccttatccacccttttctgtggagaagggagatcatttcagtatgattgtctgaatggagctgcccgggaactttccagtgccgaagcattactgactgaggttttgctgatgagtttcttgggacgttatttacagtaagacttttgctgtgttgctgagcagcactgagacttgccaaggcttccggggtgaactgagaaaagccgaggttcatcttggggttcccacagtcaagtacacgcaccgggggagggagggcactccaaaggattctttcccaatcggcaccgagaccaggctgcagacaggcacagaggggctcaaggagatgtagccaaagctccaccgggtgcaggcccgatgcttctgggaaggtaattggacagacataacgcagtgcttctcaactggggtcaccgttgcctgccaggggacatttccggctgtcatgcccgggagccctggtgctacaggcgtccactgagggaggcacagatgctgctaaacatcctatgacacacagggcgccccacaacaaggaagtgtccagtcccgacctcaacagtgctggctgagaagccctgtctaaagggacagctaaggaacctggaaagagtggcggccccggcacaggcaggatgcgcctcatggaggccagtggtactgggggcaggggaaggaggagactctggggagacccttggtgacaggagcctcgatttcaagtttacttggccgatcaccattcttaaaagggcaccaaaagcaagctaacattttaatctgaaaacaggcgaggacaagccctgacctgagatggatgacttgaagtggtagagggcctggctttgcagggtatggaggggctgggtctcggagagctgtgttgatccatgcccatgtgtggaggtccctgtgtgcacagacacatgccctctaatccgagctgctctcgctccgtgtgctgcaccccactccgagtgccaagaatctcagtctcaaaacagccttggaaggtgccgttcctcacaaccgtctacagatgaatggtccagtggcaagcagcagagcctgagctcagaaccatccgtgtttgctatggtggcataaggacacatcacatggcacctgaggcgggatgtccagaacattccgtgcccgtggttaagaaacgggagaaggataaagtggtctcacgaaaccagagtgctcaagagatgctttagatgtttacaaaacagcccaaatatccttctagaaactggctccagcctggcgtagaggagtgctggaaattctacaaatgtcaccacgcagccggccaccaggtttgcacgttcttctccaggtaccagctcctaatttcagacacggaattttattcagggacactgacttcctgcccctggcacaggcatccttccttccaggtctggggagggcacttgtggatgctgctcctcgggaagagatcccagcacacatccacctccaggggacggacggccacccacacatgaggaccactccctcagcacgcggcctccagggtctcagccttcttttaaaacaaggcccctcacacgcacaacggctctgcaccgatccgcttacaaggcttgggtaagatacgacttcaaaggtcacccgaggcccatctcttagctgcaaatgagaattcagaagtcacttctgatgccacccacggacgtgtgggaagcgtggggcctccacagtcaagacctttgcctgtgtgcagccagtcaccacgtgggcgggcggcactaaatgagaatgtgtttctgggactattatgtgatcttgagcccgacacttaggctctttcagctttagttttcatttctgtgcacagaaagaataccgtctttcctgcccggcttggagattgttgggttgagatcaaatgtgaagatggccaggcagccttagcttgtggtcaccacggcaacagccagccctgcctcgggctcgagagtgacacagcagttctggagccggaccccttccccagctgtcacgagacattgaatgcgggacgatcccagcaaacaagtgaacaattcagtaagaaatgtcctgtgcccagggaggcacgtgggaggagagtgcctgctgtgttgacgtgccgggcagcgctgggccaggcctccttcagaagctctcaatatcatcttcttcacactccagggacagggagggtggggactccaggatgggtgaaggctgccgggcactgggtctgggtgtgagtgcctctctgcttccaccctgttgtcttcactccctcatgggtcccttggaggcctggccaggtgcaggcacttttgtctgtgctggggcatcttgggtaaggtgactggtgtttaagaaactccacgtgccaggagacactcacagagacagacaacgacaataaaagatggcagacgttagagcagtggcaagccaggagtgctgagaagacaccgaagccagagccaccagccagagccaccaacccggccagggtcagcaaaggccactgggagtggtgcttctgtcttagggctgatggtggaaggggaccggggggagtttgctggagcaaggcgagcccgacgtggtctcatttcctcttcttctggcccctcgtcgtgtctccatctttggatcattcctcttctgtctcttctgttctcctatttctttttctttcagcttctccatttgtcttttcggtttgcagtgattaagaccagaagaactgggcgtggtggctcacgcctgcaaccctagcacttctggaggccgaggctggcagactgcctgagcttgggggttcaagaccaacctgggcaacacgatgaaaccctgtctctactaaaatgcaaaaaaaattagctgggtgtggcgggtgcctgtagtcgcagctacttgggaggctgaggcaggagaatggcttgaacccaggaggcggaggttgcagtgagctgagattgcaacactgcactccagcctggtgacagaatgagactccatctcaaaaaacaataaaaaattaaaaaataaaaagaaaaaaaagaaaaaaaattaaatatatattttatattatgagataggttttatgatctgttgccttaatagaagaaacagaagactatcaaatctcccctccccctgtccccccagaaacctcacaaaactaagtccagttggttttgacttatatgtggtgttttggctgtgcttttctctgctaagttactcctctccactccagcctggcctcttgttctttttaaacattggttcacctgagagccaggtggcaacattttatgaccttgttcattacacaaaggctggcccgcagtactgctggatgggccacttgtgagcccagagttataggacaggacccagagacagaaggatgccaggagccctttcagggagcctggatgtgcagcgtggccagccctgctctctgggggaatttggggttctcaggagggggtttaagaactggaatctctcctgaagccacagactataagcttggacccatagcccagcgtcagcaaaggcaacatcagacttccctgcaccggcaaaacctgcaccagcgtgggaggtctccacagggctatccccgctgccctcacccaccactcaccagccagggtcacacaggaaacccacacatgtggaagggagtggacctatcgaggcagaaatcacctccaagacggcaaagcaaacctgcctcactgacctatctaaagaaaacctctttcagtggaaggaaagcagaggtggtctcagaggggtgaccgtgggggacttagctctgtggtctccgcatggagaggacctgctccttagccagtgccactgaaggtctgaataatagtaaaaaataaatcagcagcatcatcctcttggctgagctcgcgggccccttgctttgctgcaggcattctctcaagtgtcgtgcctgtgctcacgtgttgaactgcacgactgtctgtgttgtgactcactttacaggcaggaatgaccagggacggaaggggcttccacaggaaggagtagccacaaacgtgatgtgggcatctccgactgcgaactggctttctgggttaggctgtgggcccatctccggagctggtctaatgtgtgtctgcccctcgcggagaggtgagcagcccgtgcgggcacgtggaacacagccagggcctgtgagctcccggggctgaggccggagcctggagagtgctgcagtgacccaagtggcaaaggaccagcgaggccctgggcaccagccgggggttctccaggcgacaccgcaggactcagccctggggttccctagcaaggggacgaggagtagggtgtggtgggaggagaggcggtcaaaactctgaagggaactgggtttggcaggcacacagttctgccacacgccagcggagcaaccttcatcccgtctcctaaagtgctcatggcctcagtttcctcctgtgtgtgatgcacaggccggagggcgggatacccctgaaatgccacgacccgattgtcatccaggtcagattccagagcactcactgcacgcctgctccaccctgaggtcaccagccccctgcccagctgggagagtgggattgggggagggagggagggtcctgtgaagattgggaaaggagcccacacagttcctagggcggagaagacccagtccaaactgggttctgttaagcactctgcctgcgaaaacgcgacagagacaattcacatttccagacgctgatgcaaaaatgcctaactccgtgtacatctcagtttgtaactaagcgcaaggattctgtgtctaaataagaaaaatactttaactcgaaaatcatggcatctcttgtaatcatcacgctaagcccgaagagcacaaagcataaagagggttcgactcctcccacgtctgcgtttctgcgttctcgtttgcatcccagccccactttctgatggtggggatgtgggatggggaggaggctgccaggaaatgcttggcctggacacttgcccagtgtcccaagccctcaggcactgccttcttccgcatttcgggacctctgaaccaacctggggacaggggtccacgtggggaacagccgccatggcacagaagagggtcggggcaggctcaccatgagcacgccgaaggaccaccagtcggcactctgcgtgtgtcctcgccggttcaccacctcgggcgccatgtactcgatcgtcccgcagaaggagtacgctctcttgtcgtggtcaatggcctccttactcaggccgaaatctacatgcaaacacagcacacacactgcctcagtctctgggtgtgttcgggggtccacactcaggcgggcatcagcgtccttctgtgggctctgccccctctccaggtgggcgcagcagagccctgctcagcaaaagcgggaccatgtgagtgcttcccgaagcccgtcagtgcccgaagcccgccggtgcctgaagccgaaatcctcaaagcgtgaggagttccttatgagtgtacacactcaggagcgccttggaacaccacccagacagcaggttgtcagtcagtgacgggaactcccccagacccttttccacaggcacgtggaggtggggtgttgcagggcagagggacctggggtggaaggcaggtgtgtggctgacagctactgggaaaggggctctggctgccggggagccaaggggaaggcagagtgtggcgaacctgccctgccccgacaacacgagggtgtggagagcacagacaggcggaggaggcctggggagcagaggccgagctatgatggaagaacagggatctccaggtgccacagagcaaggaggggcttctgaaggaagtggccccggggctggaaagaacaagagtgcattggctcagggcccccaagtcttggggatgacagagcgtggctaaatagagccaaggcaggcccagccagtgggtagagcagcagtgcccagagaggccatgtccttgcccctgagcctgggaatgggccaccttatgtggcagaagggactgatatggtttagctgagtccccatccaaatctcaccttgaattgtaagaatccccacgtgtcgtgggagggacagagtgggaggtaactgaatcatgggggtgggtttttccagtgctattctcgtgacagtgaataagactcacgagatctgatggttttatacagggcagttctcctgcacatgctctctctttgcctgctgccatgtaagacgtgctttttctcctccttctccttctgccatgattgtgaggcctccccagccaggtggaacagggtgagtccattaaacctctttcctttatgaattacccagccttgggtatgtctttattagcagtgtgagaataggctaacatggggactttgagaacagactaatacagggactttcagaacagactaatacagggactttgagaacagactaatacagggactttgagaacagactaatacagggactttcagaacagactaatacagggactttcagaacagactaacacagggactttgcagatgccattgaggatctggagataggggatgaccctggatttctgggtgtgcccaacaccattgcaagggtcttcaggttaggaagggaggcaagatgcagtcagagagcttggaagatgctgcctgctggcttccaccatgggggacgcagcccagccaaggactgcgggcagcttctactagctggaagaagctaagcaagggagtctcctctagaggcccccaaaaggcaggcagccctgctgacaccttgatttcattcctgggagacttatttcacacttggggcctcctgacctgtcaggtgataagtttgtgtggtttaaagccccgatgttcctggcattttgttgcagatgctatagggaactaatacaaatggggtgtcctgagactagaggagctgttgccagtttgactgaatttgctggtggctgccagggctcagatggaaacagggagggaagtcacgtggccaccaccacggtccagggagtgagaaggaggcagggacagcatcagtgagggcagcagtgcaggccgcactccagcgagactccagatgtctgccctcaggttggcactgggcatctgcaaggcccacattgcaggctacactccagcaagactccagatgtctgcactaaggtcagcactgggcactgggactcctgaactaaacacccagcgacgctgaaggagcccagcaaacagaacgtggcaggggagagggaaaagaaggggccaccgggaagctgcatgggtctggacgttatgaagacatacaatgccataagcagtctgtagctatagaaaattctgccaaatcagagacaagcatctggcaaagggaagggcggtgtaaataagagggcttgggctttgaggtggtccccaaaggtaccagggctgagatgaagccatggagggggcctgccgtcttttacaaacctgtgatcttaatgtgcccctcttcatccaggaggatgctaaaagaaagggagagaaaacagatgctttagaaagagacccagcctgccgacgggcacgcagagctcagaggagagctgcggggcagctgggggcggacgttttcagggagccctgatggagctggcccaggagatccccacggcttgtgcggtgggccttcccatcctgcctcgcttctccacagctcccagctcgagaaagcatttggtgccacacctcctggataaagggatgtgtgttcgtgcagctggaggactgctggctttagatattcgtgggtccccagggaaggtctaagagccctccagactgctgtgcgcaaagcataggtggagagcgtcctgggactgctgtggcctgtggagacccagagcctcgcagatggaatgtttctgcactcgggatgcccttgatgtccaaagacccccttcttctcccatgtatcctcccctgagccctgccctggctctccagacccacccaggtgaggcctgcacaagcgggggccaaggcatcgaggagcttcgggcttcagcaggtacatcttgtgatgagacctgctcccggcttggcacccctgcgggccactgggtccctgtcttgttccctgccaagcccttgtcacgccatgtgccggacgtgacagttgcctttgctcctcccaggtatcctgccgtggggtgaaccctgcatagagaatggaggcagggtccgtaaagggctgggtgcaggcataaatcccttcttccctgaacatcaggcgggagtctgggctgtgataccttgacacacctgtggccctaaactttccccatttatttatttggctgtaattaaatcctgttcttccagatgctgggaggtaccagcctagccctaaagagaccaggaagtgggctggaaagaaacaaaggcaaggcttggaggattaatctgtgatacctttatagaaacctgtgaaaggaaggaaagcctgacttgctacagcacagaggagcccggaggacattatgctcgattaaataagcccgtccccaaacgacaggtattatatgattttacaaatataaaatgtatggtccctagaggggccagagtcacagagatggaaagtggatggcgggtgccgggggctggggagctactgtgcagggggacagagctttagttctgcaagatgaaacagttctggagatggacggtggggatgggggcccagcaatgggaacgtgcttaatgccactgaactgggcacttaaacgtggtgaaaactgtaaaagtcatgtgtatttttctacaattaaaaaaaatctgccacagagttaaaaaaataaccactattttctggaaatgggaaggaaaagttacagcatgtaattaagatgacaatttataatgaacaaggcaaatcttttcatctttgccttttgggcatattcaatctttgcccagaattaagcacctttcaagattaattctctaataattctagttgaacaacacaaccttttccttcaagcttgcaattaaataaggctatttttagctgtaaggatcacgctgaccttcaggagcaatgagaaccggcactcccggcctgagtggatgcacggggagtgtgtctaacacacaggcgtcaacagccagggccgcacgaggaggaggagtggcaacgtccacacagactcacaacacggcactccgacttggagggtaattaataccaggttaacttctgggatgaccttggcaacgacccaaggtgacaggccaggctctgcaatcacctcccaattaaggagaggcgaaaggggactcccagggctcagagcaccacggggttctaggtcagacccactttgaaatggaaatctggccttgtgctgctgctcttgtggggagacagcagctgcggaggctgctctcttcatgggattactctggataaagtcttttttgattctacgttgagcatcccttatctgaaatgcctgaaaccggaagtgtttaggatttggggattttgcaatatttacttatatataatgagatatcttggagatgggccacaagtctgaaatgaaacaaaattcatttatgtttcatatataccttctacacatcacctggagctaatttatagaatattttaaataattttgtgtatgaaaccacgtttgtgttaagtgcttatgtgtggaattttccactggggggtgtcccattggggctcaaaaagttttggattttggagcatttcagattcggatgagggatgctccagctgtatttacacacgtattcaactcacatgtgtgcctgtggcgttccacggactggtggtgaagtcagatcatcaagcacatgggcaaatgcattttgcatcctgcagtggatatgggatgtgacctggtttctgggtaaacccagctgtttcccatagatgacagctgcatctaacaacaccagcttcggagcagggcttgtcttttctcagttccatgcaggtgacagggcaggaatgtggagtagcaactgggacgcgtttgcagaccccagggcccccccttggtcttagctcacaggcacggggctctctggtggtacccaaggccggtcggtcccaccaggccacaggtgatgcctcatctaggggcggctatgggccctggtctgggtgggtggcattaatcggcccctcagggcagggaagagtgagtgatcacctcagggatactgctgaggtcaactcaacctaaaataccatcctccaaatctcttcttttctaagtggatcactcctagttatgtgtcaggtctacaaagaatatgtaaaaacaacaacaacaaaatgaaaatgggaacactattattttggagggactttactgttcaaaaatctagaatagattagcaaaatatcgtagaaataatagcctcacaggtcaccactgccaaggatatacaaatctcagtggactctgggtctgagaattctggggccgttgtcttttaggtaagttcttgggagagctgttctgactggggacctagaggtggggctgacaagtaactgagtagaggttcattgaccacattcctgggacttgctgaagtagatgaaagggcttcctgaatctggaggacagtagggaagagatgagagaggaggagaaactgccctggaggcagccatgtttgagatggtccccagtggccagatgagcctcacccaggagagagggcgggaatgtgggtcagggtcgtgggcgtgcccctccccagctccggcttcccgtgcatcacagacatgcacctgagcctggcctccctcaggcgttatgagtgtcaggtgagaatgggcctgggcatttcctatgcaaatcagcaaggccacacctgcatctgggcacctgatgcctgagccggtcctgccggcacaagagtctccccagcctgctctctgatatgtcctcatttaggaaataaatatctagcagtggctaccaacatgggccaggaaaatacatggagctgatgggcgtggggaagtcagccctagttttttctcacttacttctcaggcttcagatctctgtagatgatccccaggctgtggagatggtctaaagccaaggccagctcagccaggtagaacttgacatcctcctccgtgaacatgacctagtaagaaaaaaacaaaaacaaaaacaaaaaacgtttaacttgttttatggctggtgtgttttaaagaactctgccagagagactgagagtccacactggggtcagtttgctctgtggaacgctatggccccccagagtggtcttctgactcttctcatggaaaagtgagttccctctgcagttccaagatcagtggatggagacgagggcttcctgcacaggtgactcatgccgccttgagagtggggtgctgagattcagcctctcctctctgtgtccttctcacccctgcaaatcatttggctctggagtaggtttctgggtttacattctagcatgagtgctgctcatgtgaattcataacaaatgtaatacaagtaagacgctgagggcttgatgaggtgactgaaaatggggctcaaatatcattctttccccatggattatctatctccactccttgggttgatgcaaactagtagcctacgtaacctgctgtcaacccaaagtgggattagttctaccaaagatcacccacaggtggtacagagttggctatgggtgccccaagctgagggggcgggatggggaggggtttccaggtgttggggttggcagccacattccgggatcccacgtagctgggacagctcagggctgggaggtgaccaggcagggatggcctaagtgtccatgtcccgggggctcactcaggccagccgaaacatgcatgaggcctcggagcccaacagactccaaagccatcgccccataatgactcatccccacccccgacttgttagaatcagcacatagattttgtagacccccttaagaggaagcaaaatcatgaccacaagccattttctatattcgtcaggagaaatcaatgttatggagactacaagtccacatgattactgaattctctccggtaagcagacgtgaaaaatcagcacgcagccagaaggctgcccggcaaacacaaaattagaagggcagccaggggacctgaacggtgagtggcgtcaggccgacagccgggcacccgcttcacacagggggttcttccacagggctggacacgcaggctctgcatcctgacagtgactggtgggtgccagccacccaccggccccccgagtccccgtcctccattccacgcttggccagcgcctttcccggatgtatgtttcttttctagatcggttaaggtgctcagtggactgactgacagcacgttctgctagtggcctggttctttcctctgacttgacatatccacacgtggcccaccatgggttttgtgtacaatttagggctcagaggcaaacctgtctttccactcccctagctcttagtgtaacccccaaggacaatagcaggaagtttctccatagaaagggaacacctcacggtgtgagttctgcaggttcaccggcacagcgatggtccccgtaagatgctggaccccgtacttgctaaatgacgacccaaggtgagttctgcaggttcgccggcacagcgacggtccccataagatgctggaccccatacttgctgaatgaggacccaaggaaaagactttccgcaggttcccagcaactccacgaatctgtggtgcccgccctggacaacttccctcctactccgaaatgaaggccctcgggggaggcacacattcccacgtggggagctgcaggactttttgctgattactgttgtctttttggtcagggggcccaaccacaggcgtgtcatagcagctgctggacaaaactggaccccaaatggactgactccctgtggatgagaggggagtggacaaaccaacagatgataccacatgaggaatgggcagacaccaggctccagcatctttggaaatggccacacagcaggaggcaaaggaaggggccagacgccagttcccaaaggcctttgtgtagagcttggatcaggttctcccggcccactgtttttcctccatgcaaggagccccacagaaacgtgcaccactgtccaagggactgctggacgcagagggacagggcagccatggtctctgggaccctttgcgcccgattcaggagcagctctgccttggtttactgttcatttggggctttgtgcaagacagcggggtctcctgctgaaaagggggaaggtggggaaaagggagtggggggtgtgaaggccactgttgctgtgaaagcacctcggccactcctttgtataagagatgaacaagcaggatcgtcagaacggaaagcccggcactggcactgccatgggcagaatctgccttttgccatcccatgaagcggggtgcttttcacgtcaatcagggccacggggctctcagggtgcagtgaagttgcatcctggagggttcctacctaaggcactggaggtcaaggagaagccctggggtgtgcagtagcggctgtgagacaaaggtggcgtgcgaagaccacacccgatgctcccgaacagccccaatgttcagccggcttagcagtacctccctcttccctccctcttcccaggatggaaagtgagaccctgtgagagtctttcccagccgctcctacccaccgacctgcgccttccatctgcgctagctgggaggtcaacagcgtgacttatggtcccagagctgcaggggcgctgccagggccacctgggacgattgctagggccacttgtgcagcttccttagaaccaggcagcaatgcacacagcacacccaacacacacacacacacacacacccaccccacatcacacatagcacacaccacacataccacatacagcacacacacacaactcatacatacacacaccctacataggcacacaggatgtcaaacacacagacaccccacaccacacaaagcacataccacacataccacatatagcacacacacacccacacacaaacacaccccacacatacacacaccctgcatatgcacacatgcacaaagcacaccacacaccccacacatagcacacaccacgcacaccaaccccacacatgcacacagcatgccaaacacacccccacatatacacatagcacacacaccatcacacacagcacacatcacatacaccacaaatcacacgcctgacatatacacacagcacacatcacacacataccacacacttatcacatgacacatgcacaccccacatgcacacacactcacattcccacacaccatgcacacacaaccccaaacaccacgcacacccccccacacacgcactcaaacacatacacaccccacacatcacgcacatgcactcacacagcccccatgcaaaccccacacatgcacatgcagtctcgcaaccccccaccacacatcatgcacacttgcacacactcacacatgtacacctctcccacacacgcactcttgcacacactcacacatgcacacacccccacacacacacacgcactctcgcacgtgctcacgtcctctcaatgctctccacccctcctcccctcgagtcccagacagaagctcctgcccgccctcctgtgtgatgtggcggctgctcacctctttggagagccgggtgaagaggtcccctccccgcaggaagtccaggatcaggtagagctttccttccgtctgaaaggctgtgggggacagagacccgcattttgacagcttgtcgaatgtcctgtggcaacatcgctctctggcttctccctgctcacggtgctgcttactccgggaggctgagtcacttgagaaacggcaggaccccggctggtgaccagctcagaggggcagcacccggcagagggggtctgacactgtgagcgctgcccctctctcactgtcgttagggggccttgagatttctttcatctttctttcctctcccctccctcccttttttaatcacaaaggaattgaaagatacacggggagaaagatgtgaatatttaagctggtatcgttgctggcttttgtcgtaatgcattagtgagcagcctgaagatggctctggtgggtttggaggacatgtcctttccgtcctatggaagtgccttcttcttacagaactccactctggtaccagggagccccccgcttgccttcctctcttgaggcagttctggtgataggtcagcccagttatttgaacatcaacaatggggctcacgtcctaggtctggtcactgtgagctataactgcagactttctgtttcaggccacaggcaggctacacagctcctgcccacactcagcaagggcctgcctctgttgagcgggcgcatgagcacgggagggtctagagaagcccgtcaccatcgctgctgtgacgatggttgctgcagtggcactggtgaggcaccgcgtggcatcttttttatctacaaaggaagtgtggctggaagggatcccaatatccctgcatactagaaaacgttttattttctaaaagtaaatgctagaagcatcataaatgtgggggttttagaaacatagcccccagctagaaagccctctgccaggactgtgtaaactgagtgtgcattaaatgctccatcctgggcttggcaggcaggtggaggtgctgggtcaccactgaggtgatgtggaggtctgtttaaagctctttgtaggacacccagttctcaatttcttcagaaaagcaccctagcaagtaatgtaaatgacacgtgggatgggacttgacaccagccacttggcagcagcggagggggcagagttttggaaagccagcctctgcagcctcctctgccgggaggtagaggtttgcaactgcgctgcccacggccgagaaggaacagcagggtgtgcccagcttctgcaggcctccttcatcctgtcctcagattcacgcaaatctcactaacacctccccgacacaccaccttgccctttgcaaccaagaacaaactattagttttgttgctgttcccttctgtactttgctcatctggattattaggtgggaaagtttaatgtaataagccatgaatctgcagccaccatctcatcacatcttttttaaatttgaagatttcacttactgcttctctgttgggataaaaaggcagacagcaaatgaagagaagttgtgtggcaaagcagctatgtggcctttggttaattatttgagcctcagaacatgaaaataataagctaccttgaatagaagttttgagggttcaacgaactactatctttaaacatgatattcatttgaaatgaggtgttaccatttctggtttaaagaaattattgggtcatagagtattttattctaaaacaacacaaaaataagtcatagattcaccccaatctaggttaagatcttctaaattatcaatggtatggtaataatttaataatggataccccatctaaaattagatctttgagatgaaaacagggcttcttgctctttcaaagaaaataaatacagaagagattaagtgatcaggatagaaggcaccttcctccccaggcagggcaggactctatggtataggaaagattttcttctttctgatctgttatttctttttcaattttctttgatctggagaaggttgccctgggtcctctttaaagtgtcattttgactctacttaccataatgaagcttcacaatgaaggggtgattcacttctgccaagatgtctctctccatcttcgatctcactcggtcccgaactgcaaagtaaaaagataaaggctttcatgaggcaggaaataagagttctgaggaacactgaacatgaaatactagatataattcccgccaacttttcattaaaaaatttcaaacatatacaaaacttgaaaaagttgtacaataatcctagatttaacaactgcttacgttttaatacatttgctttctctctctcatatatatatatatatatatatatatatatatatatatatatatatatatatatatgcatctctagctctccaaaaaattgtaggcagcacgacatgttactctgaggtgcatgtgcaggtgtctcctaagaataaagacagtctcttagcataactttaacacctactgtgccacataggaaagccaacaatcactccatgaaacatctaacatccaatctatattcagtcctcccctccacgtcgttttcccgacctaggatccagttcaattatattggttgttaaatgtctttgttttgctcctagaagacaatggtcccatacctatttccctcgccctgtattttttcgtggactttttgggaagtccaggtcagttttcgtctgtagaatgttccacattctgggttcgtctgatggttgctcatttgctttctaaaactcttgtatttcttgtaaactggaggcgtgataagattggggctaaatgattttggtcaccaggtgatgcctgtactttagcctgcctcagatcagggggtgcctgctgggctcaccctctctgtgtgatgctaaacgtgatgtgtggttgaggtggcaggtcaccatctctccatggaaaaggtcttcatgtccctttgtaacaagaacctgtgggctgatatctggcatagagtgacctgcgggttccctaacaatccttcatccaatggtgtgagcatacatacgtgatccctgcctgaatcattcagggctaaagaacagccatggtcacatttctgatggaactggaaatcaagaggaagattccttctctccctctccatgaagataaccatggaccatgtactttctgttgaatttagtgtgttacaacagctacatattcttcttagtgctcacactatctcaagtgtggccatctgggaatacagatgtaattagttttgatgcagaaacaaatgaacaaacaaagagcaccacttgagtaaaaacagctttagcattcccctgggcaagctgctacacccagggcagtatccgggacctcacacagccccatgagcgatgggagaaaatttcttcaaacattgctattgggacaaatatgatcagtattgtatcatgggccaggtatttaaatttatccatatttaggacttgtgatacatactgctaaagttttatttaagaaattcttcaccaagaatgctgcaataataaaaagaaaatagaaaattacaaactgggaggatgtggagaacttggaaccatcatgcattgctgatgacagtgtaaaatggtgcagtcactgaggaaaatagcttggtagttccttacaaagaagtagaattaccatgcagcccagcaactctgctcacaggatacacatccaaaaaaactgaaagtatggatttgaacgggttcatccacccatgttcatggcagcattatttacaacagaaaaggaggaagcaacccaagtgtccatcaacagatggatgaacaaaatgtgatgctgtagtaaatacacacacacatacacaaacacacacacacacacaatgggatattattcagctctaaaaaagagtaaaattctaacacacagtatgaatgaaacctcaggacattatgctaagtgaaataagccagacacaagaggacaactattgtaggatcccacttataagagttgcccagagtagccagaatcagagagacagaaagcaggatcgtggtgaacaggagctggaagggggagaatgggaagtcattgtttccacctgggatgatacaaagattttgggtataacattggtgaggacaacattgtgaatgtattgatgtcactgaactgttcacttacaaatggttaaaatgatcaatattatgttatatatgtcttaccacagttaaaaagagaaagtccttcctcattcctgggtccctgagtttcactgtctcaactcctggttttaatactcacacctaggattcaggctgtctgaagtccacctttgtctttggtgttgggacagttttgctttcccgtttggtctgtaatactgtctccgggggcccaggtggtgaccgtggtgtatggccctgcaacccagctcactgtcagtgtcactgtgccctactcttggctttggtttcctcatatacaaaccggatgagatggctccccctcctggggctgcctaagaaacctgtgcagtgatgtgtgtgccacaacaacacggggcccgcccacactgtgccgcttcaggtgtcattgcagtgacacctttattatatgctcagatcccctttttttctttttctttttttctgatctctccttgctgttccactgctctgcccatccctcttctaaccccagacccttgtcatcaccgtggtcctgtgacattccttacagcaggggtgtccaatcttttgacttcctgggccacaccggaaaaactgtcttgagccacacataaaatacactaacactagctatagctgatgagcttcaaaacatcacaaaaaatctcataatcgtttaagaaagtttacgaatttgggttgggctgcattaaaagctatcctgggccccatgtagcccacaagctgtgggttggacaagcttgccttagagtctagacaggcatcgagtaggcacccagcaggcagtgctgtgggcagagctgggggatactagtgtctcccctaaacctcagcacctccttccccagtggtcctcgcagttcctaatcccttgagaccaaaacaccaaggtggagggtgcgggagcgactgcttatcacttctgcccaaggggacacaggaggtccttcttctgcctcaactaacggaatcaggattttattgcttaaaagaccttggggagcatgcaattcaaccccatgttcttacagaagaggaaacatgctcactgcagtaaaaagtattgcttaaagttaggtagctcctggtagcctggaggaaggagacccctgcctgccccgctccactgggtgaaggcctggcgtacgtcccagccagcatgtgagcactgtcctcactggacacaggggcagcatggactgtggcacagaagacaaacgctggggaggaaaagggggaagcaagcaacctgggctgaaggagatttaatgagaggggccatgaatggaaaccactgtcccagtcgttaaagtggagcactgtgttcagaagccaggatagcgcagaacactttcaaagaatacaattttgtacccctggctatgattttctctctagagtaatgaccccggagtttagagattcttttcttcctttctgattgtagtcattgtgtgcaaacattttcagaaggctctcctgcagaatttagtcttgcacccgctcctgtttatcatttgtgagttcatgtcttagtgatctggattctgcgtgctggtcagagtagtttttcttctctatgtaggtgaactggaaaataggccataggatcgcggattgtggggagatgtgggagcaaaggtaggctcggtcttcctagcccttttgcaaatcagacagctgaatggtgaggtcacaattcttgccgcttggcctcaaattccttcctcccccacctcttctcctggcccactcctttcccatcactacttctcagtcttctttgtgccaggtgtttggaatgtgaagaggcaggctctgccctccaggaagtgagagcccagtggggagatgccctgtggtgatggcagcaaggggccaccagagggtgaccagtcccacctcttgtgtgctgggggacctgtgcatgctgggggaactggaaacagcctgggaggttttcacagaggaggggctaagccttacaggggacccgggagcctccaggtgcttgggcaggaggatacaggccaagggatggccctgtagggtggcagctggggtaccctcagggatgccagtgggctggcgcacagagctgcagtgccacactgatgaggcctgcgggcagggacatgggggcctggggagccaagagaccatggacaggactttcacacagcacatgtttagggcctctagatttaagaggtcatgtggaggatgcaatagcaacatggctggaatggacaacgtggctagaatggggcaaaaggatactgctatccagccctgcagagggacagatctggcctggaggagggagaactgagacctcaggacctctcagctgctgagaataaaaagaagggagctgcatcatcctagccctctgcctgggcgactggtggagaaattagccaggagagaagtcaggtggtgggcagggagagaagaggccacctgcattctcggcctgttgagtgctggggacatgcagggctcaggaaaagacttggtttggagctttgctggaaatacagatgcgaacgcccaccccacagcagcagccaagggtgcccaaggaccactggaggatatgtaggatgagagtagaaccatggtgaggacctcggtagggttactgttgttctggggaaggagggagagaggatgcaccatgatgtggtccacagtgggaagacctggaggagacagacagagaaatcaggaaatgtgaaagaagtgtttggtggcagcagatgctcaagacagtccaccaggtggggactgcaggaggccgctggtggagttgcatgactcatggccgattcatcagggacgatgtgatgaggacatcgctcatcccccgggaggggcccgcagctgggtctgtgatgtggtgggtgagtgaagtcagcatctctgtaaccccttggtgtgacttttagaagctctgatatactttcttattaaaacattttatccattcattcttgaaaaaatagttcctgatgtagataaaaagaagagagcttgttttattaaccatgactgcagttatgcaccagagaggacactctgaagggcaaaatctcatatcagcatcggcgtgacgtcattaggatgctctcaacacaagctggagattgccgaatggagctcttgtatctactaccctggctctgcagcagaggagaatgaatgtagggaggaaaagcaaaatgattcacagggaaaatgttacaaagaatgtctctgtgaaaggaaaataaatcctggggcccccacatcactaagctaaagggaaaagtcaagctgggagctgctgagggcaaatctgcctcccattctattcaaagtcacccctctgctcactgagataaatgcagatctgattgcctcctttggagaggctagtcagaaactcagaagaatgcgaccatttgtctctcatctacctatgacccggaagccccttccccgctgaagactggaaagtcttcccacctttgcttcgagttgtccaacctttccggactgaaccaatgttcatcatacatatgttgattgatgtcttatgtctccctagaatgtacaaaaccaaacggtcccctgaccaccttgggcacatgctgtcaggacctcctgaggctgtcacaggtgcatgccctcaaccttggcataaactttttaaattaactgagacctgtctgagattttgggggttcacatctccattgcccacctctcccccgttacagcctccaatagctacagccagtgtgagcaccaaagagtttcagggagttgatgaaagcaaacctggaatctattcactcagcacaaagaccccaaaggaagaaaggacacagtggagtcagaaagatttctctcaaagtaaaagcaaaggcctaggcagaagacacagggctcacgaatgcaggcaggctctgcaggaagccaggggtgggggaggcaggagtgactgcacacagtgggaggggtggggacactgccccttctaggatgattaaacaacaagcctctctctctctgagctgcctgctggcatcaaacaaagttaaactcaacaaggaaaacttctctgtcacacatcacacagccaacggggctgccattgaggacccgtgggctctgccacgccctagactcagaatgcttccacaaggagaaatcctcatgagatgcatgtggccaggcttcctacactgtgccctttatctcagcagagcaggcccaggctcggcagggcccacgggagagcaggccatccgtcattccaatgtgcctcctcttctgggtgaagtccctgttccatctgccaggccctgcatgatctgaagctgagacctggtgaagcagcatggcagagaaaaggggggttcctactccatcttgccatctccttgcaaagcttgatctttgactctgggtaagagcatctaaaaatcctctaaataggactgatgttattgaattcacatccatttggaatgaagaacattgtttagccacatgtctgactttatagcattggtaaggaaaacttggtaagtctggtgaaaaattagagaaagatagatgtcttatattcaaattttgaagggactacctagttacagtaaaaaaaaaaataggtctcctccctatatcttacactaaaataaatcccagatctattaaagaattacttaaaaaacaaaacaaaacaaaacaaaaaaacacaaagctggccaggcacagtggctcatacctgtaatcccaacattttgggaggctgaggtgggtggatcacttgagccgaagagttggagacaagcctaagtgttgggaacaggcccccaaatctggccataaactggccccaaaactggccataaacaaaatctctgcagcactgtgacatgcttgtgatggccttgacagcatggcccacccagggcggaaaaccacttaaggcgttcttttgttttgtttttttttttttttttttttttttttttttgagacggagtctcgctctgtcgcccaggccggactgcggactgcagtggcgcaatctcggctcactgcaagctcctcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccacttaaggcattcttaaaccacaaacaacagcatgagcgatctgtgccttaaggacctgttcctgctgcagataactagccagtgccatccttttatttgggcccatccctttatttcccgtaaggaatacttttagtaaatcttatgactgacttgctgtcagtaaatatgtgggtaaatctctgttcgaggctcttagctctgaggctgtgagacccctgatttcccactccacacgctatatttctgtgtgtgtgtctttaattcctctagcgctgctgggttagggtctccaccactgagctggtcttggcacctgagcaacatggtaaaaccctgtctctactaaaaatacaaaaaattagccaggaatggtggtgtgcacctgcagccctagctacttgggaggctgagatgggagaatctcttgagcctgggaagttgaggctgggtgacaggagtaaaacactgcctcaaaaaaaaaaaaaaaaaaaaagcaataacaaattataataaagttgaacacttatctggtgtctggaaggggaatcttttttgttttttaaatataaactatggaagaaataacacagtaaacatagttacaaaatatttacaaattggccattcaaaaagattataaaattaaaaggcaaacaaaaaaatatgattatcttaaacaagcagaaaaaaggtcaaaagccaaaataaatacaatacccaaatactatcattatgcttataataataaacagagaatccagccatgacagtgaatgcaacatattccagattaaacccatcagtgcagggaagacgtttttataagaatgttctgtatggttgactccccaggcacaatgtggcctaacacaagtatatgttgagtttagggtggcagaaaacaggaaaaggatgtgttcattccagggcagggctatattactgctgacaacactgtgtaactgaccatgcctagtttccatatatgaatgcaaggacaaactaaacaagatgtcaagggacaaggacagtcattacaccaagcaatgccctcagcatatgaaatactaggactggaaatggctcttcaagagggactagggaagatgttcaggtctgtgcaaattctagctttgctgggcagagctgcaatccactgacctcaccattgcccaccctaggtggtgtcagtcattcatggcccatatccagggatggaatgagagagctgcaaccatggatctgccaactgacagccatggagtgattcttccactaagaaacagacagtgaaagcaaatgtttcattttctgatgctgagtacgttcaagccgcctctttgacagccagggagtccaaggagttttcatttctaagatctagatgtataaaaaagaaaaccaagtgaagaggtttcttcagaaatgtcagcaacaatttcctgttgggtagttctagactactggagactctggagccaggccatttggcccaggctatagcgtctctgtgatgtttattctctggtacttaacaggttagtctggagttgactggggattgctactatagatgtgaaaagaataaatgttctcggctatcttgagattcgctaataaatggtaggcactggggataagttaaaatttcattgtccttcaaattagccctctatttgtggccaacctgccgcgtttcgggtttggatgatgtagtttccgtggtttactttgctctgttcagcaacctgtgcctactggtaccagctctaactgccatgtgctcttcacctgtcatggccccaagacaatccctggggctgagatggttgtggaggcaccaacaggttcaccccactgtgaagggcacactggtttccttcccaggaaaacacgggaggaagcactttgtgagattatcctggcaggcataggatatatgatatgcaactagagctactttctggaacccctcttcaaggtgcctcttttcaggcagcaatgcaggcattgctttgtgtttctgatttttaaatgatctccaccaatagacattatatgtatattacattatgtagtatattgtggtggttagttttacatgtcaacttgactgggctaagagatgcccagagagctggtgaaccatgatttctgggtgtgtgtgtgagggcgtttctggaagatatcaacatttgaattggtggactgagtaaagatcaccctcccctatatgggcaggcaccatccagcccactgagggccagaatagaacaaaaaagcagtgggagaggaatctgctccctgttgaactgggacatgcatgttttccagccctcggacatcagtgcctggttcttggactgagacttaaaccattgcactcctctccccacaccaagttctcaggacttcgaattcagactgaaacttataccaccagctctcctggttctcaggactttgaatttggactggaacttataccaccagctctcctggttctcgggacttcgaattcagactggaacttataccaccagctctcctggttcttgggactttgaattcggactggaacttatgccaccagctctcctggttctcaggcctttggatttgaactgaatgacaccccagccttcctggttctccagcttgcagacagaagctcctggagcttctcagccttcatacccatgtgagctgattcctgtaacaaatctccctctaagaaatgtatatccatcccgttggttgtgttactctggaaaatcctgaataatacagaatttggtacccaaaagtgggatgcccctataataaaacctaagaatgtagaagtagctttggaaatgggtaatgggtagaggttggaagagttctgagatacagctagaaaaggcctatcttgccatgaacagacctttcaatgtgattctggtgaggactcagaaagaaaaggagagctgtagagaaggcctacatcttcttagggaataactaaggaatcctgaatgctgataggaagtcagtatggaccagccatctccacagaagccggcagcgattctccaaggcaacagaaacatgaccctgcagccaactcagagagcatcagggctgcccacccatgtcaggccaggcacaagagccccagggtagaatgatttaaaagtaggggccactggtgcctgggactgcaagggcactgcctcacatcatgggctgcccaccctccagcactgctgtccctggctgtcccgggtgcagctctgccttgggcagaccctggtgccctgtgagccccagcagttgccttctggagggagcaggtggcaaaggctggcagtgactgtgtggttctcttttccccaccatggggagtgcaggagccttgggggtgtggctgcccttacctaaatttcaaaggctggggtccaggcacagaaccactgtagggccatccaactacactggattgggtcacccaaagctgtgggaggccacccaaagctgtggggccagggacttggagagccaacccctgccctgcaaagctccggggcagaaccgccaactcgttatgtccaaaaggcaggacccctgctccagtgggtctggagggcacagcatctagtcaaagaggattattctggagtcttgaggttccatgttattttctctgttgggttttagacttacttgggacctgttactccttttctttcctatttctcctttcggaaagaaaatgtctgtcctatgctggtcccaccacgggatttctgaggcacagagctcgtgtgttttcataggctcacagctggagggtgactgtggtcaggatgaatcataccttggatctcactaatacagagagatcgcagagatactgacattggggatcagaggaaaccatatgatttggatgagatgttgggctttagacttgagttgatgtgggaatgaagcggaggctatggagatgggatgaatgtgggaaagatatgaattttagggactggggtggaacgccatagactgtgtatgttccccccactaaattcatatgttgaaacctaacccccagtgtgatggttttaggtggggcctccgggaggtgattaggtcagaagggtggagccctcatgcatgagattagtgcccttagaaatgagaccccagagagctcattcatgccttccatcaagtgaggacacagccagaagatggctatgaaccagacagcagccctccccaggcacaaaatctgacacagcctggatcttggacttgtggcagaactgtgagaaaaaaatttctgttgtttagaagccacacaatctatgatgttctgtgatatctgcctgaatgaactaagacacgtatcgtatcatattatagcatactgttctgttctgttctatctaggtgataatacaaaagaaaattaaggttaagataaaattaaattaaatgcaattctgtcagctgctgtgaagatgagcaatggctgtgtaaatgcacctaaggaaaccactgtgttggggacgtagtggatgccgcactgaccgtgcagtgccaatagctctgctgccacaaacccacgggaccttggcttctgcacacacctctgtggggggctgagcatacgcagacggccttggtgacctgaaggcctggcagtcagaggctcgatgatgctttgtggttgatgcagcgcaactggagggattttgaagactgagccgacagacacactttcgcctgagacttaccagcactggagagtgcgggctgtgctagctcggtctcccccactgcgcggccattgcctgagacttcctttctttacccccataaaggctattgagcctgaaattatatcccgagcagtctcccagatgcagaataaaagtccttcttcccacagtatcttttagctttcaaaggtttaattcatagtaaaaaacggacttccacgagccatcgtgtggctaaacttttgggggcaaactttttacagtgaattactccacacataaaggaagagaagaaaaccataaataataagaagcaaagttaaccacactgattaccagaatgggcatgactccccaacaggtgtctttttattcttctatactcaagtattttttaaaagactgatatggttacttaactgacttccttaatagagaatctttgtcagaaaaatcttaagcccattactcttaactacttacactgcagaggtattaaagatgacaagtaatgaaaaaaatctatttcctcctttttgaatatctgtaattcaagaaatgcaactctggtaataaacacatagaggactccaccatacagaggcgggtgtatctgtaataaatcagatgcctgttaggtaagggtgatgtttatctgaaatgcaagagacagagtgagatcgtaccttacaaagggcttgagaaagacagaagtcaaagatggcttaaggaggagacattttcattttgtttgtcatcttatgcaattaaatgggaaatgaatcccttgaagagtaaacaccttaagtaccatgagcagggatgtagcttcttgctgaagaaatgcagggagtctgtcatctggtgaggatgcagctggcccagggaggcctggggaccccaggagttatcttgggataagcataggattctgaccttcaccacctccaaacaatacgcttttgagtaactttgctgccttgtgccttagtttcatcattcgtaaataaagatgatgatttataaaaatataataataataataacagtcctcccctcttaagagagggcaaaattgtgcttagaattttccttacttttttctcccctgggaatctgaaatcatccaaatgggaatcaaatgacataaatgaattagcatattatggaaatacaatctgttcaagctaccagattgatcggagctgagtttctgagtgactcagtgccttctaacgaagcatctcagcataagagaggaaaacaaataaagaggtgctgaaaataacattctggggtttgcagccaggcgggctaactccgaggaggttctatttcaagatgctgtcattgatacctgtctatgcgggtcactacacacagctctgcattcccagtgcctctgcagtgatcccatcttacaggacgtgctccactgcttacaggaaggacagagggggctttgacatgttggcaagctcggactgtgctgcctaggcccattccagcatctcctgactgccgtgggtgccatgagagtgacccaccacacagctgccaaaaacacacaccagcataaccatcagtgacttgacttgcttcaacagagagattctgctggaatgattttattttctcctttacaaacaactgaacacagcttatttccttccaggaagggaatgcatatctcctctaggctgagaaagttgacttgcagggaaaatgcttgaaaactagttaggcatgaaaacccaggtgcagtcctatcagaaaaatcatcattaccaagaaatatttcacgtaagcagctcattcgacactgcggagagcgcctaccgagacgaaggaattccacactgcaagccctcctgcagaagggcgcacctgtgttctccgtgcaggcaccggccatctttagtcatgaacatgatcacaggcctttcatattgtaactggaggtattacagctgaaccaagacatcattctttctaaccaggtggcatctaacttcctccccacatccctattcagcagaactaaataaaacctcaaccaggaaagtcctaacacagctccaaagccaagcagtctttgtggagaaaagggctgaaggtgaacacagcttacactttccaagcctttgcttgagccggcagcactctgcacactctaacaagggagagcctcacgtcggcaatgatgtggggtagttatctgttaatacaacctatcccactttcagcagggggacactgaggccaggagaggcaccccaagatgacacagctcgtggggttagagctggactcagctccagggtctggacttggtgttcctggcccctgtatcagggattctccatgttggcagtgccctagagacaccggcggaggtagctttcatcaattctcgcgctcagaccaaccaacttagagtctcccagaggggtccgaggcatcagcatcttgtgaaagtcccccaggccattccagcttgcagctgaggatgagaactactgctccatacaatacagcccatctcttaaggtgcatgaccaaccctgtttgatgaagatgaggcttggttcattcttggtctcacggttgggaacacgtttctttgcaacacattcttttaaatcaagttcccttacaatacaaagtggggatattaccctttggaattcattttatgtggaatgcattatatagaacggttacctgtaataactccatgttgagtcatgaatatggaagctttgtcaagttaaaggagtcgagcacatttaaggcatccttaagtactggggcgacaggcagcaccgccgggtcagagggagaggagcaaggttgcaagcgcaccccagcagtgtggccccctcagcagctgagcagatgacctccctcggaagtgacccaccccctctctaaaggaaggagacgggtgcccaacgctccaaacttgtttggagatcaaatggagccgtcggaagccattatcctccgaggtgagctggaaggaatcccactgacaaccctcacttccaggcacaggacaatcagccacggtttggagaaacaagctggagtttcaaaatgacttctgcaggtctcccgcctcctttcatttttctttttcaaaacatttgactattcacatgcctggcatcttccctggacggccgcctgggctttcggggttttgctgtcagcaggtggagagcatccctgcggctgttaccatgcgttccttctttctccttgacattcttcaggatgattaatgatctcacaaatcagggatattatgagggtggagaacgggttaggagatacttgaacaacttgggctaatggaacgcagaggtgttagagctgagacaaacttggaggtccctttgagtcaactctcttctttcacagatgaggaagaaacaagaaactaaggttttgggccagcaggtgtccttgcccaggctaagtgctagttagtaccagttagtgctagttagtgccaggcctcctctccacataactccgctgcatcatggttagatccagggacctaacctacttcgaagtatgcaaagtattatttgcaaagcttttctatttttctcttcagaaaatagattccaatgaaatttttgggaaaaaaaaatctactttttagtgatggatcattacggaaagccgaaacagtataagatgtaaaacaatgattagttttaaagctgacttttaaggaacacaaggaaacaaaaatgtttctattcttctatgtttatatggctttttttttttttttttttttttggacagggtcttgctctgtcacccaggctggagtgcagtggcacaatcacagctcactgaagccttgagatcttgggcttaagcaatcctcccacctcagcctcccaagtagctgggaatacaggtgtgcgccaccatacccagttaatttttgactttttaaatttttcgtagagatggggtcttaacatgttgcctaagtctcgaactcctgggctcaagcaatcttcccacctctgccccctaaagtgctgggattacaggtgtgactaccacatccagccacatggctcattttcatagcataaaaataattttagctactcaagcacattgttccaaaatattttaaaaataactttacattacaaaaaaattagagatatttcatttctgttgaaaacttgcagtaacagagtatagggaagaagacaacagctagccccaatcctgtaagtcagcccttcactttggcatgtttgcttctggcacaatgtccatctcatgtgtgtacacacaaatacacacacctcactactgctcaagtcactcttaaatttaacaataccatgattattctgtacacagagttttatgtccagcctattccacataaccatggatcaggagccgtttctcaaggacactgtggactggattataaacagccgtggatacttgcattagggagagtgaagtcatcgagatggagcgttctgcactttagctaagaggccaaggtcagccctgagggagtccaggcttagcgacaacttaaacagggtgcagcttcccgctcctccattccactgtattcctacagagcagagcaggcaggcacagattccagctgcattcccactttgcctccctttccttcagtggcgggggagggtgaggccaactttgaagggaaagaaggaaccgttacgcttgaaggagaaaaggagctcttccgggtcactcctggtgccctggagaggtgaacatggaaccgcctgatggacagtaggacagtgtgtggccaaggacaggctggagagcttcccgcatccacttgcctttgtcttaaaccacaggaagatgcctcatctgtgtttgagagcaaatctcaatgcctcgaggatgaaagagtgggttttaggaaaggaacgtattatctagcagctgttcattttaagaataacagctttttggagatataattcacattccatatgatttgcccatttaaagtgtacaattcaatggtttttaggatattcacagagttgtgtaccatcggtgggttttaaagattttaatcacccaaaagcagctccagacctgtctgcactcagttcccacctctctcaccccccagcctaggaaaccactcatctacttcctgtctctagggtctgcctctcctggacggtcatatgagtagaatcttaacccgtgcggcttggtgcctggctgttcccgctaagtacactcttcccaggcttcacccatgttggagtgggcaccagtactttattcctttctattgcccaatatcattccgttgaatagatagacactttatttttccatttcccagatagtggacatttgagctctttcccttttttggctactgtgaattggctggtgctgccatgaacattcctgtgctagtttctgtgtagacagctgtgttcatttctcttggtgaaccgcctaggagtggaccagtgaggtcgcatggtaatctctggtcaacctttcgagaaactgcaagaacagttcactgtgttggcattcagatgatcctgcactaacaaatgtctaatttaacttcctattttgaagagatagctgtaactgaagagacatagaccaatggaacagaacagagccctcagaaataataccacacatctacaaccatctgatctttgacaaacctgacaaaaacaagaaatggggaaaggattccctatttaataaatggtgctgggaaaactggctagccatatatagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattaacaaatgggatctaattaaactaaagagcttccacacagcaaaagaaactaccatcagagtcaacaggcaacctacagaatgggagaaaagttttgcaatctccccatctgacaaagggctaatatccagaatctacaaagaacttaaacaaatttacaagaaaaaaatcaaacaaccccatcaaaaagtgggcaaaggatatgaacagacacctctcaaaagaatacatttatgcagccaaaagacacatgaaaaaatgctcatcatcactggccatcagagaaatgcaaatcaaaaccacaatgagataccatctcacagcagttagaatggtgatcattaaaaagtcaggaaacaacaggtgctggagaggatgtggagaaataggaacacttttacactgttggtgggactgtaaactagtttaaccattgtggaagacagtgtggcgattcctcaaggatctagaactagaaataccatttgacccagccatcccattactgggtatatacccaaaggattataaatcatgctgctataaagacacatgcacatgcatgtttattgtggcactattcaccatagcaaagacttggaaccaacccaaatgtccatcaatgatagactggattaagaaaatgtggcacatatacaccatggaatactatgcagccataaaaaaggatgagttcatatggtttgtagggacatggatgaagctggaagccatcattctgagcaaactattgcaaggacagaaaaccaaacaccacatgttttcactcataggtgggaattgaacaacgagaacccttggacacaggatggggaacatcacacactggggcctgtggtggggtggagggatgggggagggatagcattaggagatgtacctaatgtaaatgatgagttactgggtgcagcacaccagcatggcacatgtatacatatgtaacaaacctgcacgttgtgcacgtgtaccctagcacttaaagcattaaaaaaaaaagttcactctaaaaagcatgggttaaattacgttacaattgataacactgaactaaaaacttgagtgcctacaataaactagaatgtctcacctaagacttttgtgtacgtaagaattactgggacatcttgtttgaaaagtcatatatctaggccttgtttctacaagatgatgattcagtagatcaggagtggggccaggatctgtgtttgtaacagtcctctccccgcccccaaacacacagacaattctaatcaggtctaaccaaagtggtcaacttctgcattttcttaccattggttgtactgataaatgtcaaccagatttctctcccctatagaattttcaccagaagtcccacggaccttctaactcacttggaagagctcttttcctcctttgtatacttaagtggtttaaagtctgtacatatttggtctatgcattttttgtccttcttgttggtgacaggtccttcccaacatatatctcatttcctcagctagaaggcaagtgacctgaaggcagagaatgatatatttgtactgctcccctgcctgtagttgctggggacactgttgcaagacctaaaaattcaagtgccgccttcacatctcagagcctcatggggccccaaggcctctgcatgagctccctgctctgccaagtgtgcccccctcccagagagaaagtctccctaccctgcaggtttccccataagctggaccagctgcccccatccagcacccaccctaaaaggcttcagttccctgccagcccacagaatcattccaacaagccagccacaccttctgcaggaaccaggggccacgtgaccctcccgttcctaggaagcctgcctctcaccgtctcggcacctaagtgctgcccccgtgacgccctgtgtggcacggggtgccctcctccccagggggtcagtttatgtaactaataagctgctgtcagttcatctgtccagtgcccggcgctgtgtgttcaatcgcctaatgctgtttagggcagggggaagttccctctctcaccaacacagtgaataggaggtgatcagaacagatacggtaggtgcccagctagtgacgggcttaaagactgtgagcctggaacggagattttggatcacattctgactctaacgctgcactaggggctcatccctcacttgcaggatgggcgtgcagaggagctgggcagaaatcggtatttctaatgcccagtcactgggtcaacaaaggaaaacaacccaacccaaccatgagtcacgttgtatttaaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctcttctctgacaattgtggaaactctgcagggatattttaaatattcatggaaatgtttatactgtttattatcaatcagagagtaatgtgctcatttagagacattttcagaaatcgtgaacattaaatggaatgaatatttcctcaaataacggagtagaaattgcagttacctgtctctgaagcagccggcccttccgaagctcttaccttttagggtggctttcttaaggaccttcatggcgtagagctgcccagcgtcggaccccttcaccttcctcaccaggaacaccttagcaagagaaaacggaacatcagaaacccgtaagacttcaaactcgctttccatattggatttgacaaggggatacacaaggaagtttagagcattttcaataaaacaagtacactggtgagaatttaaaattttctccaacgtcaaggctgccggaaaatgctctaagttcctatagctctgcggcgaacatcactatgtgcctgtatgaagaagcgtcatttgtttttggtatcattaactttgcattttatgccagaaataataccgccccttgttttgaagaccagctgtttagaaaaacaaacaggagttttaagggagatcctttggtttgagtatccctctgtaaatccttactgagagaccacgctgaaaggtattaccaatcacacaaaacaggctctatccgattttcaagaaaagctactttctcttacttcaactgtcttcacccaaattttagctgtgagtagcttaagagttcctttctaactggatcttaaatacacttacggatatttggcaatgctttctgaaatacattttgatgtgtatcactgagaaaaacaacaaaaaaaggtaattgagagcttgagtttaaatttgtattagtgattttttaacaaacttagtaaacaaaactggagttcctttgtataaaaaaaaaaacttccatgcaaattaagaaaatagtacttgattttcctaaaagtgttttccaatagatgcaaatatctgcttgcatgatggagatgacacaggcacacggtgcactggtgtggctgcccatgcagtatggctggagggccgaggtagggtggctccttcccaaaacgtctcctttactaagcctcaaaaagccagaaagaccagccactatagatgttctagttccatggaaactccaggtggcccaagtgagcatccgtgtggagcagcagcctcacctgccatgggcagagggacatggctgggacctttgcactcttggctcccccccaagactggaggggcaacgtctagacacttaccgagtgcaggggctctaggagcaggggctgctagggcagcccaactggagggagaccaaccagcgtctattctagaggcacaaataaagagggaccgggaagacgcaaggtcccagcacaggcatgtggattcacggagttgctgtatcagtgtcacgctctcaccatgtgcccctgaagtgattccggaccccactgctgccctgccatctgtcccgatcactgtcattattgaatcacagcccctccccaggtggggactcttctagatgacgcccatgggaaagcaccccagcacccctacccggggtgcaggacggtacagcatcatcctgtgtgatgaaatgctgcctctcggacccgattaggtcccaagaagtcacaggcaattagaaagaggcttccctcttcccctgggttatagactataccatcaccgacagttaatattcatctctgggagatgtgtggagtgtgagagagagagagagagagtgtgtgtgtgtgtgtgtgtgtccccaaagctggataaacaagcttgtggtgaagccctggggcgatagctggggcatcacccttacgcacactgtggtgggagacacaggcacaagcccttctccgggctcaggatcccatggctcttgctggcagacccactgtagccctggaagttactgcacatggaaggactctgcctcagggtgttccctctgtgcagtgggcgagcttcctgacaggcaggtagagatgtgaaggcagtggtctgaggacaggatttttacagagagaaaaacattagtgcttaactcttgagatcttctgctttgaatcacgggaaagtcacatgccatgcacagttttagcttccatctgatgcaactcctttcatttctccagcccgtccgtgtgcctaatgtccctaggttgacttgatgagtggtgctgtggagatcaggaccagccaggacagtgcagggaggaggcaggcgcagcccaggagtccaggagctgggcaaggctgcgtgagcgtcccggtgccggagaggccgcactggcagagaggaacctgggtcccaaaaaagtcggagggggtgtggaacaagggacagttgtgtttgtggcagggacgccacatttccccggcatcctgcaggtaagttgggcagtgacaccagcaagggcaggggtgtgccttcctggcctaggcaatgaagagcaggtgcaaaacgttccagctgccactccctgctgtggcaactgaggacacctggtgcaggacaaaccgggcagcctggtcactgagtcactgtgtggaggatggaagccttgggtggttgctccagcccatggtggactttggtagggtgacagatgaatctatccattccattgcggcgaagctgacatgttagctcccaaaataaggcattcttataatcagaaaacaaagggccaggttcagtggctcacacctgtaatccagcacattgggaggctgagacagaaggatctcttgaggccaagaatttgcaaccagcctgggcagcatagcaaaaccccaggtctagtaaaaataaaaataaaaattagggctgggtgcggtggctcacgcctgtaatcccagcactttgggaggccgaggcgggcggatcacgaggtcaggagattgagaccattctggttaacatggtgaaactccgtctctactaaaaatacaaaaaattagccaggcgctgtggcaggcgcctgtagtctcagctactcgagaggctgaggcaggagaatggtgtgaacccgggaggcggagcttgcagtgagccgagattcagccactgcagtccggcctgggcgaaacagcgagactctgtctcaaaaaaaaaaaaaaaaaaaaaaaaagaaagaaaaaacaaaaattagttgagtgtggtggttggtggtgcgtgcctgtaggcccagctatccgggaggctgaggcaggaggatcgcttgagcccaggagtttgcaaacaacaagctccctctttcaaaatgggaggaccctgaagaaaaaggaagcaaggtacatgacggatttgtgtttggacggtgcagccttcacaatatcctgagtgggtccgtactttcaatacctctgcactcaacccctaacccataagaagtacgaccgtataaactcaaagagcagaggaagccccattccactcaagtctgaactggagaccaagtccacatggggcagctgccagttaagatttggtttaaatgatgtcaagttttgcataggtcttgacacatgaaacttttctctctcgtatgttaggccttaaagatgagatgactgatggtcgtggctaatgttcatacttatctgttttgaagagagaaccatacttttgctttttaaaagaatggaaaaaactccatcctaccaatgtctgccaagcttctctgtggggccaggtactgcgaattcctgcagcaggtgctgcctgactcgcaagcacaggacccagtggaggggaacggcaccttgagacgagcagcaaaatacagcaaaaatgcaaaaatgattttggtaacgagtgtggcaacttgctggtctgcgacagggatcttgacccttgggtgccgtgcagttccctctccctctctgctgtcattcttgtcactgaagatcaattttaatgtagtggaataagctccaaaacaacactgtaacctcgagctaacgcaggcactgtgtctttaatactcaacccagtgggcgctgtgtgtgccccctcatttcatttttagaactgcctctccagcagcttggcgtgctgcattgcaaagatgctgtgagaaccgcgacctggcaacaggtgcgatgtcactctgaactgcctcatgatgtcatggatcaccgtgatctgctgattctctcagcagaattctcagctctctctcagaactggagggtttctattgggctgcaaaatccttcaagcaggagctaaatgcccatgtgcacttccagggacttttgagtaacagccacccccaaaaggaagacatttaaagacatgttcttatcatgctaccagcaaagtcagagaaagcaaggatttttaaaaaactttggtttggttcctttttcgaatgcaggaatcataacctacagttcattctccagaatattttaaaggaaaagaggtttcctatcctactcctggcacttatgcgaataggggagctccaggagcaggtgaggaggtgggaccagggcaaagccactttcccagccccggggtggttcccacacctccctcctctaagctcgcagggaacactgggtctgcacccctcctttcaacactgaacaagcttcaccatctttcattgctttcctgattcaagctttaaattgcttttcattttgaggataaggctgttttctgtgcttttctctggtcccaagcaccacccatggccctgctctctagatagcgatgaaatcatgatggcttcgccttgcaggactgagctcagagctcatagacgcttcccgctggtggtgagtgcagcttctcccacaggaacaagcttattccggctgaccaggtgaagagcagcggcttcggagagcctaagcggctcacacaggcaggcaatgggacaagtcactcggatggctcctggtgcagtctgaggtcaggagctggcaccagtgcaaaaagtctaaagggaagaaactgcatgtcatccatttctgcatctccaatgtcatcattaaataagagagaaagaatggagtggctcagtgacaggcaactatgagccctgttgaaggactcggctcccaggcaaggcctgtcccgggacactgcgtccagattcacaccaggtctttgctctttggagcggaggcaggaggtggaaacctgaagaacaggtgctttctgcagaatgagaacattcagtgttgtccttctgtccctggtaggtgcaaaagggaagatgactcttgcataaggttgtgttatttgcatgtagagaggaggaatacagtaacgtggggcattagaacacacggcttctccccctcgtcatcagttttgcttaaattaaaaaaactcaccacaaacaaacctatgtggacaaatacaatttgtatctgtgactctctagtgacgatattagctccaaccttccctggaaatgtctgagcaacgcttttgagaatagtatctcttctttccagagtccagctcgcattaatccacgaagcggacctaagcctcccttcccacgccagccccagcctggacctcctgccccgcccctcacaccagctctggacaggcattactggagctggcccattccgtaatccctggaggtcagacacccatgggcgctgccactgcctcatccttctctttcccctacctactactgttcttgaaactttacgttttaattcctcatataataaagacacaagtaaagataaaattagaagtggtgaaaggctgggaaggaaagggacagagtgttatgagcattatcattccaacgggattctgccaaacaccatgatttcacttgttttccaaaacatgtttttttaaagcaaaattaaaattcaaaatttgaaatctgaacgagggagctggaaaagcctttctcctttcatctttaataccccagttctgtgaggaggacattggtaagattcactctgtaacagaattggtcaaccaaagccctccagacacttcctgggcctccgccatgggatgtattccagcgctccttccctccagataaagacgattcggctgattctgtgcttccacaggtggaatctgttctcaagaaacaatgcatgggcaacacccttgaaaggtggaaaaaggaaagaatgcttgcttgtctctgttttcaaatcatggagaaaattattctcctctctcttttttctctacatttctaattaatagtgaggcattccactgtcacattacgcaggctctgccttctgtgattttgtgctttttggtaatggctattaacatcgtgagaaactgaaatcttcatccccctatttcataaacaccatatcaactagccatattaaatagacatttttgtaggcccaaaatattgctggtaatttcctatggtttaatctaacgtataaaaattttacaaacaatccagttcatgcggactgtaggattatccagaacaccgatgtactattcattccatccagttcatgcggactgtaggattatccagaacactaatgtactattcattctacacttaaattaacagcagccacatgcattttggcacaaagtcatgtgaagaatgcaaagatttggtaaatgtctacataccacacaaaaatagttactttaaagagccaggctgttctgcttacatgtaaggaacggttggcttcatggtttatttcaggcccttatgttctagaaatcaagttgtcagagcctatatatttctaacagctaacccaaggaggcagagaaatcagcattgtgctggagtaagtcacgtgtcatcataattgaaaagcgttattgacatcttgttgtatgtggacgtggcattaaatgaagagccaactatttctcatttcctgaaagaaattagcttttattgctgcaatttgaaggtgacaaaaaagggaaatgaacaattccactgcacaaatacatcttaggcacctgctgggtgggattcgtgccctatttactccatggaacaactgtataaagtaggttttatcctttccatttagtgggtggggaagctgaggcttcatgaggcaatcgtgcagggtgaggaggggagccggctgcagaccctagccttcctggctcctgtgcccaatccagaggaatggattcttttcttttctttattctttttttccttgttctcttatttttttctttctttggggaaaacagctgctagaatgcactttcaaagatacattggctcaggtcaataaccttcctcaccttggtgatgatttaccaagagccaagggaggctctagagagaaggcaaaagtgcatgtgacggctccaacggcattttgttctcacctggcacagcccagccctgtgccactggaattctggctgtgcaaagtgagaccccggttctgaactgtccaggttcccgtgatcgcagccctgcaggtgaggaccgcctgcaattttcatccaggggggctctgtccaggtgtcctttgtgttcaggaatgagactcaagagacagccagggctgaacttacctttccataggatccttgtcctaaaaccttcagcagctcaaactgggaaggatctgccttctcaaagccctccttcacatgatggctgatgtctatctccttcacgacgccttcttcctgcaagagagcggcacgggtgagaaacacaccgcgaggagtccctcagagccgctcacagcttcctcctcccctgagtttaccacgagctgggtctgttacagattttagcgctggagtttgaaagtggagacaccatttagttgtgtttttttcttttttttttcttaagacggagtctcactctgtctcccaggctggagtgcagtggctggatctcggctcactgcaacctccacctcccaggttcaagtgattctcttgcctcagcctcctgccaccatgcccacctaatttttgtatttttgtatttttaatagagacgagatttcaccatgttggccaggatggtctcgatctcctgacctcgcgatccacctgcctcggcctcccaaagtgctggggttacaggcgtgagccaccccgcccggcccatttagttttatggaatcaacttggtgatgtgtgtggttattgtgtgcaccctgtgggccttcatggtttcttttctccatggacttttgtcatttggtcttaccaaggcctccgaaaaatctaagggtactctcaatgaaatccattctgctctttaacagtctgggcagaagttctggtacgatgaatatagcaactatggaacaaaatgacagcaaaagcatattgacgggttcctagatggagaagtggtctggaaaatgcagacggcttgtcctccttctccttctgattcacgctatccctggtatgtttgtcaaagctaatgtaaagaacacgtcattgccatcctatagattatatttcagaagaagcagtcaggtaagatttgccaccagcccagaaagcaagatttccctgtaggagaaagagtctataagtgaaaacactgacagaaaacactacaaattttcatcccagagcttcctgtccccagagtcacatgacttcccttgtaaaggggtaggccatctgcccaagtgccaggccctggaaatggaacactggaaaggaggtgtttctcccaacatgagacattcgagcccaactgttccttgaatttatctctgcatttctctgagatttctgttccactatctatacattcgtacacccctttctacagttttagctcggggtgaggggctgaaaaacttcagaaactgctggctaaaatgcgcatccaaaaacagcaaccaggaattgtatgcatagtgtgctctgggaaccaggggcctctcattcctcattgcttcttttcatgaagaaactgtgaagtggagattttctcctgagactcagattacacattaatagctggaagtgatagaggtgggcttctcatcaaggactgacttcgaagccaagtacttccaccctctgttttactctaagagtgaagacttccaaatgaaatcacaatagcaataacgtacatgacgatgtttgaaaaattcagtttctcaaaacggttacttataaatcttgctattttacctccatgtcacaaatagaggcacatgtaaaagcagataaggtgtctgagccgtggaaactcacagcggattagaggcctatgcagttatccatggcttttccattctcagttaaaggaaacactttcgtctccatatcttcaaggatgatttgctatttttgtaaaaacagtggtttttttttgtttgtttgggaaaacaatgagtatagccaaaattgactctgtttaatccatcctgaagttcatatgagtgcagttggaagatacagaattacaattttgttgcttcataattacttcttgaatgagtaagtaaaaatgctagaggcacagcccagccaatgggcattatatttagatgctaatttgtgaggggacatcacattttaagcccttcctcccttcacagcacaggcttactagaattgcaggaccatgctagccacccgagactgtgcagcttttgtggtgaaatctcctggtttatggaaagggacagaaaaaaatgaggccctcagggatccacgtgtgtcactgcctgtgagaaccactaccttccacgcggctgctggaggtggcttcctgcacaaaaaacaaaggcaggagcccaagttcaaaaaaattcatcatggaaacatgtatgctatcttttcccgtcattgacctacgaaaggaagaaagaaattgcagacgatttgtcatttaaagaacaacaaaatactcctcttctgttactaaaacactgtcctcgcaatgggtccattaacatcctctacctacaggactagcacgcgcatgagtcatccaaaccccagcctccctcccaaaatagctcccatcatgcagctgtgttaatgcgacgcccacactatgaaaaaaggaatcaccaccaaagcacacccttctgtgacttcattttggtaacgagagcatggcaacggccacactgcagaacagaaagtaaaattcaacaccgcccagaggtgtggggcaggcgaggcacgagctggccagggaggcttcacactgcagccaccaccctttcctggggcacgtttcccagcccttgtgtatgtttcctaaagatttccagttccttcctttttcttcagcagctctttgtggagggtctgagacccacagctgtggtgaatgagctcatgcagtcccatgggtcctggtccccttcactgcctttgtgggacatgcctttgtgggactaggctctgaagcgagagtgacagcatccgggctacttggatgccacctggccatggacgctggcacctcagaattcccatgggtgttcccctgctcccagtcagcccgttttttaggctggcttcacgccttcctcagcacttccaaattgccatcccctgttgcctcccgcctccccggtccatgccacacccccacctccgttgcagaagttcaccttctttagtcatttctgtaacgtttcgaatcaaagccttcgacgcagatatctcataacatttcaaattttgtgcagattctttctgtcaaagtattgagagcaaatgtacctgaagtacacacataatttcatctcctaaaatgacatgaaaaacgccagctttcttccctaataatattgcgatagagttcacttctcatttcaaatcagtaaggtttttaaccgcaaagcatctgaggcgtcaatggaaaaaaatccccaagagcatcacctttcagacttcagagttctgccttcacagtgacattttagcttgaacttgctggaggatgcttaactttctttttcactttccccaaaacgaaaacaaaacaaaacaaacaaagatctggtgttccatggactcggcgcgcactctggggtctgtgtgaataggaaacagccagatgaagccccagcaccatactcccgggcactgctgataacgaccctctctggacagccctggtttctggatcccttcatgacaaccaccctaaggggcaactagcatgaaaatgttactcacatttcattttgaaatatgtgccttttctgttttatgaagcaggtaattttatctagagcttgatgaggatttgcatgcaatgccttaggaagatcaagtctgttcctgaatcggctgcatccatggcaggagcatgtggtttccagcacagctactgtaaacagtatttttaaagctaacttgagagctttgggaggaggagctgggacggtgatcaggtgctagctccataagcaacaattccaaacattttgtaacgtaagaaagaaaaactagaggtataaactgtttaaatgatgtttgaatgtgacaaattgtgacaaggaatttttaaaattcctgcagaactgcactcaaaattccaatgactgcaggaagtcccgggcaggtatttcagcagctgctgggagcggctgggaagtgggagtgacagggagaaagatgagggcggttggccactggctctgcatgcctctctctgggccaaagtcgccttcttaggtcatttcctctgctctgaatcacctgctcttcatgtcattaaagggataatatttataaaaagtgcaaattaaaagttgtggaatattaatgataaggacataggaaacaaaataggcaagggttcacctcatttccaaaaaaggagagaggtcattctataaatcgcagattcacatgtaggatattaatttccagaataataacagaatatattattacacaggtggtttatgaaaatgtggaaaagaacgtatctccaactcacaggtcccatcaagccagcactgttctgctgctgacggcatgaactcatgagcaggtggacaagagcctggctttgagggcagctttggtggagtccctcctgaatcccaggtgacaaagaggctggcatcatataaacgcttaatgacagagtaccacatcgcaagtcattctctcaaggcacagaacccggacacacctgcccaggaacagtatcgtgtcctggaggttctgaacgtatgaatgttctatgttgcccacctgcttcagaatcaccccaaggaacttgttaaaatgcagattccaggccctgggcaaggccttcttggtctggaatctctaaacttggcttcgtctagaatctgactttcattatctcaccaaaggtgcccttctcaagccatccaaatcttacccattgctaaatcgagtggctaaatttccatcctccatagcactgggcatggctattcactccctctcacttgaaacactctcttcacctggattccagtacatcctactcccctgggttcgctcccacctccccctctttctgtgtctgccaaggtcacctttcccctgggcacagtccctggccttttgtctccatgtagttacccccttggaacctcgtcctgtctccgggctttataaaccatgtgaataaacactgacaactctcaaatctcaatctccagcaggggctgctcccagaggtccagttctagaggcccatccatcacaggcaactgtcctgagtgtgtgcacgtgtgtgtgcgcatgtgtacatgtggaatgcacatacgtgagtgtgtgtgagacaggtcttgttctggctttttctcacattgggatggagctccttaaagtcccagctttatgcaggaagtggggcaagaggtctgcctggggccagccctgggatttgtcaccagttcccctgccctgtgaggctgtaaacagccaagctcaaattcaccaggttgtcacctggcctccaggagaaagctggctttaactgtctccttccttgggttccctgctctaacacagggtttggcctctgcgtattccttactccccagctcactcacacttttaaacattcttaaagggatacttgatccaggactttcggttgtatttcacatgagggctagccacatgtagtctaccacgccgctagaatggaagctcaggaatgcttttaaagggagagaagattcactaaatggctttttagcctcttccggaaaagaaagacagccgcagacttgctgagaagagtagaggggagtctgtgcaggaacagcccccggagagcgagctccatctgcggcacgactcctgatagctcgtgggtcctcggcctttggttaccaggaaagctggctgcaccagtgaacacatgccacccatgacaaaaatcctccagtaggccgtttttgtaattactaaaacgaaataaaaataactagacatttgaaccaaagactcttaagaaccagaaggaacctcccatgtagcaggttgggcatcttactattcaagggacgagaattcagatcatctgaggcccaggacccatgctcctggcaaagctgcttccattccaaccagggcctaggacgtttagagtggtaacggctcgcgaactctggggccttctctgccctttaaactgccctttctgcatctccgcaaatgtgtctgcttttgctggtgtgagcaaatgtgaaatgaaatgatgggaccagctgcatttgtccaatcaattccttaggaaaccatttctacaacaagtttcccttccatttctaaaaagctaaatataagtgagccatttagtacagcagaacgagtaccctcaagaatggaaatcaggctggtgacatgggcgcttgctggaatctaggtgaaacaaagatggcttaatttaagatgaataaatctgctacaaaatcataggaggaagggaagcaggagaaggaaagagaaaggaaaataccgggtgccatgtcaagatcgcagatagaagctctgaaatttcaggagtgtgagcctatctacttgatagagggctgctcagcgagacaaggtctccatttcaaccctggtcattttcagagtttgaactgcatctattcgatacaatgctcaaatggatgccgcagaatccgcggagggaaagcaatgtgcaggaacagggctgggctctgttttctcatccatcctagaatatcactttttctttttctgaccaatgaaagtgatttagcttccaagagtggtcactgcagtcaccgcatgcacagtgacaatctaggagtgggctggctgctcgggctcctttcctctttggggagaagtctccgttaagctactcactgaagctcctcggaactgaggctgggctaatgtaaggttcctagaacacagcagcactgagtggacagagactatgggaagaaaggaggagaagcagcaaaaccagccttggcatttctctccttttttttctctttctatccaaacttgcctttctgcctccccaccccgtccctgttcattttagtgactgaggagagaggaacctcccaaggatgtttcctctctggttttaattaagccctgccacttcgccactgtttctgccttcgccttcattgcctgttgttcccgtggattattttctcttcccttcttctcagccctcagtctgctggtatttttataaatcacagtcaaggcaaattggactctgaaagttgtgcttataaacggtgactgacagatggagcgccgccacttttgcaggggcctccttcccacagaaaagacgtgcaaagagtggagagccagggcttcctgcacacacatgggctcccagtcctgacatcggccattctgtcggtgtgctcattctgataaatcctccaatccttaacctccctgggaaacgtcagtgtgaagtcctcacggaagcctggggtgttggtgtctgacacggtgttttaggtatggctccgtgaccccttccacttcatcttgaaaattatcttcaatgatttgctttataaagactcattactagcatcggggaatgagacggtagctactgactgacatgagtgtattaagatgcacaggaacgatctccgagaagcctcacactcggggcaggtggaacacgaatgcagattaggtcaagccacagtgtttcctcgtggaacagctttagatgggaccatttccggtctgggcagtgggatgagtgcccaaaggggctgaatacatctgtattatttagcacaactttaaaataacgccaggtaaaaacccggtgacagtgataccaggacgcatgcctggtgtgcacccaatgggacattatttatgctagtgtgtcaccctgactgggaaaactttttttttttttttgtctctgagatatatagtatgaaactgcactaagagatgagagaaaactgataacacgggatttaaaatcacaagtggaaaaacctacatcatcataaactacatcatcagtataaccaagaaaactacagtcatatcccagtgagacctattgggataaatttcctatttctttagcagaaaagggaaaatagaaattctacaactatcatcttctcccagactcaattatcgatgtgtccaatgtgatctcctcattctttttcaaaagcaacatattggtgaatgtttggtcaatacctctaccagaataagttgatggctgcgatgtttccattaagaagaataaaaaatgctgagtcaactaggatgtaaagaaaacgcacatcccaagagtgcccagctgttgggaacgctgagctggtgggctcttctcacacaaagttagtttcttttcttttttttctttgagacagggtcttactttgtcacccagactggagtgcagtggcatgatcttggctcactgcagcctcgacctcctgggctcaagcgatccttccacctcagccctgcaagtagacaaaattagtttctatttcaagtgtactgagcaaaatcgcaaggctatattgatcagaccgttcagatacccagcagagggacgcttgctggggtaagagaggccggtgacgtgcgtcctcctctccagcagctgaaatgggagtgtgcacggggccaactcactctacaatgctgcaacaccaccgacttagaggaaggaaggcagtttgggctctgcaaggaaaggctgcttaagtaatggatttttaaaaaatggtccaccaaatccatggcaatcagtatcacagctgatggggtgatggggaaagtctcatccccaaaatggttctgaaaggtcggcagctgagttggcagctgagtgcccgctctccggcagtggtgctggtgcccaactggtcatgcacggtgtttgtgatctggatgagagctggcagagcaaaactgttaggctgcagatcaggatgaattattcaaattgataacatcttagcaaatggagaggatgtgctagaagatcagaagaggccattccggcaggcagagtgatggcggcagccgcttaacccatggcacgtgtgcagcacgaggtcatgttttcaaaaaaacagtaattgtgccttatatggaactttatattaattgtgatagagagtagtcagctgcaatgcaggaaaggatggaaagagtaactgagtccgtgttttagaaaaagaaataccactgtgagtggaaacgcacctgccctatggggcagactggcgggccctgaacagaaagcctgcttctattctgtacaaattccatggtcgaccaataggcataacgtgcacaccttctgacccagggacctcactcctcagaattcatcaaaaacatttacacatagaaagctgtaacattatttataacagtgaagaaataagaaacaattgaaacgtccagcaagtggggaagaataaggaaaatgatgatctatccaccaaatgaaagtttacgtaggctttcagagtgattgcgctttttcccattactccaaaaagatgaaatacttacatataaagtaacaaaacaagtatagtatctgtgtgtcaaaaattacggaacatattattggaagaaatcaaagatctaaataaatggagagacatgtcatgttgacagctcagaagagccaacatggtaaagatgttaagtgttcacaaatgcacctgtaggtataatctcccatcaaaatctgagcaagcatttttttaagtatagagaagtttattctaaaatttcatggaaaagcaaaagacctgtaatacccaattttgaaaaaacactaaagtgggaggaatcactctacagatggtaaggtttgctacatagctacagtaatcaagatggtgtgctattggtgaaggggtagacacacagatcaatggaatggaatagaggacccaggaatagaagcattcaaatacacccagctgcttttggaaaagcaattcaatagaggaaaggcagcctttttgacgaatgatgctggagcactggactttcataggcaaagaaaaaaagacatttaacctaaattccatctcttatacaataattaactgaaaatggatcacagacataaatataaaacataaactacaaaacttctagaagaaaacataggggaaaattgtccaaacttagggctagggaaaaattcttagacatgacacccaaaccatgattcatcaaagaaaaaagtgataaatcaaacttcatcaaaatttaaagcttttgctttgcaaagactctgtgaaggagatgaaaagacaagctatagagtgggagaaaatgtttaaaccacacatccaacaaaggttctgcatccataatgtataaggaattctccaaagtcaatagtaaaacaaaacaatccattagaaaatgggggagacaagcagatatttcaccactgaagatacacagatgacaaataagcacatgagaatatactcaatatcattagtcatcagagaagtggagagccgcaataaagtatcagtacatacccatcagaattgctaaaataaaaaaatagtgataaacatcaaacatcggtgaggatgcagagaaactggaccttgtacgttgctggtgtaaatataaaatgttccagccattgtagaaaacagtctggccagtgtcttacaaaacaaaacatcccagcaaacgtattccagggcatttatctcagagaaatgaaaactaagctcacacaaaaacctgtactcaaatgttcatagcagctttatttgtgatgcaaaaactcgaacagcccaaatggtcttcaatgaatgaatggttcaacaagctgcagtacatcacatcatggaatactatacacaaatgcaaaggaacaaactactgttagtcacaagttgtatggatctccagaaaattacgctcagtgaaaaaaagcaaatctcaaaggattatacaatgtatgattccatttacatattttttgaaatgcaaaattatagaggtgaacagtttagtggttgccagaggtgagggatggttggtgttgggggggtgtgtgtgtccataaaagggtaccatgggggatatctgtggcgatgggacagttctgtatcttcatcaggatggtattgccacagattacacatgtgatatatttgcagagaactcatatacacacacacgagtacacgtaaaactggtaaaatacgaataaggtctgttgattgtaccaaatgtgaaattcctcgttttcatactgccctgtggttgtacaaggtggagcccggctgaagcacaaaggacctctgccacgtgttttgcagcttcctgtgactctataatcatttaaaaattttaaaaatggtaaaaagtgatttttaagtctatttgccaatattgaaagagctttgttataagatttaaagaaagcagaaaaataaacgtcatgtatatgatgattaccgtgacatttttacaaggtaggaaaaatatttatggaaaatacgtcaagatattagaagtgatagtattagaaaatataaatgattaattttctcccctttgttttctgaatttcctatacagaaatagaaaactggccaagtttctatacaaggacatttaaaatgataaactatgcgacattccctctgtttactcactgctatcctattcagctgcactgaactataatggaaagttcaggcaaaattaactgtgagttttcaaaagcaaataagatcaaacaacttgctgcaagggaaaaaaaaatggaagccaatggaaaacaatttggatatcatttctggatcaaagaataaacctattaattggtaaaaaaaaagaaggactcaatatttttaaagctattaacattttttatactcaacacacagattcctcccgtgcatgaacatggaatgtccaatcagggtacagatggcgaacatggacgcctgcaatatggacggcaacatgcacttcccagcactgcgggcagtcagggaggcagttcacagattttttcctgggaggtgggtgtctctaggggtgggtggcaacaatttactggaaactgacaaacaaaagaacttgttttaaagtgaaattagggttgggcgcgatggctcacgcctgtaatcccagcactttgggaggccaaggcggtcagatcacaaggtcaggagatcgacaccatcctggctaacacggtgaaaccccgtctctactaaaatacaaaaaattagccaggcgtggtggcgggcgcctgtagtcccagctactcgggaggctgaggcagcggaatcgcttgaacctgggaggcggaggttgcagtgagccgagatcacgacactccagcctggcaacagagccggactctatctcaaaaaaaaaaaaaaaaagaacgtgaaattaggtactactctctgtaacactaattagataactgagttaagtgtgatacatttatttcttttacattaagtagttttctagacataaatatgaagggttcaatttttttttctttcaaagtccttaggattaactcaagcaaaaccagcgaccatctcttttgtaatgtatgtgtgtgttggactgatgctcccctaatctttgaaggaaggttcaatgtgaatggtattctccaatgcataaatgagataattggggcaatggaagagaactacttctgcaatactctctggtcctaactactttttcagtttcctgctaaaagtagatcattccggatctccttgagagaggatttccaatgtggccagtggagtttcagaagacatgtggcatgtggcagcccctgctctgtgtgctatttcctatcctgacgattcttacgaatggaagccctacgaaaaacaatcaacactccagaattaggtttcaatgatgtcagaggtaacgtgcagatcatcatttagcagtttccaaaactgttgaaaagatgaaacttttggacaaaaacctcattcaaaggagttcattaaatagccatccttctttcttttctttttaaactaacctagttattgcattctaaaagattatgaagcattttgttaaaaaaaaaattagatatggtgcaaagtttagaaacggcctcaccagcccaccaggcacctgatcaccctccatccctgagcctgcagaatggtgagagcaagaaggacttggcacagaacaataacttgaatggaattaagctgactgctgaaatgcaaacatgcggtaggctttgccaatatgagctacaaattacggatttccgaacagtcttgggcacagatagggtatttcaagtgaggcgacaaactgaagtcgttgacacagcacaatgcccttgcagaccgccttccgacacagcttaattctatcagcgtttccattgtcattcgcaagcagcacagactgacaggctgaagacccacacctagtggatttcacccgcctagagatccttgttacccagtgctgctccaaagcagctccctgaccccatgaacacttacaggggaactcaggggctgtgcatggattaaatacagtctcaattctcaatttcacaggtctttgaccccccacaggacaggccacattttgtactaatgcctgcttatcccctcctacctcgcaaagcgtctggcaccatccttcctcagtctttgttcaaggaatcgatgaaaacttgtgaaatggtttagagcggtgcttggcggtccccaggaggccctgctcaaatgccaggctgcagaatcacccagtggcatggcctcacccacatgatgacagccaatccctctgtgtggcgaaagatgtgggcttgagaactttctacactccagaagccattactggcacaatatataagtgttcaagatcaaaagaaattgtattataaaagttttttttttaaatctaccctagcttgaggtttggtaaaatgccttggccacatcccccaactgcaggtgtcctgttctgcatctggaccacacgccttgcctgggagagacttcagtgatggaggagacaatcccaaaaggtttctgaagctctcacagtcacatgccaaaaagtccactatttattttagaaaaaaggatttggaaacttggttaggaaacccatgcatcgaggatgctatttccgaattgctaagtaaaaagtttatcatttcctatgcacaaaaacgaccagctctttttcagtggcatagcagggatgggccgataaccacgctggtccctggaggctaatgtgggctgtatcctggcaatggccacaggtgtgcaatggctctctacggattctgcagtctagctttgacattgatctactaggttttagtaacagcttgacatctgaatggtttattatcattagcatatgaacacacacttatataatattgctgaatgtaaaattctcaaggtaggctcaactcaaaccctggaggcagcatgtgtcttagccacttactcatttttggtttttgtttttatttttgaaacagggtctcactctgttgcctgggctggagtgcagtggtgcaaacacccctcgctgcatctttgacctccctgggctcaagagatcccccaccacagcctcccgagtagctggggcaacaggtaagtgacaccatgcccggctaattttctttgtatttttttgtagagatggtggtctcactatgttgcccaggcaggtctcaaactcctgagctcaagcagtctgcccaccacggactcccaaaatgctggggttataggtgtgagccaccatgcccagcctccacttactcatgtttagtcccacttttttttttttttccttaaactccttaatgcaagaaaatgcttgggaaagaaacaggagtcatttaaaaaaaaaaaaaaaggcacccactcgtggtgttcccaagtagcaaactgactgggcagagtgggaaggactcagagacaactcactgacccgccccgccagccctctttctctgctggctctgacgtgggccagtcagccctgactcaatgctcacatattatcacacgtgcggctcatcccattgttagaggataccattgctgagccaaacacagggcactgctttaaacagacttggctaatttctgcacccattacaagctgatacgttaaaaaaagaaagccagcctactatcatctgttttcaaatgtttccaaattgctcttctttctcagaatgacagctttggaacattagcgcaaatccccaccgagatttgcatccgtattcttggatcttattcagaacttagccctgctgaaaaatacacagttaggtcaaagtctgttcatgggaaactagtatgcgtatttcagaaggagctctcacctacaggctaccccgaggcagtggctggaaactgcaccaaaccctgtgtgtgtatctgtctatctgtctgtccaggcaagaacatttggaattttctagtgcagttcttggtgctgccatcactgaagcaactgatgcagttcgtaagttcagctttctgctacttcttcccacagagtgacatatttttcttattagacttagagcttttcaaataatgatgacctgagaagcgactgctacccctttcccagaagtaagagatctgcaaaattttgctcgttcgtgagcattttagcttctgtttcaagtcttaagactaacatattcccagactgtcaggccagttttatgaagctgaatgtgatataaagcttaacctgcctccttttgttgtaaacattggatgcaaagaagaattaaccatggaactagaagctgctggctgaataaaaatcccacgggaatttctgttccctttctattcctcttcccagctccggatgtgcatcctgtgtggggacagagagaaacattcagggacaaaacctaagtcacgaggtctgatgcgatgtgagaactcgcggctggcacgcgggtggccatgggggggtgggggtcccactccagcacaggactccatcctcctccactgcagcctgaaagcagggggcaaaaccaacctgctgtctgaaagggttttgtttttttgtttttttctaagcaaacaagtctgaccttccatccctaggaaaggcctacttatgatgagaattctgatgtcaatgtgaggagacactgcccagaccagcaactccacagcaagtcagaaatacagagattgcccaccgcatgaaaaatgtctccagttttacaaaggtcaattggtaatttacaaaacctgattttgagatgactttaggaaattgttgcttctatactttttctctacagagctagaatactgttcaagcgacagcagaaaacatcagttccctaaacccaatgtaaaaattgatgatttctctagcaatttgggctcaaagacactgcaatagcttgaaccaggaacatacatcctaagcaggtaaatctgttttcttcccaggtacgtggtaggttttacaatgggaaagggactcctccaagtcacggttatttgtgcatctcttcataagtgacaggggtgagaagaattgcacgctggcttctggacaggaatacagttctaagcagcattcatcaggccgcactctggcccacttccttgttgtgaaaagtcacatagctctagacactgaccacctgcacccctattgttctgggctctccgaccttggagccataaagcttttgtttaaggatcacttaagatgtttttcagaccctgaattccagcaaccagtttgaagacccccacagaggaatggcattggtgtagaatatagcttcttcctctccctgtcccacgaagtcaccctgtactcttccacaaatcaacaatctccacgctgcagccactccaaaagccacaatcctgagcccaaattcctcggggaggtggatttgaggttttctcccatcgcctcgttcagggatgctacgattgagcctctttctctgctgcaacccagtatctcggtgtactgactcctgtgtgcatcgggcaaagaacctattacgcttacatttcccagtcacctttcatgtttgaggtttcatcattctgaaaggtgacacagaatcatcatggaacaagagcatccttctccctacccagataggtccttcatctgggcgtcatcagagaggtgggctgctgtcacctcacttataggtaaaaatatactttaggcagactgtggggaaaaggaaggagactagaggatgctgctctaggaaggatggcccagggtggaggtgatggggaatcctagagtgacagttgctaagtggggtatctgggggaaaacagttggggcagtgagctcaggactggagtgaaagggccacggctagaagccctggggtaagaagatgcaatttctgattatttctcctgtaatccaggggttatccatatgcacttatctggagctggtctttggggagcagtgaatagcctgttcctggaccctctttctctcttctgcaaagtcctggatgggcaggaaatcaggtggctctctcctgtgcaagagtccttgttccaggccctacctgttggggttctctgctcgggttcagacagagcctcacccactgggtgcaaattcactcacaccaactcctcagctccacaggcgactgactgtagatgttactacattttcatttttcttggcttgtaagtccctaatgacttttccccctactacctgacatgttagaaatggtcattcccatagccactgaaagatacccatgttaatctccacctctgagtcaactggccttgtaagcacactaacccttcatcacagaagaaagtgaattatgtgagtgggttgtggttgggaaccacttactcctgagaagacagcagaatcccaccactaacctataggaatgaagatgaccaagtcatgctggaatagactcaagagtacagaggtgggcaactggcacacccaaaggaacacaggacataatacaaaccttcctttcccaccacaataataaaaccccaaagagaatgtaatgttactgtttctctgtggagcagaatccctctgagtccagctgtctgaatcgggcgtcgttattctaggtaggccacccacagccttccagtaagctccaccagaaacccaaacaaaacacaacaaaaaaaacttgtcagggcagtctttgtaaaagtacaatcccctaatgaacattttctattgtttcacccaggcagatttagaagcccgctagaggctggtatgctgggcgtggactcagtgtgtagctggtgtccagtgttctggccaagtccacgagttctcaggcaagtgccaagaaacctgcatgccagcaaccagaccacggggcattagccggggctgactcatcacatcccgcctcgccaaacacgttttctcttcctgttacccagtgccaagtggctgtgctgaacaagagggcacaaagtagaacatgccctccccctctctgctaagttcctccctgatctacggcaggcagttcccacccagccaacaggcagaggcagctgcagcctgagtgcgcagagggtagctcctgccggggtgaggaccgtgggcgcggagcatgcttcccaagaacagcccgcagggaagacgcccaaaacctaaatcgacataaacacggtcctggccaccacgtcccccacagactcaatggtcaggtggccggggtcactctgaaaatgaactgttctcccactgagctgtgcctcaacccaaattaacctgaagttctgtttacagggattgagagaaatgaatggattgaattatgctaatatcttcccttcccataatcctaattgagtgatatggtctggccttagagtttctctggcacctttgtcaaatgacagaaaaatcagcttttgtgtttttgtgtctgttattaaaaaatgttttaatgaagtattataccacataatagatatatagaaaagtccaggcaacttacagaaataatacagataaattacaagaaagttgttattcccaggcaaatatccagagttcaaaatgaaactcgaaatccttctagtctctatatacagactttcctcactctgtgaaccctcactatcctaatattttccataacaacttgcaaaacattttagccccagttcaccatccaaatagaaagcctgttacaccagtgtatgtcagggttcttcagaaaaacaaaaccagtaggtgatatgtgtgtatgtgtgtgggtgtgggtgtgtatagagatgtatatgtatatacagaggggtgtgtgtgtgtgtgtatatatgtatgtgtatatataggtgtgtatgtatgtgtatatataggtgtgtatgtatgtgtctatagatttgtatgtgtatatatataggggtgtgtacatatatatgtatgtatatataaagatgtgtatgtgtgtattacatctatgtatgtggggagagagagagagagagagagaatgaatcagcccccacacatatagaagctgacgagtcccaaggtctccagttagcaggctagagacccaggaagaactgatgttttagttcaagtccaaaggcaggaaaacaccaatgtcacagctcaagctgtcaggcaggaggcgtccctcttccttgggacagggccagcccctttgctctgttcagactttggctggtggaggaggcctacccgtatctagggggcaactgcctcactcagtccagtgactcagatgttaaaaccatccacaaacaccctcacagacatacccagaataagggttaactaaatatctgtgcatgtgtggccaagttgacacatgacattaatctgcatcccaagcagtgtgtgcccagggcaacactcaaggctgggctggggcagggggagggtgagaggcaagcggtgtctcagccattctccaacaggatggcgaccataagtggggcggtaaatgtgcttataacatcactgttggtggccccatgctgttaacggaaaaggttttccaggaaagtggcaaaccgtgagaagtagtgagggatccgagaggcctaataaagcccacaccgtggagaaagtctacagtcacggagcatcacaagtgctggctggacacgtgaacccatgatgacacacaagctctgacatccttgctatgaaggtaaattcagtcttgaggaaacatttggtgtttcaagtgctttatgtgaggcagaaattcttgaaagattatattggagtttcagagtttttgtgtatttgtgtattttgtggttttgtgcttttgagtgggttgagctaggaaaatgtaattttttgccatttaaaataaaggcatgtgggctcctgatattcataaacttgctatgctccatctcttcatgaggattagatctgggttaagaaggaggctttggacctggaatatgacacaccggaactactgtatcattctgtagtgggcagtgtgggcaaggattcagtagaggaaaagagacatggaatatgacacaccagaactaccgtatcattctgtagtgggcagtgtgggaagggattcagtagaggaaaagagttctgcattttctttctcaatgcacagggatagaggcatgtaacaggagaaaatacatgggtaggatgcatgacatacgaattttgtcagtgttgcctcatccttcaagtgtgcaccagccaaacacgcaaaccttccgacacttcctgaatgccaaaatcatcacatcagagccaagccaaatgaggcagaaaccaccatgctaagtgatgaatgcttctcttattaaggattagttaataatgaccatgctgtaaattactgtatcatatgtccaaagacatccccagtggactggtgagtaagtttcagtaacttgtatgagtaaaaacgataagcagggcctcctaaactctcccctatccagaatccgaattgagtaatatggtctggccttagagtttcactgtcacctttgttgaatgaaagaaaaatcagcttttgtgtttttatgtctgtgttattaaaaaaaagttttaataacatgttataccatatattagatgtacagaaaagtctaggcaacctaaggaaataatagagatatattacaagaaagtcaagttatccccagacaaatatcaagaggcctcttaaaatgttaccaaaaagagaaaaatctatgccacaactaaagatccacatttttacaagaactctcagcacctttcttctaatggcatttaagaagaaaccaggaaaacatacacatgtgaacttacaaagatgcaaaccgcatgaccttccctgacactagcactatgacatcaaaatcagcatgatttagactgagatgtgagtctagtgggcatctcataccacacactgtcaggacagtaccagacacagcagacacaccagaccacacctactgctcataggccatggaaagaagccaccaatgaataagctgggcatgcatttctggccctctgtgttctgcaggggaagggttctatcaccaatgggcccagttcctgggattccaagcacatatttcaatgcgcttacatgaaatactggtttttatttcaaagaacaactagtcttcatatttcttttaaggtcttaacaagtaccttgcaatacaataaataataaccaaacacaatgaaggcagacatgaagataaattatcattccaatgaggcttacaattgttttcctgacagtgaatgttctcaagcacagtgccagaatgcagcataaagaacaatgacacattccatacatttcgcttaagatatgtgatcagaattcagaggagaccagggtcttaatatgcttagggggcttctgaggaaggaaaatcacaaaacacacacccattgtgacgggaaatcacagcagaaaaaagagaaatggggtggtcgcgaaactccaaggccccgcttggtgggaggggagggagggcaggcaccagcaggtggagggggtggcctgggcagaggatgcaggtgcaacgtgaccaagtgaacaggaggactggcttcctacccctgaatctgcacccctcttacaacactcttgctttttcttttattcttccctaacgcttccccaagcatacaccaaaagaaatgctatcaatggtcacttattctcatgcaagtggctcattccacggtccttttggggcgtatttcttagcccaacatggtgtttttttttttccctgagactaatcccattcactcatatgtgcattggtaatccacacccctactaaataaagcaagctttttgcaagtattgatcagagaaaagcgttcaacttatccaccattaaaacaaaaaactcagggctgtttccagtagcaagaacaatcatataaacgaccttcctccatgttggaggtgtgtttcctgggtgcacttgtgcacacacactccccctggagccctacacacctcattcaggagaccctggaaggccagcgggcaggagccctgacctgcaaatgtgttgtcatctccacccatttcaagaccttccctccatccttggaggatgagaccctgtgcccagctcaaggtccctgctttgtccccgataccctgaacacttggtcttgctccttcctcccctccaccattcttcagcttgtcccccttcccaggcctgctcgttccccgccaatgggttccctccctcctataaagaagaaaatctgttgagcatggttcatcgttgactgctgctctgtgcccctactgccaccccctccccattgctgagcccactctgggagtcaccctcgactctctcatctgcttgactctgtggggggagtcctgggtcagtgcttacctgtgacagtttctagcaggcaagacggctgaaggggtattaggaactaggctgcttgactcttgctttcaagttgtagtcacagttgacatgtaccctgccccaaagccttggaaaagtctgtttacaccaggagtgtccaatcttttggctttcctgggccacactggaagaagaagaattggaagaagaagaagacgatgggctgcgggttggacaagcctggtttacacagagatttttgagagggaggctctggagcaatcacagagaagcaactggctttcataccaaacagcatgagggaggagagagcggccaccagaagccaaggtcataaaagtgagggcgtactgagcacgcatatgtcaggcactgtgcaaagcattttgcaaacattatgtcattcaatcttcaaagcaggcggagagggaggcattgctggctcatgtttagagatctggggagggaggaacacagtcacccgaaactataagccctggatattttcagagtccttagagaaggaattagacttcctacaggatacaggacacgcagcttgaggcaaatagatttcaaagcaaaatccaccatctgagaggcacactccaagcagcaccacttactcactttgcatctctaggagagctgcttagtctcctgggcctctgtaaaatggcgtgatcacagtacctacctcgtggagttaatgcagagatggcattaaccagtgttggtgatcagacactacctattatttatattattgttagtatcacccatgtatacatacaagtctctaagtatgcatttctatgtgcatacatacatagcacacgtagaatcaatgaatgtaatgaccatctctggctctctgttgagagaaacatgaaaatttataatccctgccctcaaggagttcagactctggtgacaaaggaataaactaaataggtagactgccaagcacaataaaattcattcccaaactggtcctaagcacctactaagagcccggctgctactaagccttgagtatgtcaaagtatgaccctttctctgcctcaggctcaacctggcgggaaagacaaacccgttacccataaccttccaacattccaagaaacagcctcagaagaggtttatcccaggtgctggaagtctccaggtgggacacaccaagttaatccaagatgctgagctggtggatgggacagcatggccacgatgggggctgggggctttgcagacgaggtgtcttagttgagccctgaaggctacttggacttccagaagttgggggtgcagggggcctgggatgtgtgggcaggatgactggggcagaagcaggggtacaaggacaggcgccccggcgggacagactgagaaggcggccgagccagaccgaggaacagcgcaaaaggtaacatccaagtcacaacaggagtccagagggtcctgagtgtgggaaacacaagctcttctagcttttagtccttggagtcccttccagtgtgtggaagagatccagcctgcaatgactggagggtgggagtggacgaagtttattctggagacaacaaggggtcctggtggcttttccggggtagtggagacaccgccacgtctgtgtctctggagaaggaagatggagaaggcatcctccggtgggatggggtggagctgggagaggccccagcgggaagcactcggaggagcgggggccaacccggaatcagcctctgttccttcttttccgcagctcacctgttcccggcttttcctcccagtctcctgggctcgccgccagcggtgggatccctcttcctgcacagaaccgcctcttccttcctcctggtgacagatgccccctgccacccccaggggctgcggctcccccagatgcccagcctcagcctcctgagtgctgtgcctgcccccactccatctgagcggctgaccagtcaccagactcacccccacccgccctctcccctccacacagggtagcccccaactccagccagagggagccaagacctcccaccccaggcagatcttgtgggcaaggtatctgcttaaagacattgatggattttatgaagaaaatatttaagccaatttaaatatttcagcaattgataagtaactcagcttttatgggctggacctttagggtattgtttgtaagatgtatatgattttcatatctatatcagtgcttataatattgtttgcatgaaaaaaaagtttctcatgtttgccatccatttacaaatgagctttacctatttgtaaattacgggctttcaacacgcagctggacgtggcaggaaagaggagacgattactccgtgtctcagcatgaagaaatggcagatgtcagatgtcagcgctgccaatgtttcagcactgcggttccttgctcactgagtaggaacagtttgcagaaatactggacaacctgctgtggataataaactatgtcccaggctctgtgtttcctcaggaatatatttacttagagaagcggcctattaacatttcccgggaaaatgcaaaatccattttgtgaagcagtgaggctgagttttcatagttctttcctcctccaggtgtcttcactccaagcttgtcacccgcatcattcgatcaagagtgcccagaacatcgcatgtgtcaaatccttaccgtttctgcctaattggcagttacagcctcggcccacctgtttccagggttcccagtgtcagtcggacactggaggggcctccctctccccaccagtctctggggcagattccccctcagcctaaacattctgcactgcagagggcctgccactcacaagcagcttctgtgccgctcttccaaattaccctgaagacattccctgtccgccccacgcctcccctttattctctttctcatctccaatgttaaagagtttctgaagcaaatgacaatgacagttgacagatttcagtctgaatttcccttttctagggccctcttctaggcatctatcttgcacttgctctttaatgtgaagctttttgactatttctgttgtaggagctctcattcagacgctgtaaaaacagctgttttccaaatacacaaataacgcagtctagaaaaactgggaactttctatgggggaaagtccttgctcatcctcccgagccacggatcaaggtcgagggctgcagcgtgtccctgcggcagcatcacctttctgagagtcctcaggaagcatcctcagtggccagatcccatttcaagggccctgtgcttcagggagcgggcaggagctttaggacatgtgatcccttatatgtctgagccgtcatctgtgggccatgaatgtgtttttaaaatggtcattttaattacccttatgaggtgttcacgtggttccccattcagagtctacagccaggagggaataaggcagacaccaagagccacttggcgaagtggagatggctgggctgaaagtcactcctgcatcttcctgttgagtctggcttgaaattcctgggagaaaagagcaggctggggccagtgctcggcctctgctatgcaaccagaggctctccaacttttccccatcccaagtgatttaagtcaccgccaattccaaaccattaaactcacactggagagaggcccgttgtttaagctgagatggtgctgacagcgaggcggtgggggctggctttaacgaagccctgagcttgttcttctgcggtgtgcttcagccatttctccagcttccctcgggactgactgagctcatcagaccccgggatccaaagcctgtgctgggatgcaggggtccgccctccctggcacctggctgcaggctttgctggtgtggctggcctgggccccggctgcctctgcctacagtgccatccacgctagggaacagctgtccccacaagaaccatgtggtccatgtctgggcagtgaccgcctcacttgcagccaaccccacactcttcagtggtgccgaggtcctgtggcagactcagccaatcccagtgtggacttgactcggtcttggacaccgggggccagtgagctagctgttgggccagtggggctcagcctgatactggacagagcctggacctggggcctgtggctggggaggggtgctcctgtgtgggccaacaggacggccgatggcctggaagacagtgtgaccgagctatcagctagcactcgggactccacatggatgcagaggtcaccgctggccatttcaggagacactacgcctaggagctactgcagccagcactgccaggcagcgacatcacaggaggacatttctaacaaaacaaaaagcatcttcccatcttcgtggacaactgccatgtggttctgataaccacttttcaggagaagagacacatgaaacttgggatagaaataaagaatgggaagagtgtcatggaaacctagatgaaaatgtaggaattaatcttcaaagttcagtgtgaggtgtgtgacagcagggaacatcctagggtgtacagaaagggaacagacctactcccgggctcctgggacgtgatggccttggctgggcgcaggctgctactgcaggggaggccatgttcctcttcatgattgtaccacatggggaagagcctacatcggtgtccttgccagaatatgccagaacatgcctggaaatcccaggctgctccttggcatctccaaagggccccttcacaggcgtaggcagtgtatcaggcagggacacctgagccctgccagccatgtctgaatgagggatggatggctaccacctcagtcacctcaataacctcactgttggtgccacaggtctgcccatccaccacatcaccagaggttctgtctccagatgattctgaagcaccaggctcaggcttccaggcagcagagctctgcacaggtgcagggggtggccctctcccaagctccatgcgatgctatggtccctggaagtccatgctgggtctgcggagcctgtcttgcacaggcccatgggtctctcacacctccccacccttgcctggaatctccccaagcctcttaagggaagcaattctgtccactcctggccctgaggtctctcagccaggagctacccttgctagaggggcggggatgagctctgagccagtccctgacagccccactcctgcacctgacaggctcagggaagctgggtgattggctggagatcacacagcccacgcaaagctgaaggtctcatctcccacactgttctgtgcctgtggcaggatcacagaaagcagagctggcaacagggattttccctcggacacagtgacttccataaaccctacattacatcgtcgcaggtgcaaatgtgaactaaaggagcttcttagcccaaagagttgcaaatacgctgaaaacagcttccagaatgggtcacatgaattaatggcaaaaaacaatccatgatgagccactgaggtaacccaggaagacatcacaaacacagaggccttcgctgcccttccgcagaacaccctgcttgctacccacaaaagcaccctttaatcggccatgagtcacatccatggtggcaaatcggatgttctttcctaagtgggatttgagaaatccaaatccttgacatgtgcttggccgtgagcctgcagccctgcctgtcctcccatgcagaccacatacttcgactcaaccttgtgattcactttccacacatccctacacacccatggttaatagggagacagtaacccagaggttcacgtgagtcactaaaaaaccagaaggaaaaatgagtggccacgtgagagcagctgtcagggaggagcaaacacccaaagttttgattaatttcccagggatctaatttaacataagaagtagacatggacagattaactatgggcacatgacaacacatcacggtaccaggtttctaagaaaaatgtttgcccaggggactagcttaaaacagagagtagtaaatcggcagcggactggtttgcttatagcccaatgtgcatttcactgtatcactgaactgagctggggtttcgaacagagctgggattgagataaatcacagcacatgctcggccctcagtctaaactggaaaacctgttcggaggaaacccatgcccttcccatggaacgagctgaattacctagaccagcaggagacaagaggttccatctctccccagcgatccgtgctaagcttacgtttcccaagggcctgtcagaaaaatggattagagaaacctatttccctctgaatctaaaagccagctcacctggggaaagagcacaccaccaaagtccaagggcacgccagtgcagcctctgcgcctggcagctcctcctcctgggaaacatcctgtctcaggtctaggatggaagaggaaatacctccaccgccagccccagaatcggcccttggacatcctgctctcgtaaccaagagaaaaggggacactggatgcccaccacaggcctcagctttcttggggtgacaggaatctttaagaatttcatgaaatcttggcattttcttcctggaaaaacacacacatgcacatccacataaaatctgtcacagactgtctggaattcctgagacccatccacagaagccatgttaagaaagcctgttctcagaggactgcattaaaagaaaattgaatccaaaatctattacttggccaggcgcggtgactcacgcctattatcccagcactttgggaggcttaggcaggcggatcacctgagatcaggaattcgagaccagcctggccaacatggcaaaactctgtctctactaaagatacaaaaaaaattagccggtcgtggtggcaggcacctgtagtcccagctactcaggaggcttgaggcaggagaattgcttgaacctgggaggcagaggttgcggagagccgagattgcgccatcgcactctaagcctgcacaacaagagcaaaactccatctcagaaaaaaaaaaaaaaaaaaaaaaaaaaaaaaaaaaaaaaaagcaaaattttttactggctaccatgttttggggctgaaacacataagacttcggagaccccactaaccaggcagagccctgccctggaggtgactgtgcttgtccctgcatagctagtgaccagcacaggcccaaagccatctctgaatgtatgtggcataattactgaaactagaaaacaaacatgcaaatcacaagtgcgttttgtgcaaataatgtgatattttaaatcagaaaatctgggtatcaatctagactctgcttcttcctgatttcatgattttgaacaagtacttttttttcctcttttaccaaatactgtagttgaaagtgtattaaaaattaagcttacattaataaacgtatacaaaagattatattctggatttaataacaaagaagggtattgggaaaaaaacaagtctgtaagtaaaaaaatgcaagtttactctaagttaatgggtacagacacaagcatgtcccgtataattattccctttccattggattcctccccaaggactggcacaatcttcaacccacaggggctgagaccccgcaggggccttgagactggccctggtttggcccattctgctcctcccgtcttccatggcgggttttcttctgagcgacctctccacagggaggcaccgagggctgggcgtcacgtgaggttagcgctgttcctgccctggccgctttccaagtgatgtttactcccatttcattcggctcccttgcagcatctcagatgtttgcatggtatgtgtctctttctgtagaagaaccttctgggtggtttgggaaaggccctggcctgtcatcggatgcctctgccctcgctgggtccctgctggggccgccctggaaatctccaggccaggcattctcaccaccctcttgccttctccctggacctgctctcatgaggggtctttctggtcactcccaggactcctctatgggcaggggccacatcgtaggctgctgcacggaccacagacaaggtcaccttgggagctgtggacttctgtgtccttgtgatccctctgggaactatacttactctgcacggtgattcgggacagcaaggatggcagaacacttctcaaaggacacccccctcgggaataggacatctccctgtactgacttggtgccgattccttgcaaagcgtcttcccctcgtccttcaggactgctggccagcactgaaacttacatcccaattctacagtcccaggagaaaagcctcactctgtactttcaacccctgccattgcgctgaggatcacaagattcacagaagagatgtcttattttcactttgcaggtcttaaaactctgaactaaagtactgtctagacaattatcacttgaaagaaagttcagcaagtcacacatataaatccaagggagaggctgtccagtatgagggtgacaaagggacacgttcccacaaaagaagcctactgagtacctgtcacctcttgcagcaaccccaagggtgtaacagcaactacgtggtctcagacccaggagcttcctgccatagctccagaccctcggggagcagcactgaaaaatggcagcaccccggtatggagaaacatgggcagtcaccgcctcctcaaagagaggcacaagatgggtcagcaatgggccctggctccccttccactgtcctgcatgccccgaagctgtttctgacagctgcacccactccccacagtcagatgttagggtcaccaatgacaacgcattgatttctgtttcatgtgtttcacctgcaaaaacaaaaacccttaaacttaggatataagaaattgccaccaatacttaaaactcttggacatttcagcaaatgaagtaagcacagaaatagaaataagaactacaaatatagctctaaggcagtatgcttgtatattcagcataaactaaaataaatacagcagatctaataatacagggtttagatacaaaaagaaatacacacataaattccatgcttataaatcaaaattagcatgacagtgagtgccacagggaaaccagacaacattcaaagatttactcctaaatatttaatagtgaatattaaaatattaaaaataacaactaaagggtatacagaaaagcaaagggaaacattacagagacacaaaggtagatctgaataagtagacaggtaggctgggaagactgagtatgttaattctcttcactgtaatagtgtttaacccagtttaaatccaaattttaagaggcctttttaggaatttaaaaatggcaaactttttctaaactttacacgaaataataaagaatagcataggaattctgggaaaataaaggcgtgagagagaagtcgcactgccagatgctaaaccatgctgtgaatctgcactgtcacaacagtgcggtgaggacgcaccccaggaccgatgaggccggccccgcatgcccagcaggcctgggagaccgaagcactccacacaggaaacagtaagcgcgggaccaacccataagggataccggggaaactgccatgaaattcatcaggtgaaaaatcgagtccttctccagttgccatcagataccaaaacatcttctatcggcttaaggttaaacgctgacacacacaacacagagaactagaagaaagaccagcaaagaggttgctgcttcccgaacagcaaagaactcaccctaaaagcaacagcagaaagacaatgatttagctacacaaaaacgtctgaactttaaaagctcgtaagcaaaatgaaaaagccaatgacaaacagaaaatattgagaaccacaaaatagtgtgtgcttgggcgtgtgtgtgcatgaatgcacgcacatgcgcgttctagcactccaaaataaacagtggtcaaaggaatgaaatgcacagttacatggggggaaatttaaaatccaagaaatatattctttaaagtagtctcattagtaatcaaagaaataaaattagataggtgagagacttttttttttttttgcctatctagttaattaaaatgttgagaataaaaatatctaacatttgccacgttgagcgtggtgacgacttgctgacaaatgccagtgtgagcgcagcttgaacggcctctggaaagcaatctggtgcatttgtatcaaaaatcataatcttgaaacaactgacttcctttttagaatttttggaaaaaaatcagagccagggacaaatacttctgtgtaaacgtgccatgttggcattatttatagtgaagaacagtggggggaataaaacccttacatcttctatattgtcttaataaaggcaaacaacagaatattatatataaaataaaatgcattcataatatttaataacacgagaacatacactataatactcagtttcattttaaacacaaaattctatgttcagaattttattaattttatagcaaaactcctacatagatataaattcaagaaagaaccaaaatgtccccagatattaaatatgtgtatctgagtggtgggattgattagggattctaattttctttccagttctctaattggaatatctgatacaatgtcttccatatattagctacccaataaatattgagaagaagaatgaaacgatttcaaacttccaacataaacatgaacgattactaattctaagaaaagagtgaaagcatgttataaaacaaacactaataaacagatattggtttaggaaggtggctggtggcctctcaggctggctaagccaagggatgtttacttttgtcaatttctgcagaaaccacacaagtggctggtgacgtatttagctctttcctcacagtaaccctcctgaggactctaggatgatgttctcacatagctctcattgccggctgctttccctgcctgttgccctgtggcagagccctagttatgggcttacagctcctccacgctccactggtcatatggcctggggataggggaccagggtggctgaacctggaccagcaaggccccctttcctcctgcctgtgacccctcactgagggtccttgggggacacaagcaaagaggaacatagcccacacggagcccgcgtcactagcaacggcacacgtgtctctaccctcatgcagggtgtgagacagagcagctcccacgtcctctgctccccttgaatctgcacgttcgggtctacccctgcctgctgaagaagaaaacaggggaaatgcaggaatgcagctcatgaggttgggcccagggagcccctgcgtggtcagagggagcggagcacaggaaaggaagagaaaggagaggctcctctgcatgcccagccccaccccacaccatgaggacagtgtgcctggggttcccggggtgcccagaagctctcgggagccctccttcactgacaggagggatggcccggtgcagggagggcaggagggtgagatctttggtctgtgggaagccacatcagatgcagaaagtccatttcaaagacaacactgaccctgcacaaatccagctcctctgccctgtcacgagaagggcactccatcagggcaggcgctcaccacctctggttagagcttccagaacctcgtgttatgaagcacattcagggacgggcagcaccctcgtgcaaactcagggaaaacagagggtccactgctgcacctaggttgaagaggatggcagggtctgcagggggatttttatctttttctacgtaaaggacagaagacccagcgcacgtgttctgatgcaggaagacgtactgctgtctatgtaaagtacagatcaacagcaaacccaggaataaattcctgctgaggaaggcatccaggtgcctccctgcagaatgtgcccctgggtcaggctgcagctgactttttacaaagtgagctcgccactgcaaagccccatgggttttgtcacactgactctgtggctccggcctcaccggcctttgctgcacttactcccattgactgccagggtcgtgaccgtaaacaccgaggttctcttccagagcctggtggcataagcttgcagcctcgagtccattggctgcgtggtgaaacagtctgggaacttcccagttttgaaaaaagttagagatggaacttcccagttttgaaaaaagttagagagaacttttaaatagttaatagagcattcagagagaagaaagagctcctcacgcatgtgaaggtgtgtcagatgcagcaaatccatttcaaagggaacgccgacccacaaagagcagccacgcaggatctttaaaaggactctcagtcctaacagctcacaataaaccatctctacgcggtccactcaagacacactcaggccctgccgtggtcattctctctctacagcacacagagggcaatggcaccactccttgctcttatcctgagtcctggcgtgctgaccgaggccaggtgcaagagggttttttaattttttaaattctttaaaaaaacattctggattcaggaggtccatgtgcaggtttgttacgtgggtctattgcatgacgctgtggcctggggtatgggtggccccgtcacccgggtactgagcacagtacccagtaggtagtttttaagttcacatgcccctccttccctcctccccagcagcccccagcgtctgttgttcccatctttatgtccatgtgtattcaatgctgagcttccagttttaagtgagaacatgcatttggttttctgtccctgaattaatttgcttgggataatgacctccagctgcacagatgtggctgcaaaggacatgatttcattctttttatggctgtgtagtattctatcacgtatatgtaccacattttctttgtccaatccaccattaatgagcacctaagttgattccacgtctgtgctattgtgaacgttgttgcagtgaaaatacaagtgcatgtgtctttttggtagaatgatttattttcctttggatatatacccagtaatggaattggtgtggtagttctattttaagttctgcaagagtattttaaataaaaagttatataaagataggagtaagatggaaacaggaaacatacaaatgattgcagaaaaaccaggttaattcatcaggtagcttgaaaagcgggactttctgaagcagtaaaatatctgactaggttctatataaatgaaacttgtattacctacaaatagagtagacttagtaagacaccaagaaccaccaggaagagctaccaaggatctacttttgtcaacagataagaatgattttaaatgaacaaatcgagaaagatggaacaaataatttaaaaatttccctggtctgccccactgctcccagataatttcaggtatctggcagaagaaactgactgccccaaccatgataggcacagccaccaacaaaactagacatgcaaaacgcctggctcttttaacacagcttttgtttacgaacgccatacaacttctcagagcacattggaggaaagattttcaacacataaaaactttgaataactacaatgattcatgtgatttttttgtctttgcattcaaaagtcagaagcataacacgaggctatgtgtgatccgggctcagggagtacgggggagcgctcagaagtgtacggagaactattttcagcgctggcttttgctggagtccagacctgccaaatcgagcacgagagggcaccttttgccaagatggaagcactatgaaatccaaggttgctcatttccggttcattgtgtttatcgtgtgaggctttccagaagggaaaaaagccagcttctattttaaatgacgatccactgatgagcagatgggtttggtgttgctttttgtttattctctctacatctgaaaatatttcaacattttaacttcacagaagtataatgatttttctttccttttttacatgctttcattattaaacgttttacctcaggagagttaagacctcagaacaacacctcccactgagctgaatggaaggacactaatgggtccactgcctctttatcaatgggaaccatctctctaaacacagaatttcctccatggattggtttggaagaataaaattttcaggtgtaaaggagctcaccaagatagcaatctattcatttcacatgaaaaaaaaattccaaagatgagaatgaatgacttgaggtcccaaataaagcaaaataggtgatatggtttggttctgtgtccccacccaaatctcatcttgaattgtactcccataattcccatgtgttgtaggagggacctggtgggagataatttgaatcatagaggtggtttcccccttgctattctcgtgatagtgagtaagtctcaggagatgtgatgggtttatcaggggcttctgcctttgcttctttctcattatctcttgccaccaccatgtaagaagtaccttacacctcctgccatgattctgaggcctccccagccatgtggaactgtaagtccaattaaacctccctttcttcccagtcttggatatgtctttatcagcagcatgaaaatggactaatacagtaaattggtaccagtagagtaaggcattgctgaaaacatacacgaaaatgtggaagtgactttggaacttggtaacaggcagaggctggaacagtctgaagggctcagaagaagacaggaaaacgtgggaaagtttggaacttcctagagacttgctgaatggctttgaccaaaatgctgataatgacgtagacaataaagttcagactgaggtggtctcagatggagatgaggaacttgttgggaactggagcaaaggtgactcttactatgttttagcacagagactgggcagcattttgcccctgccctagagatttgtggaagtgtgaacttaagagagatgagttcaggtatctggcggaagaactttctaagcaacaaagcattcaagaggtgacttgggtgctgttgaaggcattcagttttataaaggaagcaaagcataaaggttcagaaaatttgcagcctgacaatgtgataggaaagaaaaacccattttctgaggggaaattcaagccggttgaggaaatttgcataagtaatgagaagttgaatgttaatccccgagacaatggggaaaatgtctccagggcatgtcagaggtcttcatggcatcccctcccattgcaggcctggaggcctaggagaaaatggtttcctgggctgggtccagggtcccagagctgtgtgcagcctagggacttggtgccctgcatctcagccactccagctgtgactaaaaggggccaaggtacagctcgggctgttgcttcagagggtggaagccctaagccttggcagcttccatgtggtgttgagcctgtgagtgcacagaagtcaagaactgggggttctgaaaccacctagattgcagaagatgtatggaaaacgcctggatgcccaggcaaaagtttgctgcaggggcggggccctcatggagaacctctgccagggcagtgcagaagggaaatgtggggttggaacccccacacagagtccttactgtggcactgcctggtggagctgtgagaagaaggccaccatcctccagaccccagaatggtagatccaacgacagcttgcactgtgtgcctggaaaagcctcagacactcaacaccagcccatgaaagcagctgagaaggaggctgtaccctgcaaagccacaggggtggagctgcccaagaccatgggaacccacctcttgcatcagcatgacccggaagtgagatgtggagtcaatggagatcattttggagctctaaagtttgactgccccactggattttggacttgcatgggccctataacccctttgttttggccaatttctcccctttggaacaataactgtacccccattgtatctaggaagtaactagcttgcttttcatttttcaggctcatagatggaagggacttgccttgtctcagatgagactttgaactgtggacttttgggttaatgctgaaataagttaagactttgggggactgctgtgaaggcatgattggttttgaaatgtgaggacatgaaatttggaggggcctgggcggaatgatatagtttggttctgcatctccatccaaatctcatcttgaattgtactgccataattcccttgtgttgggagagggacctgatgggagataatttgaatcatgggggcagtttcccacatactgttctcatgatagtgaatatgtctcaggagatctgatgggtttatcaggggtttccgcttttgcttctttctcattttctcttgctgccaccatataagaaatgttttttgcctcctgccatgattctgaggcctccccagccatgaggaactgtaagtccaattaaacctctttttcttcccagtcttggggatgtctttatcaggagcatgaaaacagactaatacaacaggattggaacccaggtttcctgaccctcaagatgctgggcaacgtgttccttccctcagaagccacgtgccgtagactcctccatctgtgccctggactgggggctgtcctgctgctgcacacctacatgtactgtccttgagcttataattgggtggccctaggaagtagtgggatagtaggagcagttaagaggcctcaatgctggaggtgaacaggtgggatttgggtccgggcatcattatgtaggagctgggtgaccaggggcaagcaccttagccctccggcactttgctgttcacttttgcaaagcagagatgagtgctttggccttagggctgtgaagtttaacagtgttaaataatgcagaagaaagcaagcatcccacagatactactgatgacaataacacagctctttctttaacaaatgatggcttaaaaactaatcctggccagcatgctccaatctagagagcgaggttttgtaaacctgatcctcaggtgacagcagtgtctggaccagcagggctgctcacaggagtcaccgtgccaggatcactgtgctggagcaggcctactcaatcagagtgtctgggctcagctccgaggtcttccaccatgcgcctcgtgcattttctacacagagaaaagtgtcaattggcccaggatattgatgggatctgtgcagagatatgtgagggacaggaacgtcacagcttagaaacgcagtttatgagattctgcatttaaaacccaccttgactcaactgcactcagagagaccaaaaagcctctgcattctatatttcacatttagtgagaaggcccaggttagaaggaaacagtaagtctgatgtcgagcagcatggaaaacggaggatcagtggatcatgaaaaacaagccggaatgagaaggcgtgtcagtcaagacagccccgagccaccgcctggccgtatctgccaaaggggtttgtgatcttagacaagtatccgtttatgctgtttagaaaacaatctatagttgtattctattttctgcattcagctttttttgagtgccattatgataaaatgtcatgttattataaaatttgaagttataataaaatccaggttgagatgggcccaacaggtgcgacctgcattctgtacagaatgctacagaattcttggctgctcgggcccttcctggagtggtgctggcctgtcgcccacaggccatctggggaggaagaaatgtatgcaagaatgtcatgcttccagaggtttcggtggtggcaattctactgcaattattaaagatacattgttacactggctagttacaagtgggttatatttaaacaaaatttggagaaaaatgttaaataaaaaatgtttccaagcacaaaattgtttttggagaagatgaacatcctacgtcaccatgaaactggtgtattcaagattcaggccattaggaaacgccatgtgtcatgttacaagaaggaagcagcctgtgaaaagtgtcaaccgctcctttggcagaagaagaccagtgttgtggtatttaatgtcgctaaatttcacgatttgacattttctacattttcctttttctaagatctaaagatcacattattgaaattttatctctaaagaatggacctcttaaatagtcctcttttatgattatgcaaataactcacatactgttttgagaagaaaaaaaagacaactaaataatctgaggatagttcctctgttatcccagccaaaaagaatagggaatgcatagtgacaacaccttcctaactgcgacctttagaatcacggcacttcatcaagttcagcattgaacatgcttaaagggccgtctttctatgactcagcccggaggttctggagttgttgcccccatcacagtgggctttgggcccccgggcctgccccttggttctaatgatcagggaggtcctcccttatgtgcccactgaacttccagtctcaggctgactcacacaggacacactgtgaaaagctggagaggaaagggcccaagtgacacagtcacccgatggctctcagggacctgagggccggcaaaggtagaacaggtgtccactaagcctggagcgtagcctcaaacccactgtgccaacacaccctgacttcagccatagtcccgtgcatatccaaaggtctgaaggaaacttcagaggtgtccagtcttttggcttccctgggccaccctggaagaagcagcattgtcttgggccacacataaaatccgctaacactcatgatagctgatgagctttaagaaaagaaaggtgagtgcataaacctcataatgttttaagaaagtttacaaatttgtgttgggcgacattcaaagcccctgggccacgggttggacaagcttgctctggattgtacccagtccatgcctgtcattgtatgtgatcaaactaagcaaaaagacctgattttcagtctaccccacccccaacccctgaccccctcagtgggtccccagtgaggacggatgagaccagaagtcccaatgagcccagtgtgccttgtgtccctgggggaaccagacccgattggacacggactggattttcatgcgtagggggcggaggaaagggaggacattaaatctttaagtggttaaagacacaaaacccacaggaatgatttctaatgaacagaaaaagggctgaggaatttttcttttcttttcttttctttttttgagacgaagtctcattctgttgcccaggctggaatgcagtggcgcaatctcggctcactgcaacctctgcctcccaggttcaagcgattctcctgcctcagcttcccaagtagctgggactacagacacaccaccacgcccagctaatttttgtaatttttagtagataggggttttgccaggctggtctcgaactcctgacctcagatgatctgcccgcctcggcctcccaaagggctgggtttataggcttgagccactgtgtctggccagggctgaggaatttaatattgcacatacatattgtctatgattctttatgtgaaaatccactcaaacatccactctgcttttgacagcatcagcctttctcatgacaaaaccttcccctcagggcctatgcggagaatgccgacagcacctgggctccagcgccttctggggcctaggcctctctacacccacctggatgcgcaggtcaaagtgctttgcttctcagggagggaactgacgccccgctcagcccttccttctcctacgctccactgtcctgagggacttgatgtccaagtgctcaggtgggttcggcattttccacaaacccaaggaccaggcatggcagcctgttgaggccaccgagaggccggcttcgagtatgcggggcagtgggtgggtatttcgctgtgtccattttccttatattcactttctatttgaatgacagagaattatacccagaaacagactagtttagatttgaaagcccttggaaatcaccacttcaaatgaagacccaccctgggcgagatggggagggaacacccgctgggcaggagggcacggggagagggccggatggggtggaatgcccactgggcaggtgggctgggcaggagggcacaggaagagggtgagatggggtgggacgcccactcggcaggtgggctgggcaggagggcacggggagagggcgggatggggtggaatgcccactgggcaggtgggctgggcaggagggcacagggagagggtgagatagggtgggacgcccactgggcaggtgggctgggcaggagggcacagggagaggtgagatggggtgggacgtccactgggcaggtgggctgggcaggagggcccagggagagatgagatggggtgggacgcccactgggcaggtgggctgggcaggagggcccagggagaggtgagatggggtgggacgcccactgggcaggtgggctgggcaggagggcacagggagaggtgagatggggtgagatgcccatgggcaggtggggtgagcaggagggcacagagagggtgagcacagtggccactgaaagccgctgagccgtccatggagatctgaactgttgagctggcttccggtggcatgcactttttgaaataaagccttttcatttgaccatgaatgtgttcaacaaaaccaaacttcttgggagagtgaacatgtgttaaatgaccatatactaacccatcacgctgactgttcacagctgctcaccaccatgacctcattagttgggcggagatgaatatgcagccattttacgatcacaaattacattccacaactgaaatgtagcatggagctctgagagatttttcataaatcacaagttttatagtatgcaatgaatttttatcaaattcataacatagatgcatacatcttattttggaaaatgaaatggcatttattttctccacagaaaaagtgccaaaaaatgggcagtaataaaatttccattattcaagaggttagatatgatttccatcttgactgaaaaagccagaacgctttgaaagaacttcttttaggggttcttatgtaagaattgctattatgcatccaatgtgcagaggaagaaaaaacaaaacacaaaaaaacctcttgaataataaaagctatggaataaagcagtataataggttggttttaaaacttaaatatttttggtaacttgatgtggataataatttgaagatttaagaaaaataactcactatattttttaccttccacattttctcctactttaaaattcactcactttgtcttgacttggtcgttgactgcttttattcataattcacttgggataaacagacttgaagcatatacacgataattatttcaatatcaattctaataaagacaaagcagtttggtaagttttactcgcattcgcatacttttcaaggtatcatattacacataattagatcctagaaacaaccaaattgctacttgtgagctaaaagtgctgaattcttgcttgtttagaaagcacactgcctcatccaaggccctgatgtccagctcaccctagggtctagcactctgcaccctgtaggacttgcaccagagatcacggccttcttggggcaaaccacagcactgtcgctgtgatctgcggaaacggctccctccactttgcctcctgtgagtcttggtgattaaattgttgagcaacttcaaagcacagaggcgaaaaccaatgggaagaagcagctggtggtggagagcttaagcatcctgcgcaccttctctgagctctggccaggccgtgctgaaacactgcggaagtcatgtctacaccagggttccccacccactgtccagaggtgacaaaggagagacgctcctgataaatgtcttcacgtgacagtttgtcattaaaaaccgaagctaagcccactgaattcctgagtgcttattaaagcgccaatggccaaaagagacaagactcacaagactgtggctttctcctctggatggcagaagacgtatctcacttggcttgtttcagtccaggaggcatcacgccaaaggaagtactatgccacaggaagaaatgtgcaaactggctggttctcacgtttttctacagcattttacttccatgggttctatctaatggtaacataggttagagcaaaacacagtcaacacagttgctttagctcaagtaatttcatcaccttaccccatagtgatagtgaccctctaagggtcaacaaaaaggcgcatcttaaaatgtattttatagctctggtaggccaggtgtgcaacgaaacaaggttaataaatttaaaatgccttggtgtgttttgctcctttcttagtctgcctgagctgccataacaaagtactatggattgggtggcttacaaaacagacatttatttcccatagttctggaagctggaagtccaagaccaaggtgccagccatttggtcctggtgagggcccaattcctggctcacaggcagctgcttcttgcagcgccctttcgtggtggagcaagagctctggtctctcttcctcttcctctgaggacactactcccatcgaatcagggccccaggcttaggacctcacttcaccttcattacttccttacaggccctttctccacatagaatcacactgggggttggagcttccaaatgtgaacatggagggatacaattgagtccattaacattccatcccttatttgtagtaacagcatgaccatactcagtgatgacagggacactctaaatgtcaacatttacatcttacaacactttttatagctctattaggccagttatgtcatgacatcacaattaataaatgaaaaatgcctgggcattctggggatactcagcagctctccagatgttaaggaaactcagtataccccaatctggtcatttctatctgtgattgtgatcttttgcactttattttatagtaattttaactgaaatttttaacggaaacaaaggagctacgctgtcatgccaagttttcagtaaatacgttgaggagctgtgagctcagaaagcgttccaatagaattcatttctcatggagagaccatgattgatctatttgaaatgcaatattggtccagaaactcagaaacatttggtggaactcagggtttacaataacaacattagctaaagattcaatctggacctattttaagatcccgagggggtggcacattggtgtgtcattcccaagatgtctcaaaacacacagcagatttctgctgtagcaactagtgtgagaaaacccgagagcttcttggtcatctttgcacctctgagtgctgagcacacgtgtggtgacgatgttgctacaacgatgtggggtgcaggaagctcgagtttcaaaagaagatcataagtaacacatttttccttctagccagaatgccctgaaatacatgaaaaaagatgcagctctggctacgtgaaaaagaggtagtgagtgactcggggctgggaaacgaagccgtcctcgctgggatggactttcagtctcacatcttcagcaactttagcttcttcattatgactttttttctcttgaagattaaggaatcgaggattgctgacatgtctgtattgattagttatggttctccactatgtttactgccatcctaattacagaacctaattttcacatttacttataattgtgtgcaattgtccaggctgatcttttaaggttaaagagaaaatctcaaacatgacatcaaacaagtctttttttttttttttttttttccttattttacagctttattactgatttccctctaaaaagagactcaagtgtggagctgactcatctatagattaaggaatcacaaagtaccatagtcacttaacaaatgcaaaaaaaaaaaaaagcaattgttttacctttcaactgctgatgttatgtacaatctatcacaaaaagcatagctgtgcattcatgagctgattatatcaacctctagaattttagaaacgagcacatctaagcatatggatactctcttaccttacaaagtaaaagcattttctattttaaaatttttatttctgtgtaaaacaaagaattcctagaggtcaaataatataccaaacttaaagcactattaagtcatgaaacaaagaagattctgaggtagaagtcaagcaatataatccacagtttcaggtattcccagcaaccatcgcatttcgcaagtaagatctattttttttaaagtctcaacttccaaaaaatcaataatccattctgtaaaatcagatgtaaaactatgaccaacagaagacacccaaacttttctcatggtaacagagtaaatgcttttactaaaagctgccaacatttctatcagtagtaaccgtaaggaggccgctggttgtaaccataatgtccatattgctggggatagtaaggttcttgtctgtgttgcgggtagttgttaccccaggatcgtccatgccactgattggatcgattgtcacttggccacccccatctgttgtccctgcctctgaactgtctgttgtcttgcaaccgattgcctctgtttctttggttcccaccagctctgctattccattcctcaacaattggaggagactcaggagggcgtttcaggtattcctgatactccttgtcattttctgtgaatctactagcaaacatctcttcaaaatttggaacagcttcggcagtgtcagtcattctgaaaatcccaaaggtttgaggcagctgtattgcttaatgtttaggttgtttaaatccgccaagggctatgtctatccagctcaggccgaaccccgccggcgagacactgagaagcccaggagaggtggcctctggtccactacaccgtggaactccagaccactccagttctccaatgtaaccgagcgccttcctctccaaacaagtcttttaataaggcccatgaactagtccatatatataccagaggaggaaagaaaaagaatgaccacagtttattctgaagacatgacaaaggtaacacacatcagttatacacaaagtcaaatttcagcattacctccagggcagagggagccaacagctttcagaaatctctgctcctgccatagactggggctcccctcagctgcctcccagtggggactacattacccagccctccttgcaggcaggtgtggtcatgtgactagccctggccaatggagtgtgtctggatggtgtaccttaaagaagcaggtgcttctttcatagtctctttccccccacagctaactgcaggcccttagggctggtggagctacaaagaagaagcctgggtcccccaaatccccatgtggaagcaaagtggccagtcatcaggaaccctgacattagactaacacataaggaagaaataatttttcttttatgaactcagggaaatattttcctgaaacacaagagtgcacagtccagagaccctgggtcagagccctacaggcccaagaaaggcttggttggacactggcatgggacagagggaggcaagaaagatgagataagcacagactagagattcgtatctgcttttcataagtacaagagaaatgtaccatcaaaatcagttctaatcaccgtcactctaattgtgtggcatcagacaagctcctcacccgtccttggcctcagttccctcctatgtagaatgagggggtcctacctggattagtggttgtgagaaataaatgaacccacgcatgtaaaactcccagaacagtacctggcatagagtgggttctcaaaaataacactttagttcttcctgaatatctcatgcagtgatataacatctttcttgaacgagtctgccctttttgaagtctgccattggaaaaaaaaaagcaaaccagcataaaataaatattatatatatatatacacacacaaaaatgtaaaatatataagtggattcagaagtagaagatgaagggcccacgtctctgaaaagccacagctgaaggcgctgaaactagccgtctggcctcactagcacagtgggtagagtctgacttcctgctggctgctgtcattcatggcaggactttccgggactgtgcgctctctgccctgtggggaagaaccccgaggaggtgagagtgagaccctgcgccctcctcactcactcaggttccagccacaacagtgaatttattttgttttttatctgtttggcttatcacatctgaatgcaaaatatgcagcataaaatgaatgaaaattgagaccccagtgatggttagagaattctcgtatcatgaactaaaagtgaacttctttccaagaaacaggggaccttcgttttgctccccaatgtacacactgtgctggggtctgaagtaaacaaggcaggagctcagctccatcccagggccctcaccctccactgctccctgagtgtggtttaaaaagaggaacaaggacctccacaaagtcagcttcacattcagcaggtggacagcagaatcaaatctctgcaaagaaacagcctatgagtgtgtgcagctgctcacaggcctaaattataatttccaggtggggccagcgagttgctgcaggggtggctttctgcagaaaaaatgaggggtggctgaactggattccacaggccctagccacacagagcatcatgcacctgaactgggggtcttaggggactcctcttgggcacacgacatccctttgctgcctcctttccacagggaccctgcgctgggaacttgcagcacgtcgctgagacaccagaatctggggaaattctgcctgtccccaacctctcgctctggctgattttgccatctaatttgtagccttgcatgtacataattcctatttgtacagaaaaacaatcaaaggtggaactagatcgtctgatctcaactccagaatgtgggctttattgctgccctgtaacctggggctgctactctgccctgatgatggacacagggttcccggaagctcagggcccgaagagagtccagctgggcagtcgcacatgacagacagggtgcggcagccaatggccctccgtgctcactgtcaacccggccagcagaggccatgcataggtggccaggtgcgactacctgtgttccagcaagtagatggaaaaggaacactgtcgctttctcagggctgacttccaaattggggggaggaggagtgggtggttaagggcatctaggaggtgggtggcaagggagtgcccccgcagaaaaggaggaagaagctctaagcccttgatgagtcagagctgaaattagtaacattggggttgccactactctttcaaaatttaagtcttttataaaagagccccaggctttctggaaacaggtggtcagattgaaataaaaatgatggctatggggccagtctcctcctaccaccagcaaaagccaaaagtgaatttatgtttcacagccagtgtggagaaagcgtctgctcaacagctcaacaggaaaccacggtgcattccagggcccctcctggggttcctttgctcattttcacataaagaaagaaaaaggatgggaagtattaatctgcagcactaagtatgcacttttgtgagcacttgttctaaattattgccattacatatccacactggaattgaaaaataacccagctcaattcatcggccaaagacacccagcctccatggtcagagtatcttctatgcccgacaggagggactgtacccttagaattgaaatcagttgaaatcagtcatgcttcatggaaggctgcataaacaatgtcattctacccttaggtattttaccctcattaagtcgcagaaaataagagcctaaagggaaactgggaaattgaactttcagcttttactatcagctccaatagagactgttggtagaaatgggcgcacatcacctgtgtctccagcatctctgcatgaaaaacagagcgtggtctatcagtcttacagaagactctcacccagtgctttggcccaaacaaatcagatttgttggaaacattttcaaaatttctaactcctagatttgatatacaacataaactaaactgtggcatgaacagaatggagagagacttgggatcttaccgggagacaagatcatacccaccaacccaacaaatgaggccacaggcatgcaagtgagatacacagaaaacaagaacaggaagggccagaggaagaagggcccctgggcagcttgattggggtgctcagaggaggaggcaagggaactggggggaatacagacggtgctgtggagagggcattcaaggtgaaataaaacagctcaagcaaagacacaggggctggaattggcaagcatcatcgggatgataaagactaaatctatttgattagagcagccttctggttttgcttcttttgttgttttgcttatactttttgcttaaaacttggacatagtgggaaatagaatcagaacagtaaattactagttcctacatcagtaggctttgaggagcaagaacctactaaacgctgataagaatcagtcattagggtctggcagatacagcatccacgtaagattaagttcacagattcccagtgtgaactccgtgtcagactctgctttaggaggagacagatcctatttcagggctgggcacacctaaagatggagcctggcgaggagcatgacttagggtgagaaccatgccatcagcctgccccagaagaatccagacatgcagcagcacaattgaaatcctcattgaggacttcaggtcgttgcactgtactatacaggggattcgtgtggaatgagttgattgctgctgctcttgccccacaacacacacacgcacgtgcataactgaaagcacgtctatgttaatgggctttcctgcagtaaccttcttactatctctactcatttcccgttgcatcatgtataccttaaacatacacaataaaactcattttaaaaaattaaaaaaaaaacctcattgaggcagtgagtataatcaacactaacggataagtgatggccccaggcaaagagcataaataagggaacggaagagatcatcaaagacacgacttagagtaaggccttgctggatttaaaaacagattaaaaccaacccacacaaacctttgcaagtaaaatggatctgcctgccatgtcacagtcaatgaagagtcaaatctgagcattatttaattacaagcatcacaaaagcagaaaaacaggttgtctcggtctgactttagaattctcttctacatattaaatgccagaagatgccagagagcaatgttcactgagcatcaggtacaaaaaggttgcagcccaggcatttcacagtcgcccaggcactcttcatagatgcaggtgatggaaaaggccagcgtgcaaggactcagcaaacacaccctccacgggaggccctgggggcacctcggaaagatgttaccatcattcaacgcgaccaacagtgccacactggagtgccttctgggatgagcagaatgcctttagaccagtcacagtgtggctgcttccgtccaaatggcgctcggcatgggcatggtttgatgtgtgccccccacccctgaaaaaagacgtgttgcatgtcttgacttggaaacatgtgacttgacttggaaacaggatcactgcaaatgtgattagttaaaacgagatcacagaggaggcgagtggccctaatccaagatgactggatgaccacctaatccaagatgacttctaaaaaggccactggaaagcagacacacaccaagaaggcggccctgagatgatggaggcagccaaggagtgcctggggccaccagaaaccagaaggggcaaggaaggatcctcccagggcgttggagagagcttggtcttgcccaggtatagtctcggaaatccaccctccaggactgtgagagcataaactcctgtcggttaatcccacctgttcgaggtagtttcttacagtagccccagaaaactaacccagcatttagtttttactaaaatctcatcagtgtacccaccatggccaccttcaagcctgtgtgtattacacactgagttccacaagacagaaggctgtggacaacagcccccaaacccaagccggcccacactgatggcactggctgggcccactgtacctgcagaagacagaagcatctgcaatacagaaatcactcagagcttagacaatgagaaaatgatggacgttctgtttaaaaaataatcaccagccagggcgcagcagtgaaccagaaagttctcagaagtcctgaaaagtgggcaagagatgggcctggcttgtagagaaagtgacttcaccaaataccagcagaaagagaaagacttctcgagggaactagagagtcacatattataaatagtagcgagggtcatggagaaatcaacaggataatgaattctctgctctatgtggagtcctggcctgctgagagcttctgatgggtgcacctcagattaaaaccagggaactcacctgcggggaagagggccccggtgtggtgctgtgaggggctgacaagcccggcctgtcctctggatttacaggggactacttattcacccaatctatgggctaggcagaatctgtgaatctcactttacataagggaactaggaggtgagaacttactagttattcttataactaataagtgaggagctggaatgtgaacccagaagcccagagtcagtgttggtgaccattctgctgtaatgcctgatacgtgaggggaagaaatcagaatgtgaatcagcgcctgtccttatatcaggcccggattgatgagagggacagaagcacagaaagggacgggggagggcaggcagggcagccaccgcacagaactgtactacagcgcttcacttccaggagagcactcctacctgcccacctgcggtctgcccttacattctacagggcaacggctcttggctatgtctactgtgactcaaagaacaggccttcggggaaacagatcatgccagcgatctatcctaattatattcctaattatattccttatgaatcaataacaaaaggatcattagacatcggagaccaaaaacatcagcacaaaaggttgaaggaaagtatgtttgaaactcgaattcaacatcaagctgagacagttctcacaggaacaggacaaacagacgtgttagtcactcaagacctcagagctcaccactgatgcaacctcgacagacaccagtgagcaaaagagcagttcaggagaaaggcgcaggacacagcagaaagaagctttccgatgcagtgtgagcaccaaagaaggcggcatgaagtcaaaggagaattcaggggcccttaaatcccaatcaaatccccaacatatacttttggattctaagcgtttggaagaaaaattctttataggtaataccagagctaaaagagaaacagaacagaatacaacagaacaaaatagaatagaatgaaatagaagagaatggaatggaatggaatagaataaaacagaaaagaagactatataaaaacagaacatttgacaaaagtagtatttcagattgtgggtaaatagctagttctaaaaccatatgctggctcacactacagtcaactggaattattgtgatcaagtgttaacagagtaaaattataatatagccagcacagtacaggcaaccaggtccacaaatctcagaatggtatcgatttttcttatgcaggtacaacagcaaagagataatttataaaggaaataatttatagatttggttacattaaaattgacgtgcgtcaaaacattccattaaaaaatgtaaacacaaactggttttcggaaaaaaaaaacttgcaaaaggcaagagctcttaatatataaagagctcttacgaatcagtaaggaagacaaatagttcaattaaaatggcaaaagatctaaacaggtgattaacacaatcaataaacatatgaacaaacttcaaactcactaatacttaaaatgtatatttttaatgtgtcaaacttctataaatgataaaatgatatcaaaaattctgagaatataggagagtaaaaatctcagataactcaggtaacactatcacaaatgtaaatgcacagaactattctgttcatgccattgacctaacaattccattcccgacaatttaccctaagagaataaaagtgcacggacaattctgtgttcaagaccgttcatcataggggttttagtaatataaaaatcgaaatgaatttaatattaaaatatatgattaactaaatacagcttactttatttgatgtgtgaccattatacttgtatgtgtggaatatttaatggtggcggtaaaattctgaaaatgtcttggtaagtgatatgaaacagtttctagaaggtgattcaaatttttaaagaactgcacatatgtatacatgaagaaagaatcagaggaaatcaaaaatttaacaagggtcattctaaagtagaaaatgttaaataatttgagtttttaaaaatttatttccctcataattttcacaataaaatgtgttattttagtaagcagatcaaatatcttattaaaaaaattgtcacgtgaaaaaacaaaacaaaaaacttgtctgtccaaacacattttcttttttttttcttttttgagacggagtctcgctctgtcgcccaggctggagtgcagtggcgcaatctcggctcactgcaagctctgcctcccgggttcacgccattctcctgcctcagcctccccagtagctgggactacaggcgcctgccacgatgcccagctaattttttgtatttttagtagagacggagcttcactgtgttagccaggatggtctcgatctcctgacctcgtgatccgcccgcctcggcctcccaaagtgctgggattacaggcgtgagccactgcgcccagcccaaacacacagatttttcaaagatctgtcctaaactatcactttcatagtgcttttctgctataaggttctcagaacaccaaagttctttccatccagtatttactgagatgcaaagaaacaaaagaagtaaaaagataaaagaggcaaaataacataatggaaggagatctggaaactgggtctgggattctaacattagtcttgaaattaactggttctgtgacctaagccaaagttcttggtcttggttttctcacccaaataaacaaagaagttgaaatgaataatttttttttgtttttttttgagacagagtctcattctgtcatccaggctggagtgtgatggcaggatctcagctcactgcaacctctacctcccaagttcaagcgattttcatgtttcagcctcctgagtagctgggattacaggcacataccaccacgtccggctaatgttttgtattttagtagagactgggtttcgtcatgctggccacgctggtctcgaactcctgacctcaagtgatctgcctgcctcggcctcccaaagtgttgggattacaggcatgagccaccgtgcccagccaaaacgaataaactttgaatgcaattttgtaccctaaagctctatgatgctatttcataattcccaaaaagccaagttcaacgacagcaaagctgcccagggaagcggttgtatcctccacccgcacagactgcggctgtccactgggacttcaatccccagatatgcttgtgattggaagccctttttcctctctgaaatttcaaaaggtgctgcagtcacagctggttctattttgccactgacaggcagacacatatttttatgcattagtaaccttaggaatctcagcccctcagtgatgtgagtcaaacaaacacatttcatgtttctaaggagagaatccagtctaatgttaaatgatcttaaggaagtcattctgtccttacatgatctaccagtcaaggaagacaggcagaaagatataaaagaataaggatgggtacacataaaactacttggaggaaaactcccttcaatgtattaccaataaaggaatggggttccctcatcagtcagtcctgagccaagcaaatccaagcctggtcagaggccaagacctctgaaagagaatggcttttagaacttattgtaatagtatccaaccagttttttaaagcttaaaataagatacacaaggtttggatatggaaatctttgaagagtcattggtatcttatctcacagaaagggaaaggctttcaatgggtttaaaatatgtgacttgcactgtgatgccaggcaaactgcactcactagagttgatgtgcaggaggtttggaaggcggggcggcctccagacaggggtcacaggccatggggaagataggcggtaaggtccacgtgatgatcaaggaaggaggtcggtttgagtttatggtcaataatactctgtgtgatgattaatactgactgtcaactttactggattgaaggatgcaaagtattgttcctgggtgtgtctgtgagggtgctgccgaaggaggttaacattcaactcggtgaactgggagaggcagacccaccctcaatctgggtgggcaccatctcatcagctgccagtgaagctagaataaagcaggcaggagaagatggaagagcagacttgctgagtcttctggtcttcatctttctcctgtactagatgcctcctaccctcgatcatcagactccaagttcttcagtctttggaatctaagacttacaccagtggtttgccaggggctctcgggccttcgctcacagactgaaggctgcactgtagtcttccctaattttgaggttttgggactcagactgatccaccactggcttccttgctcctcaacttgcagatggcctatagtgggactttaccttgtgatggtgtgagtcaattctccttaataaactccctttcacatatacatctatcctattagtcctgtccctctacagaaccctgactaatacactctgtgaggaaacactgggcctgaatatgggagacaaacagggtggggggtttccaccactgaaatctttactgtgggaccagcagagctgtcccaccgtggatggacaagctatgtaggggtgagggggatttcgaggggactgtggtgattcaccacagatgcgccagttgggagctgcagagagaggcctgggtgatgggcacatgtgatgtcaggcacagtcatgggaacagatggagaaaggacacggggaggggccacagatgctgagaaccagcccatggtgttcacccacgaaaacgagaccaagtgagatggagagaaaggaaaagaaacaagatagtgcacgccatgggaggcaagagaggggcacaggtggctggggacataggctacgggataagtcgaaagaatggagtctctagagggcagagctggtggcgaggcaccccgtgaggccccaaaggacacagcccccgaggacgaatgggactcaacaggtggagacagctcatctctgaggaggtggcagtcactgaagggagaaaaaaaggacaagagacaaatgtgaagccaacacctggcagccaggccatgggggccatttgagcatctctacaggacacagagctggggaaaaggacggcagtggagcgggtgctgggctgcagggtggaggaggaactggcttcagaaggaggaagagcatctcttcttctgggaaaaaaggtaggaggattggaataaagatagaggagacatttaacacataaagaaaacgtaagccattttggaaacaatcgttctggaatgcaatgatcatggagctgataacatgcaagattgcagctctaatagacactgtaggcaagccaaaattttcatgaatttttcatggatttaactagtagcctcaaaatgaccatttcatattattaaacatcaagagacaagaaatatccaatgggtgacggcatcatcgagaagagaatagaaacagatttccggagtccacgggctggtgagatgctctagagagcaggactctgctctctggtgtgccagccccagccgggcaccgtgctattgttggttttcatcacccagttcctgtcagaaccactgcagtcatgccacagacagagcttttgtgcaaatggtattttcttccctattaaaatgttctactctgttcccatctaaatgggtccaggagcagtcccagagacacctgcaaattgcacagaggcatggtttgatttcacatgctcctgatgaccataattgttgctattattttccttactatttcacctctcaggcagaaagtaaacaaaacacttctcaggagagagcggggagaaaggaagagaagacattgtggggccaaattggagcacaggacggcatttgttgaaccgttctgatttcctttgatgctttccctccctgctgttcaggataatgccttgttctcctccctaacttggtgtggaaggaatccctccaaaaggcaatgggggcagacagaccacgcttttattttcttataggcatttatgttcttacaggaatggtttagagaggcttatggatgaattaaatggtttgcaaaattaagactggattctctaccaagtagataggcagggacaataaaggaataaaaagccacatttggagctaatggcattgcaaaaccaattctggatggagaagttggaatcagatgaccctctgaacttgaagacatttggtgaaacagcctggagtctgcccatcatgcactgagtcacgggtggttggtgtgggtagacgctctaaacattttggctctaagcgcctctgtttatacaacattctttcccgttgcgtcaggaataggaagcctgttttctctgagataatggagtcaggaagagaaatcatgtcccaactctggtagattttgtggcagtccaggaaacaacaaggcttttctttgtataagcacacagcaccgctctttcctacctcccttctttcctgcctccatccttgtattccacagctgatcaggactcagctcatccccatcagacacggctcactctcaagtggtcctccaggtggggttgaaacagtggggtgtccgatgcccaggcagggcccagcccggcctgtctcaggggttactgctgcttgtccaggtctgtaactattgtcccaggttcggtgatcaaaatctctccagataaatttcatcctaagaaataattaaagaatccagagcaggagtcacctggtgcgtgccatatgtaaacaaccactcttgaggatgtttgaagaagcactggattggtatcaaggactgaaagcaggtagaggtttttagaaaggtaaattctgctaactacagacagggagattggaaattagcttgacaacgtcttagggaggaagcagtgatcaacaataatcaggagagtcatatgaaatatgtgctgatttccttctctcctctgatgaggttaccagatgggtaggtgtggggaaaatggtaaacagtgtctctggttttcaggaagaatttaacaaggttttctcattatatacaccgaataaaatgaagaaatgatgactggcagattaatagctgcctcaaccaaagggaagtaattaagcaatccatgtcaaccaagaaggcagttctgagggcaccctcctggctagctccattcagccttctcattagcgccaggggaagcacgaagcttcatgacacggggaagacagcaggtcacttgcaggatgatgggatatgtatctctaaaaataccaaccaacagacgcatgaatttaagaacaaaataagagacataaatgcaacatcttactcttattaaacaaaaaacaaataagctgtagggggaggggccagattagcaggagtgttagcccaatatgcgctcagtaatgtgaggatcgtgttaagtgctgggagaaacgacacaggcttctgtgtgcatcttcccaaggcaggtctccttcccactccatctccatcctccatgcgtcactctcaaggcctagagcagaagccaccatctccctgagccctgcctgatcacctccctagagtagctccttccgtcatgatccaagggacacccagcctcccctcctccgtatatgggtgagggtggtaagtttgtttgtttgtttgtttgtttgttttgagacagagtcttgctccatagctgaggctggagtgcagtggtgccatcatagctcactgcagcctcgaactcttgggcccaaacaatcctcctgcctcagcttcccaaataggtgcacctactataggtgcaccaccacgcctggctaatttatttttgtttttagtacagacaaggtctcactatgtttcccagaccagtctcaggagctcacgtgatcttctggcctcagcctcccaacatgctgggatgacaggcacgagccatcatgcctggccaaggttactgtttggcatctggcttcccaagtggaccatgggctccaagggcagagacgatgtctgtcttattctcagatgtttagccaggcaatgcctggcaccttgtagaaactcaatcaaggcttgctcagtgaagataaatgaatgagtcaccaccatcagatgtgattttcttccgatctaaattcacctggtttccctgtttgacacactgtcttgggaatttggaaatatcccttattcctgatgggttttgagatcctttagtgcaggaagtccacctgattatctttgaataagaacctacgagagtctaaaaactggttgcataaacaaatgggagaagaaaacactaattcttttaacatacaagttgttgcacttgccctattttcaggactaaataatatagctgcatgtagcgtatttgaagtaaaatgaaatttcagatgtgtagaaatcagtgaaagaagctcattgcacaaagtgaatagaaatggaaaatggaatatgcatgcattttgaaattggtcttatcaaaatcagtaggaaattaaattttaaactcagtcattcttattatattatccctattgaaattcatcttgcttttgcctgtaggcagggagcaatttattaaaatactctgcatatccaatatttcttaaacaaacaaacaaaatctcttatactcagctcaaaaagatggtgacagatgaaggaagaattagaagtgttaaaaaaagaagaaaaagaaaaaacaactaaccacgtggcctatcttagaacctgactgatgattccattcagataatatttcttgggcacccacaggccacaagccacatgacattagatagagaaaatgatagaaatcaagccatatttctctacttgcaagcaagttatatactagcagatacatacaatacacaaaatgctcttaaatccaaataaatcacattttcatgatgcaaatactgacagcttaaatcgacatagcactccattggttacaaagcacttctacctaaaacatcttatttaatttgaaagtaagttaatctagttaggttaaagagttgtgtcaatcgcaagttgtctccaaaagctacctggagcataaagaaccaagaagagctacgacaatattgagaaaacccgataagataaaggtaggagagacttgctgtattagctatcaagacttcttttaaactgatggttaataggacagtgtggttttgacataggttagacacatgaaacagaatagagccagaaatactccatccttatagggaattgtgtgaattcagaagtgcttgcaggtaaatggagaaaggatgaacaacacaataaggggcactaaaaaaattggttatcttatttaaaaagcagaaaacaaaactagttccattctttacactacacaaagaatgcaagtcattaaagaccaaagcgttaaaattaaaactttaaaaattttagataacagatcacttttacaacttcagagtgaggatagacttcttaattaagacacagaaagcatataatgtaaagaaaaggatgaatcaattcagctgcataaaaatttaaaacttctgtataaaaaagtttaaaagattggccacaaacttgatagcatttacaatgcatgtaactgatgaagagttattatacagaatatgtaaagaactcttataaattaactaaaagaggcagagaaaaggagaacaggaacactgtatagatggggaacgcaaagagaactatcaatgcccctgacatgtgaagggagtctgaccacactggccatcgggcagtgcgtgttccggccacggtgggacaccatctcacacacagccgatgggctgcgactcagtgcctgatgtcctaccaacagcaaggagggagagaatgagaactcacatctactgttggtgggaatgcatcttatacgacgactttggaggaaatttggtaacatttactatagttgaagatcgtgtgctccatgacccagcaatctcactcccaggtatatacccgagagaacctcccccaacacctgcccctacggtgctcaagggatggatgcacaagatcattcatggcagcactgctctcagaaacaccagaaggaaacaacaagcatccagccccagggcaactgacacaggactgttggcacagtcagatgaaataccacgcagaagcaaacataggaaccaagcgctacccatcagcatggatacagctcatgaatgcaacctggaacaagacgcattcatgcatacacgagatgactccatttatatgacacgtaaactgcaaaaaacaatacagtgtttaggatacacacaataaaacaggaagaaatatacaggagtggtagacctcaaatccagggaaatcgtagcctccaggtgggagggagaaggatgagactgggggaccataaatggtgttcaactgtatcgataacttcttgatttcttaagctgaatttatgggtgcaaaggtgtttcttaacagtattttgattcctaaatatgtctgaaatatttcctaagacaaatttgaaaagggctcaagtcaatatttctgttcactgagtagaggaagttttctgcaagccaatggtctatccacagtgagaatctggagagagagagaggtgttggtcaggggcacctaggaacccattctgctttcaccctctggatgagttcattcaaagactaagagacctaaacatttggaaatgtaaacattcacttacatctgcatctgttaagtgttaagttctgacatgagcttagtctaaaagggatctgggcgggatatcaagaaccaaacatcacagatccagaaagagccttccctctgctacttccctgtctgcggtctctgcgtgacacaagttatggtttctaagggacagggaagcttggctgagatcactgcacctgctctcggcttgtgtgggccatggctctttcaaaaaagatcgtgctgcttagcataattaaaccaggaactcagcgcagcctcagagtgcgtggggtggggcagagctctgggaggccgagtggtgacttcctccagtccagcatccaccagccacacgggagatggtgtgggatgtgggatctgaaaggcttcatttggcctcataaatgggattagcatgggggcagctaccgaccagtcaccttctggagtcgagggcgcccaggtaaagggctttggcatggaagtgcaggttgctgaaggagtcatgggaggggacatgacagaagatgcttccacctgggcaacacctgtcattgggagggcatcgtgaacatggctggcacattccgggtgatctaaggctcaagttagacaaagttaacaggcacaggaaggatactgaatattgcgaggttgcagaagggaggccagggaatggctgtggcccaggtgtatcaaataaatgcccccgtactgttgtttgcgataacaagtcaggggtgttagaggagccaaagaccccctcagcacccaccaaacgggcaatcgaggttgttttaggcagaaactggattgccgcaaagctgacatgttggaaggggtgagatgagagctaagaacttctccaactcgtcctaacgtgtccctcctagaagtcacgaagagaaaagggcgagactatgaaacaaagtgtgtaaaggtggaaagaagtaaaaataaaattaagaagagttccatcctgattaaccctccatggaaaagctccagagaaggtgcctctgccaattgaaagtttttcactgtgagcaactctacgtaaaatgcatctggaccagcacattcccctgtggacagctctgcatggagatgtgacggggacaaatgatctgggaaatcattgttttcgtatcagtgtttgtaagtttcagagtttacttgaatgggaacataacagctcactaataaaaaatgaggaatgtcttactttttttaaaaaacgtttccccaaataggtttgcttatatgatctatttgggggtttggaatgagtatgtggaaaactgaaaaaaaaaaaattcagaaattaataaagacataaactccatgttttataatgcccagagtggtgcgtgcttccccgctggggtaactgaagttgccggagctgggttcactggggatcgtaagggagcttcccgggcggggccatccccagctgggggaggtggcatccaggcacctcatatgccgtgcctcgggccttacctgagcatcagagtttttaaaagtccttctgtcatgggcttgctgtaagaagtcaacataaatatggacagtgctcagaacatggggcgcctgatgtctggagcagcaaactgtgatcaaacactcatatttccacagcaaaataatgatccacactaatggaggtaaagaaggagaagactacgagccttcctcacccaacgcagacctaccagggctctgtgcgccagtgccacaggcatcccttgggtggtcacgtagcctaaaatacgaatgagactaaatatagggatgtgaaagttctgcttgacacttaaatgtgcttattaagacttaatccaattatattatcgggattgatatctataagtctctaatagacattcctatttaagttttaaaatatcatgcttcccacagctggcccctcaggccctcccgttccagggcttcactgcgaccacgtggcactcttcactgggaatatccctcttgcctctcctagaactgcctccaaccagattctggcgggagatgatgcaacctgcaaccaagtcacctgcacaggggccctggcccccaagggccttgggtgttgccagtagatccatgttcattttatcaacgacattctacccctctaaagccacattgtgtttgcaatctacaacaggtagatgacatcaagtcttacagcatttacaataatttcaagacaatgactcttatctccttaattagattacgagctccttaaaaggcatcccttgggtggtcacgtagcctaaaatacgaatgagactaaatatagggatgtgaaagttctgcttgatgcttaaatgtgcttattaagacttaatccaattatgttatcgggattgatatctataagtctctaatagacattcctatttaagttttaaaatatcatgcttcctatctaggcacgtaaaatgccatgtgacattagaacaaaaaattagcatgtagaatgattagcatgtgaaatatgatattagaacaataaattaacatgtagagtatgatttaatgtgaaagggccacgtgaggtggcattttagatagaaatgcactcacgcacacacacaagcacagatacacctccctccacacattcaactgagatctttcaaaggtgacatcaaaataaaaatagcacacaaattttatggaaaagagcaaatcaaaagattgttttctgtagtgataagacctgaaatgaaaacacatgaccagtggtggagacataaaggcattacgctgcccagaggcgcagcaaccaaaatagaaagctctttactttgcaggttgatgtgatttagcctaaggcactaaatcagcacctgttatcagatcacggtccttgggtcctgatttccttctgccagcaaagcaccttgatgagtgtctacaagagggcaaaggcagcataatgccgcccatggtaggactgcggggctgcacacattaggctctttgacgcttttattacagctacagcccaaggatgcagttccaactcctgcccttatgaaaataaaatggtgcacaccatacaagactatttaaatagaccagacttcagccatctgcaccccacttcttttgagacccacaaggtcggagtgcttgcacgagaggtaaaatgatttccctggaaacacgctcacctgtgcaccatgagagacccaaagctgaatagccctcttgccttccttgctcgattacacaagaaaagcaaaagcaaaaagcacctggcatggtgaatttaattctgcaaaaatatatcctgaatacaactccctattggaaatgtgaatatctaagcagcgttgtgtaggcctttcaaagcgactgcaaattatggtggaataatatggttaacacagaagttatggcatttttgctgtaaacaataccatcaagaaaatgaaaatacaacccactacggggaaaagtatttgcaaataatatgcctgagaaggcacttgtatctagaatatatacataattcttataactcaacaataaaaagataaatcacccaatttttaaaaatgggctagtgacctgatgtgacatttctccaaaaacatacagccaataaaaacatgagaagatgctctacatcatttgtcatcagaggaatgcaaatcaaaaccataaggaggcaccacttcatacccaccaggatggctgtattcaaaaggtgaacaataacaagtggggaaaaaatggatctcggctgggcatggtggctcacgcctgtaatcccagtactttgggaggccaagatgggcagatcacctgaggtcaggagtttgagaccagccttgaccaacagggtgaaatcctgtctctactaaaaatgcaaaaagtagctgggtgtgctggcaggtgcctataatcccagctactagggagactgaggcagaagaattgcttgaacccgggatgcagaggttgcagtgagccgagattgtgccattgcactccagcctgggcaacaagaggaaaactccgtcaaaaaaaaaaaaaaaaaaagctccatctatcactgctgggtgggaatgtacaatgttgcaatcactttggaaaatggtctagaagttcctcaaaagctcagacatagagttgccatcccagatccagcaattccactcccaggtataaacccaggagaaataaaaacatatgtccacacaaaaacctgtacaaaaatgttcacagcaccattagtcacaacagccaaaaagtagggacaacccaaatgtctatcaacttactaatggattaaaaaaatgtagtatatccatgcagtggaatattacttggcaatagagagaaatacctgctacaacacgaacgaaccttgaatacatgaggctaagtgaaagaagccagccacaaaaccccacattgtatgattccgtttatatgaaatacccagaataggcaactctacggagacagaaagtggatgtagggctgcagggggtcgtggaggggaaaagggggacagggttctgttctgaaggacgaaaacattacagatgtggtaacagttgcacaaccttgtgaatacacttaaaacatggaattgtacattttaaatgggtgaattgtatggtatgtgaattagatctcaaagctgtatgcaaaaacagaaacaaaatgttatggcattcagggcaatttgaagcaaaacaaatactgagatggttcttcagaagggactttcctttagccgggcaccaggtggcatgtacctgtggtcccagctattcaggaggctgaggcaggaggatcacttaagcccaggaggtggaagcagcagtgagccatgatcgtgcccctgcacttctgccagagcgagaaggcaaaaccttgtctcagaaagaaaaaaaaaaaaaagagagagagagactgtcttggtgccttttattatagtgcatcttgaagaatggaggggagtgccttcttccacacatctagctttcattctgagtccatactcaggacagatttggaatttttcacaaagactcccaggaggcaatggcttagtgtatgataagtaatttcctcaggatatttgcttcctggcaacaaaataaaatttagaatgcaaacaatatggtatattttgaaacagagtcccccagagggtagacaacgcttctcttagccactgtatagaacagtctagaagttggataaccttatttgtatggtagtaaccaatatctctatattcatgtgaattcaatccaatttggtgctacaaaaattaaaaatgcttgactcaaaattcttacatctaacctgactcaacaatccatcggcgcatgaaaaaaaaaattcccctttaagaatttctagttattgaattcaggattgtttatctctgagagggagacaaaatcagaagtaagtttggagtctcagggaaaacataacaagttgattattgtttaagtctaaaaggcaccaaagcacttgtccctgggtaccactcagatgcaggcaacattcagttaaagtgcctcatggctttttttcctatgaggcctacagaatggtccctcacaagttttctatttctgttctgcttcaaagaaagactttctcaacttttttagggctccagtcctggcccatcgtggatggtgagatattctttagatgtttgttctgtttttttttaagttgatatatatttaggcccaaagtcatgtttattcacaaatccaaacaaccggcaagctaaggctaattttttcatgtagaatatttatgaaagaaaacaatgaataaacaacttaagattggggatttactctgaagggcactttccggaacatgtcataggctcagccccagttcaaccccatctccactgcggtttggaaaattgtcaggcctgagagagagcaaggggttctgtttactccactctaggattaaggaatggaaatatagggagagccaagtaaggaggttgtgactcagttcctccccctggataaatgtctgcacagactttagacttctggttttcaaactggggttcaataggaccctgagttcagtggagtgggaggtactacagagatgaagcagatgcccctaaaaagtggctctttctgcataagatgtttaaaaaactgggttccgggtgtgagataaatggcagaaccttgatttagatctactttcggggttgttacagaaagatctgttgggctgtctggggtgagattagatgattctcattatttttctatggttaaaattgctatagctaccatggtgtattgcaaagtttggtacttatatcaatgactcaggagcactgagacactgatatactgaattatcaaaagtttaattttttttttttttttttgagacagagttttgctcttgttgcccaggctggagtgcagtcttggctcaccgtaatctccgcctcctgggttcaagcaattctcctgactcggcctcctgagtagctgggattacaggcgcatgccaccactcccagctaatttttgtatttttagtagagacggggcttcaccatgttggtcaggctggtctcgaactcctgacctcagctgatctgcccgcctcgtcctcctaaagtgctgagattacaggcgtgagccaccgtgcctggcgtaaaagtttaattttatttagacaagttttagtgtcaagtatattttattaatctgtaattactcgaaaatgggaaatttacaaactggaatactcaggcaattggaaaacatctccctacacttatttgaagatttaaaaaatgtattagcttcggactagttattcttgttctcttttacatatttttctaatcattcctactcattttctcatcttgatttttttctctcctcctatctcctcattatatctcttgctatttagttcaacatgagatcttttacaaccaaatagcttgctagaaacagcaatgcttcatggtaaacagcgtgagggaaagatgttctgaaatggttatataagcacgtgtggcatcaactacaacgtgaggcacgtcatttgatcaatgtataaatagcaagtcgtaaatgattctttccactcctgagcagcctggcagtagcacagaaggtaaatgcaaatggccttccgctcctttcccgtgaataaggagataatcccaccaacataggccttggcagcaggaagcgcagcaggaaattcatgtgaatttctgaattctgagagaactagttacccatcggctgtagcaaaaatcaagaacaaaattcaaaggaaagaattcatgatggttaatacagataaaacctatgcaactgggttacacacttcatgaggccaaacacttaaatatgcatttagcataaaatgtgtttctgccgagggccatggaggcctccaaaaatgctactttcacccagggcccctcaggagtctttaccttctccgttgtttcctatattaataacaaattccttctactaatttatcaaaacataatcactgcagttaaaaggcagcgctgccaaatatttgaccataaaatcatatggaaagtagtggtaaagaaataatgttaccatgttttcataaaattcatcctaccaacaaatatatgcatatacaattattacatttattatagagttataacagaatagtttttaaaactggaaagccacatgtaataaataatatacctttcctaaaatcagtacttatttctgtctttcttttttgaatcctcacttctttaaattactatctgcatattctggattttagcctgggagagtattatgagaatgagaagtacaaagaaaaagaacaaaagtatccttaaacctactaaataccctgaaaggataaaaagaatgattgcagacagataatatatttatttttttcaacgaatgaaataaatttaatcctatttatcccagtttactatctcaaatagactggtaaaactgaaaaagcatttctactatgttttgaagcaaatttaaaagtattattatattttccaaatatacatcctattaagacatgcccatatttttcacatatagccatttagcataatttcaacaagtccaaagctgctaaatataccatatgtgcccatttattctaatgaaccaataacacaaatacattaccagattcatgcccctctgctcagaaagtatcactagcctgtagctgctgaaaagctgttccatctcagtcacccactccaccatcatccgacatgacctatcctgctcctggccagaggaccttttcaacattggattccaattcctcatctaggcaaaaggtatataacatacttatcctcaggcaagcttcttgtacagagtgaatgagataaaatatgtgtgtcacaacgcctttatctgtgtcagagaaaatccaaatcaaactggcttaaacaatgaaagaaattgcttggctcatataactgaaatatctcaaggtaatgtggacttcaagctcaggctgatcagggctccaatctcatttctctgtggatttcccagctctttcctctcgtgtgttggcaccatccttaagctgggtaacttatggtcacagatggctgcaaaaccgcaagtcaggactccacgtttccatgtttctccacagccactgggcagggatctcaggttacatcctatttgaccatcttgggccacattctcaaccctgagctcatccctgtgaccaggaaagtgccatgggtagggcacacacgcccaggatgcagatctccctggggccaaacaaacttaaaaacaaaaagtttctctaaaaacaaggtaggcttggctttctccaactgcctcatcctctaattgcacagaagaaatactgtgaatgaataaggcatccaacccattctccaacacccctttcccaggcctgtttgttctttttcctcttatttttcctccgtcgtccaacatcaagatgcaagggccgcaatctgagtgtgagggccagggaactcactgaccatctgggggggctctaggaaaagcctggaagagactctctgtgggaagctcaggggagtcaagccccttgacgaggtgtgtgatgtgggcaggtgtgatggaagaaaagagactgggacttgtcctttctggcttctcagtggtctgctcagagacgtttatcctccttgcagctggtgcatgagtgaaactctgaatttgtagttttccttaggagaaagatggcatgcacccctgggtcacctggcaaagctataacacacggtggctcctgcagacccctggctcccctcgcgggcttgcaaccaggcactcttcctctctccctccatgacagaccagggcgaggaaaggagaaatgatgagctctgagctggggccttgctgcccgactgcctccactaatcctgctcatctgaccgaggtcagacactgctttgcagagcccgtgggctgtgctccatttatcactctgtccgggcgtctgttgttacccatgctcgggtaggaaaatgctgagtgaaggtaacaggactgtgcagttgggaagctcatctcctcttacatttggatgttttcccaagtggccactgccaaatttactccacatcagcctctctctctccatgcccttgacctgtcctcctccctctggccctgcgcactacgtcccacttgtttcttgactcttctccactcttccccttctcttgtctttcttcttcctgcctcttctctcccctctcctcctgccctttaattattgtttaaaagacagatgcttgagcagtgtttcccggacctcccagagaaagctgacccagaggacacggagctatccatttgggtggacttttcagggcctttccctgtatttcaagtccttagttaaaagcacgtgtctgaattttctaagttaaggggggaggtttgatttagtgatcagaaaaatttccagtcctgaaacatgcctgcttttacctggaatccttcactttcagtggcatttgcagtttgacatgaatgcttccggtgctgcatttcatagacctgctgatttgtagctcagcctgtcgccaccattcaggcggctggggtgcaagagctaggagcagtgctgctgaaagtctttaagacttcagtgaagcaaacagattgcagtataacgagaaacatggagttttttcaaaacaattttgtctactgctgaaatttgcaaaacacgtcaccgaaggagtctcaggttgatcctgtacagaggagagctctgacctgcctcactaacccacaccctgagctactcaccctgcttcacggtcacgcctgtttctaaaaggtagctcaggctgaagatctaggagtcatctttgatttttctgtcatgtatagtgtgtccaggctatctgcaaggcctgtccaccctggtgtcggatggcagctccgagagcttgctagctcagtttcttctctgccagccttcaatctaattgcacgcatcacccaaaggatccttttaaattgagatatgatcccatcactcccttatgtgaaacattagggctttccacggccttcaggacacagtcgggctttccacggccttcaggacacagtcgggcttttcacggccttcaggacacagtcgggctttccacggccttcaggacacagtcgggctttccacggccttcaggacacagtcgggctttccatggccttcaggacacagattcctccccaaggccccaagagctttgggctctcacagcccaccccatcttccccgtctttctggggacactgacttctggcaggtgccagatgaggccaaagcccagtcagctcaggaaccaggcttgagccacatctcccccagaaactctgccccacaccctctaggggccaatcacctctttcattcagccctgcggagatgtctccctggactgccctctcaaacactgtcctcctctgccactcatggctccctgccatgccttacaatttgtgtatgtttgagatcagtacatttttctatgtagacttgatttgtagacagatatagatgcagccgagcttcctacgcctgtcggaggctgaacatctggctctggaatgccatgtggacatctagtgaacacctcgagccctctatcgtaatacctcgagcccccattcccagaaggacactgggacacagctgtgctgcccggcccgcttcctacccaggccccgagggcaggtgttcaccttctgtgaccaggccctgccctgccctggcccctgcccgtgtccctcccacactgaggccacagccctgcctgcgtcctgtctgctgcatcttctacaacatgctatcttcctcaaagctgaactgaccagaatattcgctttgtcttgctgctgtgacaaattccacaaattcagtggtttgaaacacagggttttccctcccagttgtggagatcggaagttcgggatccattttgctggtgttggcaaggccggtccctccggtgactccatgtccagccctgggggccacctgcgttccttgctcctgacccttcctccacccctgtaacctctgcctccctgtcacaccctttcccgcttctgcaatcagacctcctctgcctcctctcacgaggactcttgtgattacatttagggcctccccagattatccaggaacatcacgccatctccaggtccttaacttgatcgcacctacaaagcccattttgccacatatgggaacagctccaggttccaggcttaggctgtggctttctcgaggagacattatccagccttccacacccaccaagaacaccaggggtctacacctgagcacctgcgtcagggctggatgtggggctcagccggatgaagcccaggtcccgactagtcctactttatttcctgccattgaaatcccagcaggatgtggccgcattgttcattagcaccttttttcagaagttcagttctgataattaacattccctctcagctgactcatctgactgggaaacaagcatagatagatgttccactgggggctgagccatgcgactcccgcaccacacaccagaaagaacatcgtgtctcacactcccaggctggccttccagccaccgtggactccctgtgcacagtattttggtcacaggtcacaaaagcaaaaaggaaacgtagaggaagaagatgtagaataaagggaggagtaagaaaagcatttctgaagatgattgaagatatcggaggggatgcctttttctttttaatgaaaggaagcagtggacaaaggccaggctgacctgcccagtcacatcggaaggacctgctgaccccctggggccccagagatgcccggcctttcccgcttgaaacacaaacctgcggcgcacaggccaacggtgcccacacaccgtgtgctcgctccgctcataccaggtaggaaacagcaaaagcaagagctgggtgcaggtgctggaatgagataccgatggtctccgggacctctctccttatccccgctctatcctgtcctggaccatcttgaacatcagagagggagagcacacccccccaggatgggcgctctgtcccctgtgctgcctgtggggtctagacaccattgaggacttgcccactcagcgcaggactcccgcccactctttgccctttgtgaacaaggggatggatctgctgcatttgggagacatctccctgcatacacaggcctcactgcagtcattctcattcaatggaattcagcctaaatgacgacgctttttagacacccaatccctgtaacagcagtccctgcgctaggcctctaccgtgtctcttgccgtaccctgccacccactgtgtgtgggtgcagggacgcagcctcagtggggagaaggtgccagtcagaccacaccccggctgacctgccatgccacctgagagccccccagcactctggagtttcatttattacgggtcagaccctgtaaggcagatgttatactaattttacagagaagaaaattgagcctcaagaagttcccattggtgaccttgccaaagtcatatgagtgccacatagcagagccagaattcacaacatgggggctacctccaaagccccaaccccgacgcatggatcacaggcaacagctcccctcaccagctgcaggagaaatcaccaccaccactaacgggacccgccctgctcaccagcagcagctctcatgcctgcctgaggccatgtcaaccgagtcgctcctgtccagcaacacgtgttcacatacatgacggtacagttgcggacagctccggtaggtgcatggcgcaccttctacagcctagggacagccaggctcaagagagggagatgaacatgcagaacccccgaccctgactccggaaaatggctccaaaggctctcagctgcaggtccatccttcccatccatcctccctctgccaggccagagcccaggcccacagctctgagctgcatgtgggtgtcaggccagctggggagcagggcctgatggccacatgtgggtgtggcaggatttttgccctagagacctgggctcacacaggggcagtgagcccactgtggtgcccatggggggctgcccagcaggagccacagtgctgacctagcccagagccaccaaggcccctgacaacaggtgcctgactctcctaatctaaggtgcgccaaggcccctaacacccaagaggaagaggaacaaatgaatgtgggagaaagaactgagcccagaaggttcatgggtccaggtacaggagagcccttgacagaagcccggctctgcctgacagaaggtgccgggcgcccgctccatcgtgggccgaaggcagtcacaggctggaatgtgcagagggaagtcattcatcacagaaactcagcgtcaggagtcaaagactttaaatctcactataaatctctatcagcaatgtcacgaaggccatcttcctagaataaaacctattctagaagcaacagcttttaaaacaaacatccttattgacttttcctgtttttctatttcttaaaaattaccagcattaatacatgtggaaatctgtgcattttaaaaaatgttgatagtttctcaatcttttaagatattttgttgcttttaaaaatttttaagtaatcaaagttgttcggggattttttcccaaaaatgttattgtaagataacactagatcagctatattgtgagcctagattagacattttttctacagaaaatttttcaaggccaaacagtagttagtaagaaacccaatgccagcaccacctcatgctgttatgtggttctctcgtggcttctgagtaatttgacttacgcgacggttttaatgacctcctcctccattggcgtcaggtaagcaccactttttgtctgcattttaaccctctacacccaagtcctactgataatttaggcacgtagtgaatagtcagtccatggctaattcctaagataaaatgtcctaaatgacctccaaggactttgtacatattaacctagaagctgcgaattacatggagaatggccacgcatggctcgggggcaacggtcccgcaacagccacagctgtctgtggctgccgagcaaacgccaagtccagcctgcggcaccttccttctgcacaagcttcaccagcatttttagcggcacagaccacaaatcagcccgaggttttctgtaaattcacacacagcaaagaagtattatggggtccaggctgatgacaccattggggagaacccgtgtgctctgtcccggatggctgagagaacgtgaagctctgcagactcggagcctggccatgcaaggggacctgtgattcaggacacttcttaaaactccagaatataccactgtgggtgaccaagccttgaaactccagaatgttcccaccatgggtggccaagccacatcacagggaagaaaccttcaatgtgctttctgtgcagcacactcctctcttctgtgatctgaacacgaaccaccacctctaggctaggactcagatgcagtgagctccactatacccacagtcacatacggacagtaacttctcttcccgaatcctgtctggatccaagtgtccctgggccagagtctccctaagagacagccctgagtccaagcccctgagaagctcagggccatgcaaagcaggaggcctgggtgtggaaggggtatgggtagggcctgagaatggactgaggggcagacagttcagggaagggaagatcactggggtagagaggtgacctggagggaggtcagcgtgggcaggggtgagaccaaggaaaagattgaccatcactagaagatcaggctcacaggcagtgagaggccttggctgagtgggaggtggagatagtaaaatgaaaacacgggcactactctataactcccatggcaattcgggcaaatgcccatcacctccgttacatccaagcttcgggagggtaggacgagcgtctcagacgtacatctcttctcctgcctcacgcacacagagtgattgtggccagctcattttagcaggtcacactcccttccctccatcagttgttgttctgctgtcatgagccttgacaccgcagtacgacgcgctcaggaagacatcaggacagaggtctagacgcttacaaccctgagagacacactggacgctgcgcgcaagagccctgtgcatatggactccgattgacgccatcagattcgcccacaagccctgtgcgtatgggctccaatcgatgccatcagattcgcgcaccagccctgtgcatatgggctcccatcgatgccatcagattcgcgcacgagccctgtgcgtatgggctcccatcgatgccatcagcaaagttttttcacttctttgttgggttgtactctacaaggacttgactgagtcacacatcatgatccatgcgttttctttgttaagatctagaaataagagacagacccaacctcatgctgtgtctcgggttctctggaatgaaggcagtcagctatagtcaccactttgattcccgcagcccgtctgttcagtccctgaagtgatgagaaaccaagaagaattcaagaagtcaaaggtgttctaaaaataaatgctcttttgaaagttgttttgtttgtctgtgtttctttccttcgctatgttcaaagtcaaccaatcaacagagttgctttaacaagttacaggcaagagggcttctcgtagcacctttgcaagcatagtgtagaacgcagcagtctctccagggcttgaccctgtgacagagagcccagggccccaggtgcctgcaggagctgacggccatgtggcctgaagtcttaaggctcgtggagggcctgcagagccccctgggcttcctgcctcctcccagccttgcccggctcccagcttttctcacacagagtcctctcaaagccatcttctctgctcctcttgtgttttacccacagttcagaacaagaggcttccttggtttttcaccctcagaaagattgtccacatgatattatggatgtaaaactatttggaagctaatatgatatctgaccttagttctagagaactagttgcaattatcctgggctgagagcattaaaattgggacctgtgcgagcttcttaagtagtcgctagggcatttctaccataaccattccaaaacaaagtcattcaaagtaaaatccccccactcctcctgttataaatttggcctcacagtttaatgagtaaaagctgcaagcccacaggcccttggcaggatgtgtggccaagatgtcttggtgcaaagaatgttaccgtgcacttcgagtgcagagactgctctccacagcaggccccaggcttgcattctggctaatgtccatctgaaaattcagattgtgaaactacagcatacgaatcattccacaggtatgaggcctgtttttcttatttgtcaatctcattcaagcctttcttttctttggcaacaggaggaaatacactggccaatacctaagtactaatctttgattcattttttaaaaatcttgctaatttcatacagaagacagaataactgaaagaagaaacaattcttttctctaaaaggctagataatttctaccagtgccttctcctttctcccaacagtccccactcagccattccttgtgggctgatgccagaaacagcgtggaaaacaagtctgttttccaagaggggctattaccacgaattatgtttaaaatgacagcatcaaagattaaaccatcattgtatataaacttaacatagctataacctaggaaaagctagtttcatggtgataatactaattagaaacagatgtgtattcaaaggggcaaggaaagaggctggcaggagagaaaaaacatttttcccccataatgtagtgcaagaacctttacagatatggtctcaccaaagtcagctttgtgcaacaccacggatgccaagtgcaagctgtcctgacaaggcacatttcactgatgaagcatttaataaattgcagataacccttattacagggttacccctattttgtagctggggagacaggtgctcagaaggattcagtggtttggcaagggagacagcaagaacactagggcagtgtgaggtggctgggagaaggggcagccggcaaggtcaggcacttcccacggcaggagactggcaccgagcaggggcaggagggaaacagggacaccacctgctccatgcctgcagaatcctacctccacggggcaaggcaagggcaaaccacccagcctggggagctttgcacaccaaggctcatagaggaagactggctagggagcattcgccgaatggaatcaggtagggctctcatatcagtagcattcttgggaacaccctctgactgatctccaggaacgcatgcaaatgactgcataacatatgcaaatgactgcataacaacaggtacacatcttggctggtcggaaacactgcttctggcctgcttggtaataaatcctaggtgtatggttacgcacatttgtcctccacgccctgatatgcaggtgcctccggcttccttgtagctgcaccattattttcccctagctaagcagttagcaggcaaggcttctcacgcagctgcaagtcagatgtgattaacagtatttcatatggaatatatttgtgtctgatccatttgcttgattaaatcacactgtagcttaacagcctatttgttgataatttttacttatttgaattcaatgtaatagcttttactagtgaaaatatatcagcaaacataaaacgctgagaaaatgcaacacaacctaattcagtgtaatcagaaataaaagcagagcattctagagaatgctgctagtcttagaccagctctgcttatttaataagcacagatccttggagcaaaaaaggtagagtatttctggctaagttactggttaccaactccacgtcatacaaagtaaactcatcctggtcccccatatcaaaggagcactctcctggcagctccctgaaggtccccaaggccgcacacatctctggttgacccgaacgttgccttcatcctgaagctacagccctaaagcctctttcctccccttccccttcacagccagcagccctggaagctgcctcagagagttcatacttctcccacccactattaaattgccacttctgagaaactatttgccccacatgtgagaaacagaatgaaattccaggtaaatggtaagtcagaggatgtgaacatagttccttttttatttaatgggcttccacttcattcttctacttctgaatgcatgaaaaatagtctgaacagtctttgctgtgctgggtgtggccaaagacagtcagcacgtgggtttacggaaaaggacgggcaaagcaaaaggggcaaaatctcactacgtttagttgtcttttcacatcgtttaaaaaaacaacaacactatttcggggatttttcctgaacgtaaagagagaaagtatgtaatgaaattccaagcataaggcatatcacagaaattgtgaccacaaataaggaattaagcttaatgtctttaaaatgagtatataaaggagcaaaaagaagaacaaattccaattcagtattcactaatatggactatttattgtggtttttttttggctgtcagaaaatccaataaaattaagataaacataatttctttgggagcatttattgagagtacctgaaaattatcttaattagaaatggttttcttggaaaccacccaagatctagaagaagagctcacctatcatgccccaagaataagccttagtggtaaactttccaggaagctttctttttatccatgactggagccaatattgttcctgatgcttgctaagagtcccttcacacttcctttattaggataccatgttttccttaaaagggatgagcaattaaaatgtctttatatgtacagatagatgaattctgatgatctgtgaccaccagaaatagaaataaattgacaattgatctaatcagaccatttaaatccaaagctgccaataatttcacagcacttataccctgatagcaagcttcttttgacttgtttgcctctattgttagacattaagctcactgagggcagggatcctatttttatgtcccagttgcttagcacaatgcacacagtatgtgctaaaatcttttgagtgtatgaacaattgagcaaatagataaataaaacgaaattctccttccactcagcagttcatcactagcaatatcccaggtagagtctcgcattttgtcttcctcattcactccctactgtctttcaggagaaatgccagttacagctgaaatagctcaaataataggtcaccaaagagaaccctctggctttggtaactccaaactaataactgcttcctaaatgaaatgactttgcatattgacacctttagcaagttggtggaagtcttgagttaataatctcacttttaattagtttaaatgtacattccctgttggaagaaatacaaactaagctttggaggttccacatcccatcttctgaggctctactggcgtgtggaaaggttgagtggggagaagattcctttcagctcagtggacctatggttctgctaagttaggacggtgagggtggtgcatttccttgctctcaaagccaccttagctcattaggcaactggcatgggtaacgtattttgtagataagtgcagtgactcataggccagacactcagagggtatcctatcccagccaggtgacggtaactccagcttagcaaatgggccagtgtcccctttcctcatctatgaagtggactgttgaatgagatgcaggttactctgcccagcaatgtgtcgtggttcttaggcaatactgtcaatgccctgaaagcagagctctcttggggatgagggtcttgcggtcactgagacctgacacctttctggggcacacccatggaagtctatggaagatacccagttttcctctagaaacccccaaaattatagttgccagagtcaacaacttggccatctcacttggttctatgctgatagaggacaaaaatattcagtgaatttcattttaatctgtaattaataaactgtttccaaatatgattaagtaacctgacttctctgtcacttagggtttagcaaatgttgggttatggacgtaaaatttattttaaaatcaagtatgttcagagaagttttgccaagcataaatgtaaaagagaggaaaaaaaagaaggaactttagaaatttctcattatttaaaaaaataaaaaatgaaaataaataaaatcaagtatgaaaacattaggactgagtctctctctgaaagccttttaaatgaagatattgttttcaacttaaagtaactacattaatttcctgtttatgtcactagactttgaatttcaaataacaaaaattttcaaagtctttgtatatttcaaaatataaatttcacagaaacaattttaaaatgtttcctattataaaacaagttatctttctcattcatccacacagaggaaatacacatctgtgttcagtactttgtgtcctatttctcaacctcaatccattgacagacctcccctgctcagttttacattttttgatgagtgcttcttggcctataaccagctgtgaacacacaaacgaacaggcagccttctcaagtatgggtagggcgcagaagaggaacttactggactggggcacaaagtcagctgcttgtgagactcatcactgggtggaagtgccctgaggccaggacttctatgtctcgtgtctttttggacacagtatccagaaaaagaccagcccaagacccggtcctccataaacacttgcagaatgaattccttggaaagcttttaacaagactctcaaactctcagggtttcttccccttagcaatagaatgaggaaagttacatatgctaccccgattttcacaagtatcaaataatagaaagctggggaatgcatttgtaaaaaagagagcattgtattagcattgacctttttttttttgagacaagtctcgctctctcgccaggctggagtgcagtggcgcaatctcggctcactgcaacctctgactccctggttcaagcgattctcctgcctcagcctcctgagcagctgggattacaggcacgcgccaccatgcccagctaatttttgtatatttagtagagatggggtttctccatgttggccagaatggtctcgatctcctgacctcataatccgcccgccttaggctcccaaagggctggcattacaggcatgagccactgcgcccggccattattgaccatcttagtgagacctccagcacctagtacgggatctggcacacaggaagcactaattgactacttgctcttagactacatgtattttcagcccatttgacctcctacatcgctgatggtttatgtatgacttctagaaattttatttctacatggaagaaacctcgtttcctattcccaccacccccccacccccccccccgcttgtttcccactgtattctttccggaggcacgcctgcagcccagccctccttgcagaaccctgtgacaccagaggcgtgtgtatccagaatcaggcagattcctgaactcccactggtcagccagtgtctagtgctgctcttcataaacaatgcctggagtgtgctcacacgtgtacctcttcttggcaaagacagtaaatggaaggagacaaggagttgtctaataaacttggcattgagatgaaacaggaaacaaagacatgtatccggataaagataaatactgttctgagtttctgatcttgtcaacttcagattttttaagtgcctgtgtcccaggaaaatgatttgcctcactggtgtgcttcatttctttcaatattagacttaaaagcaagccctcctccagtactggattaacagttttgtttgaaagatgtgttttaccctcgggaaccggccatactgatcctatctagtacttccaattctgatttagggatgccataagagaaactttttaaacaagtaattctcttctacttttttgtctattcctcaggtctctcaatggttacagaacccatgtctgtgtctaatatcatggcagctgggacaaagaaaaccaagatgaaacatttgagattgttccagctgaaacaaaccaaccaaaaccccacaggtgccagccttgaggcaaaggcgggacagtgtcaggcgaaatctttgggtcccagcctcagtctccccatcaccatgtctttttcacttaaacacgtttcactgttttgtcatctatagattcaacaatgtgatttggacactgggaataagagaataagatttgatggttgaaataaaacacaccacgagagaaccgtccacaaggaaactctaagatgccaagatgcgggacaggtagaaaggacagggctttgggagtactctgggttttcaggacgaatctgtatcagcctcggcgctgcgaggatattgcatcaggctctttactcctgaacgccgttttagacgcctaagcagattgtgctgctgcctgttcttccccgttctgtgaattctacactgacttcaagtgcacgaatgagctacaagataaggtggaacctgccggccgggcacggcagacagcacctgatcagcgcctcggagggcggagctggggggcttctccactcgggactttgagggacccccgcggagcgctccgcgccactcggcggtctagctgcagagaaagcccctcctcacccggggctccctgtggcccacaggggaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttccagtaacttgaactccctgacgggtctcggggtccacccaggggtggcgaggcgggctcgggcgaccacggcccgctcagtgcccggcacctgcgcgccccgagggcggccgcattacctcgagccggctcaggctggagctcttggagcgcgacttcctgcgcaggtacacagagaagaacctgcgcacggcgaacttcttcatgctcaggtccatcgccccgcgcccagcccggagcagccgcagggccgggggacgcgcatccccggcatcccaggcgcggggctcaggtccgcgggcgggcacgcgtggccagggagcccggcacggcggccatgggcgcggggcgtggggcgcgagctgcggtcacaaagggcaggccgcgccggccaccgcggccggggccacaatcgctccctccgcctccttctccgcctcccctgcgagtaccagcgccggccacgcgccacgcctacaccacgcccaccaccactaccaccaatcagcgcccgccgctccgcgccccggcacgcacacctcctcctcctccgccccgccccgccactacggccaatcagcgctcaccacccctcccgttcccacccaccaccagcactgccaatgagagcccaccgccccgcccgggagagccccgcctctgccgatacctccaatcatcagcgccgccctgtggttccaggtgcccatccctcctcctctttctactccttcctacaagaaccagctccgtgcagccccgcccccacgcggttccgcccacggccccgcccacagcactgcccgccaatcagtgcccgcagccgccgcatacctaatgagcctcggcccgggacagctcccggcccgggcgagttgtgcagctgctccggagccgcgcagtcgcgggcgttcctgtcacgcaacttcggcccggctgctctttcttccagcttggggccgtcattatgttttccttccttaaaacatccctatgcacactttgtcatcatgtttttctctgccgaaccaaactttaattgttgatcagcaaacgcagccaaaacctcagcggcacagcgagcgagggaccgccgcctgccagcgggccctgcagctcggccaggagccgccctccgcggaaccggcgccttccctccgccggagcggacaaaggcgcccgagggcgggggctcaggcagccctcggggcgcctccctcccgcggctgcagaacaaagacgcatccgccctccgcagccggtcccgctctaggaaacgtctacacagatggcttatcagggcccgcgctgggaatacccgggcggggtgacctgggtctagggcaaggccctcagacccgctgctggcggcagcgccgctcgggatccgccttaaagggaaacacttttttcttttttttcctagaaatgctcaccaagggctgcagcagggccgagaatgcgggctcacgaccccgtgcagcctgctctgttttcctcttgtgcacgtgttgagtttgtatttaaaaacagggagaaaccgagcccattgacatagcaccatcaccacctgcaaagagcagaaacgagtgcggtggtgagttgacaagtcttgcttgctcttttgcagtgcgaactgcaaaatcctcgcgttgttttgctccctggactagtcagatgttgcgttaatacttgtgtagtctattttggctaaggtgggtagagaggtcagaatgtccttaaataagagctttaaagtcatgctgcatccgggctgaggtgaggtcagataggctctctgggtttcctggagacccgcgttgagcggtgctgctccggagtggaagccgggagtttagcaccacgactctggcgctgccccttccttgcttggtgaacttgggtgccgttgcacgttgttcccacgactcatctctaagaggaaaatacgagtgaaacctgtctcacctcccttactggataccaagaggcttatgcaagatcacggatgtgggagtgctttgtgaatttaaatagtgcaattgattttcatattatgtattaaaggatctataatgactattctttaaaaacagaagtgcaggaccccacaaggacaccaaacaccactttttgctccttttcaagatggtgtgccagttaagtgcccatgaaaactgctttgcctgcttcctttaaggttctgctgggagggtagtaatctgtgctctcagaaccagcctcttagtgccctgtatccctgctgggaccctcaggcatcctggctctaggcaaacacaaagacactctgtacccagcacgggaagaggtagatggacctccaactggacacagactccgggaatgagggaggaccaacccgaccatgcttccctcggaaggggagccagtaatactggccggagacaggagtgctgaatgccacctataccaactcatgggcatcctgttcaggacaaaagccccaaggcaggcaggcctaagtcaaggcttgtgttgtaccaacaatagtattttgacctgatctgacaaaattggaaaggaaatatttcatgggacattcattagttccccaaatttgaaggcaacaaaactgttctgttgaacttgggagggaaaatcattcagatttcactggaattcattgctagaacaataaatctgtttgcctttgtttttctcctggtaaaatacacgtataccaaaatctctagtgatcatggaacactacttcatgtgattatgtaatgaaatcctccaaaaccactaaatctagggtaggtataatatcaagacccactgtaaccgaaatccaaattatccttaccaaataccagaaaagaaagtgaacttgataaaggctcttgcccagatgatggaatgggagaggactgaagagaagataaagagcttggtagacctctgagtatctcacatttcctctgactcaagcacagtaagtttgagactgaattccgtggtgactgctgcttctatgagtaccagattagctgatgtgtggtcaatgcaattccacaagtgattatcgagcactaacatctggcactgtggtggtcatttgtgacacaaaatgattacaacatcccaagaagttcacagtcttatggaagagaaggtgagtgaacagacaaagctcatgccgtttttatgtaaagtgaaagaaatgcgtaagagatgaatgagaagccaattctaattggcgaagtcaaggaggagatggcctttgctctgaacccctgagggtaagaagatgagggaataagtttcctggacagacaagaggaggcgggagtcccaggctgaggaataacagggcactgtcaggcagctgtgacaaggtttcccatctctccctgctacacaggcaccttgtgggtaaggctggtgtgctctctgcatatgggaagatgccacattctcggggcaccccacaggagtggcttgagtgacatccaagagcttctaattagtcaagtaccacaaatgtctgttcgtctccaaacagtcctacaggctgctgaaagtttcaagcttctaaaactcccacatattttcaataaaacgctaaattgcacttcaagtgaaactatatatctttaaaataaattgaaacattcggtcttcattaggactaaagttttgccatgggaggtgaattcactaggttcacctgatgcaaaacttcaccaggatcaccagggtcacctggtgctggccatctgcgaaagcaggaagtcgtgcttttccggagtatcagcattcgaaggctctgcccatcacaggcatcctgctggatgctccagagacagtgtccagccagtacgagggagggaggtgggcttcagtgtgtgcccctgtgaactacttcctgtggctgtgatacaaatgggtttagtcaagcttcccttagtgtagtccctgagtgtacagaaaggaatccttttcctgggctgtggatccccgtgtacttgaaatgtttatgactttgaagtttcttgaatgtaggaattagtccttgctcaggaagatggtcttaaagtcctgagaccctagaaggtaaactgtagtggacagttcaggtgggggcacgttcggagcaggtgtcagcaaggggcctggagctgtcagggaagggcttcttgggccctcggcaaaagtcagaagggatcaagtttgcctctggtctctggctggcccctggccctcacccacaggacacttgggtctcattcacatctgggtgccaaccaagccatgtcagaatgacacctgtgccctcagtttaacagtttaaaatctctgagcatatcgaaaatttaaaaagaaagtcttaatgcgtaaaagtcttcaaaatgacagaaataaagctctaatggtgaagtaccaggaaatggaatttacatttgaaaccagagggcctggtttctgagtagtcaggagaggcaggtggaaacccacaggccagttgtacttgacccttattgactggcttacatttaggaagaaaaaccacattgggtttcaagctgtggaaaccatcatggttggcttcctccctccccgctggagccctcatcccccatccaacctgggtaggaaggcacagggctcacagaaggtgggcttcacctgcaacacctcccccgccagcccgctgtgaggacagctttggattttattggtttttaaatactatgttccttcataccactttcttttgaaacccatttataaaccatagggccagaatctacagagaggctgatcaaataactttcctggtaacacagattttttttcgtccctctgcctggggcactctggtgccttccatggtgtcagcggagcacggctggagtcatgactcccaaacagcgagaagggagggccctgcctcagtgagccctttttctctttgagacagtggaacccaagagatagatgcgaacacacagagcagtcatagacacagcggagcagagacagaccagagagaggctgcgcggcaaacggagcccagacaggtggcacctcagggcagcaccagtatcagctaaggtgtaaatgcctcgaaaagacctaaatcaaacaccacatgagagagatgaaattcagacagagaggcggtggggacagcgctcctctccgcacatttccaggatactaactccagctgccatgcggtgccttcaacctccaggacctgtctgcctcatagctgaagctttgtaccctttgagcaacatcgcccttccccacccccagccctggggagtttttagactccacagataagtgagatcatggacatttgtctccccatgtctggcttattccacttagtatgatgtccccaggcccacctgtgttgcccgcaggtagctatgtgagatgatgggtgtgttcattagcttgattgtgggaacccttacatgaggtatacctacagcaaacaccatggggtgtcccttaaattatgcaacttttggctgcacggggtagctcacgcctataatcccagcactttgggaggctgaggtgggcagatcacctgagatcaggagttcgagaccagcctgaccaacatggagaaaccccttctctactaaaaatacaaaattagccgggcatggtggcgcatgcctgtaatcccagctactcgggaggctaaggcaggagcatcccttgaacctgggaggcagagttgcagtgagtggagatcataccattgcactccagcctgggcaacaagagcgaaactccatctcaaaaaaaaaaaaaaaatttctttgtcaattatacctcaacaaagctggagaaaataaaaagaatgaatgaggaaggacatacagaaatcaacagcaacaacacagaggagaaagaccagaagacagacacaaagaccaggagaccaagaaggaacttaacccaaaggaaaggaaactgggagcccgagcttagtgagggaggagaaagcagggacagacagcgcaactcaggaacagggtcggggagaggcagaggcacactgagcggtgtggggaggccagaggacaacgtggactcaacatgggcgtgaaatacctcggggccgggcgcaggggctcatgcctgcaatcccagcatttcgggaggccgagatgggcagatcacttgagcccaggagttcaaggccaacttgggcaatatggcaaaacccatgttttctctactaaaaaatacaaaaattagttggatgtggtggtgtgtgcctgtggtcccagctacttgggaggctgaagtgggacgatcacttgaacctgggaggcggagacggcagtgagctgagatcgtgccactgcactccagcctgggtaacagagtgagagcccatctcaaaaacaccaaaaaccaaaaaacaacctcagaggagattgcctaagtccacagagcaagaaaggaaattggggcagagtaaaggggtgagtttcttcttctacctctggccagtgtgtaaggatgggatgctcagagctagcagtactttgggcccatgaggtcatgctaagcatggcacagcagaaaactggaaacattttggatccttgataacactgttgagttactgcattaaccaagtctgcagccaaaccgctttgaggcttacttctgtggaaaataaatcttctcgttgagctgagttttctgtcattagcagccaaaggaatcctaactgatatactgagcaaggcattcgttattcactcggttaatccagacttaaatctagttactaaatctaaatttttataaaagttacttacagattatttaatagtcataatatttgtaaaacattatggtagaaaatgctgtgagattataattacagttataattataggatggaagaattacttgtttgaatttattcacgtatcatgcatttcatgatctcttcctctgtactcagcactgtgccctctcacaagatcatcacgggctagtgacaaatgatcagatacaaaaatatactatgagtcagcggaacgtgccacgctttaaggcagacaaacatgcagctggcccatggggagggaggaaggactagagggacacggggacggtttttcaaaccaggcaagtggagacgagagcagaaagaaagagcagcttgcgcaaaggccctggggtgagtgacactgtgtgggcagagtgtgggctcagggcgtggggtcaggcagagggaatgacgtttgttctcagcttaacaaagaggccactgaaacgtgaagccaaggacgacagggacacacttgcatttgagaaagttctcctggcagcagggtgcacagcagaggaagcagattcggggaggtgcccctgtgacagtcttgtggggcaggacagtgtcctcatgaagagcaaaccgcagtggccacagtgatggagagcaagaggccgaggtgggcagtaacactgggagcagaacttgccgcagacccacgggctgaggggaaggaaatggggccggacgtttccaggataagtccttgcgtccacaggcgccacctctgagttgctcctcccccttcctcatccctccattttaccacctcgaaatcaaaatcgaaatcgaaatcgctgagcttttacacagttcactcagatgcttccctgtaaatccatgacttgcaaaactgtcaggttttattccaacatgaccacaaacatggaaaaacaaagacatgtgtaaattatgtgagatgagaaaataacacataactctaaaaagggaatttcatttgcaaatgttttttgaggcagaatctcactctgtcccccaggctggagtgcagtggtgtgaactcagctcactgcaacctcctcctcctgtgattgttgagtcgctggggctacaggtgtgcgccaccttgcccagctaatttttgtacttttagtagagatggggttttgccatgttgaccaggctggtctcgaattcctgacctcaagtggtccgcccacctcagcctcccaaagtgctggggttacaggtgtgagccactacactcagtgttcatttgcagatttttttagtgtttggtatagtttcacaccataaatacctcacatccttaaaaatccacaggaaaaaaactaatattcaagaactagaacaattttttaaaatatgaggaaaatgagaccataatttttaaattataataattttaaaaagacttgtgataacggagagccaacggtagtacgtgaaagtgaccgtgtggggcatacttggttgtattcatgtttgtgactcactaattatcaatcacttctctcccacgtacaccttggcatgaatgagttagagaaccacggcaggagcccagtgtcattcatcaacccaggtcctctgcgcatctactgtgcctgctgctgtgggctgtgctgaggctgggatctgaggggctgggcacagcagggactcctgccctgacgggcactgcagtctctggggtagcacagacaagccagggtgcgttcactcccaggcaggaagggctttagaggggagagaaagccctacgggagcccccagaggagcccttagtctcgcagatgactgctacattcacaggctatgatgagcaagcgccagccagatacacagggacagacaagggtgttccgtcagggaagctcaggctaaaggccagtgagagcatggtcctgaggaggttcatttggctgctgtgtgagggtgtgttggagtggggacagggcagaagaggggtgctaggtcacatggtagagagccccatggagtttaccccagaagaggaggaagagcccgggaggctttggcaggaggatgccatgagcatcacctgggtgtgtctgcagaaggacgttcaactctgagcctgcccacctactgcgctcaccccaggacaagccaccatccccaccctggggagaaggctgcatccaccccaggagggtgacctgggtgtgtccggtaaagggtgtcttaagtctgaccctgctcgtcttctgcgtccactccaggacaagccaccaaccctactctagaccagggtggtcacctgctagcttggccgcccatggccattccacataaatccaaatccaatcatccacttctctgcttataactcttccaggcttcttactttcttgccagtaaagtataataaaacccaaactcctcgttctgcctacactgactctgctacaaagaccctgggtctcaccacctaccgcccatcccgccctgccccaccctgctcctgggctccaccagcctggccttcccttcattcttggaaccgccaaggccgtcccacctccagccttgggttctggctccttcctctgcctgggcccctgttccagctcgctctcaagctttggcttccagcttgaatcagtacctccctgcagaggcctttctggatagcctatctcggacaggcttgaatcagcgcctccctgcagaggcctttctggatagcctatctcagacaggcttgaatcagcacctccctgcagaggcctttctggatagcctatctcagacagggcctctctccactactctctagaacacctcatgctcattttctttacaaaacttctgataatatgtgattcttcttccttttctcctcctccacatatttctcctcctcctcctccttctcctcttcctcttcctccttctccttcatccttttcaccttttaaatgcttgtctccagtaatcacaatataaggccctaaaggacaggaactttaacatcccagaggctgctgtgacacagagcccagctcacagtaggcactccgtggatatctgctgcccttgttgaataaagacattggggaacgaggccaggagaagcagggtgtggccgaagggaagtggatgaactccagggttaaatttagaacaaacaggatttcaggattgatcatttgaaaggaaagtttctaccaactccctgagatacactaagtttgaaaatttcaaggacaaatagctataggccaatttttaaaaaaaagtgctgagaggctgttccaaaaccctgacactgctccggtctctgagaacacaggatggcctggagagtaaaggaggggagcatgcaggggaggaaattcggcagcatctgtgctgagcacccttcctctccaccacctaaagggctggggaggtgccgcctctgttgttgtagcccaggcaggatgactttgtggggccccttggggagtgctgatatgctaggaccaggtggcttaggtctggcttccactgggaccatctggaggggaacgcgaggaggacagagaggctgtgtggtggctgaccctgtccgcgcaaggcttgttggccaaggacacacgagtgcttcctacaggccgggcctgggccaaggaggggccatgcgaagtcctcagagaccctgcctggagtgaagccaacagggacctccaggagagaagggtcaggctggggaagagaggagatcagtcgaagcccattctctcccctcctcttcctcattcctggctctggccctgagaggaacaatgagccgagaggaacaatgagcaggtgccaggtcgggggagagggtggtaggggacacacaaggtggagagtaggagagccagcaagctcagactgcaggctgcctgcgcaggtctctgaaagggacccatcctgaagaccggaaatactaaccaagcgctcagaacttaaagtcagtgtgggctgtctgttgtccaagagtgggaagaaaagctgtggaaagtgatagggtcctcactggagaagggggcgtttgtcccactggtggacattgaaatgtgtgttttgacccaatctcaagccaggtttgttcaagtcaatgaggtgaggaagcagaggcaggaaccaagaagcgggttcagatttgcagcataagaccccgtgtctcagccgtgggggccgcaggggacagagcccactccccaaagtggggatccagcagggcgctgcacttggcctgagggcggggctgagggaggaccccataaccccctggatgaggaatcgtggttgaacactggcgctaagcagggggccgggagcgtgggaaatcctctgggagtttgtggccacagccagccttcgcccaggggcacggcctcggttcaccgcctgtgtgaaaacagcagcaccaactccggctgacaatttaaagtggtcttgagttgttgttgccctaggtgcctatcagaaacaatcacaaatgctttctagaggaatctgcattagagccaggcttcaaagaaatccctcagacacagctccaaggagcgcaagctcgcaatcactgtgcgcaaaatccacaagaccgctgaagtcaggagcacagcccgaaagccagccagccgcagactcggctgtgagcaggctccagccactggaccctccaggagagagcagtgaatgtcagatttgataagcttaaggagataaaagcaagatatgaaaatgccattaaagacaagagactcaaagtgaccaagcagataaaaaaatgaacaacgtcgctcttgaaatggaaagacatgaattacatatagctgagcacgtgtaccatttattaaagagcaaattagatgtagctggagacaggcgaaagacggatctaaaaacgaccgcggtaagcaggagcctgtgatggactgtacactgggaagtaaaatatcttgaattaaatttctacccgctgttcagatcctatgacctgactttggctgaaattctgagtctctagaacagtggttctggggcggtagaggatgggtcccaggggacgtctggcagtgttagagacatttttgattgtcacagctgggtggggctaccggcatctcgtgggttgaggccgggcactgctgaaccctctacagtgtacaggacaggctcattaccaagacgtgtccatcaaaaatgtcagtagtttctgttccttctgctcagtttgtttgagaacctaaaatggctcttaaaaaataaagtctatttttaaaaatgttgatggtgaggttgaaaaagctcactttaggatgaagagggaggaagaagagggaaaaaaccctgttctcaccaggtcgtcacctatgcaaacagcaatttcatgcagttaaaccaatatgtggaagggctttataaatcataaggtgctcaatggagttattcgtagaaatcctagagtttcacacagaaaattaatgaaatggctgggaaggcagtcgactcccaaatatgagaatttgtatctgaaaactcccctattcaactgtattgtcttatgcaaggcataaccatgtgccccgctgcccaaaccagaaggtaagacttaccgtgacctcctgacacgtccttattccctacgtctctagttactgagatttgtcaactgtgccttctacatgttttccccgtcttgccttctttccaaccctgccctccataacacagcgtgggtcctccttagctcttgccagaaaatagtaattactggctaaaggctttccctacaacccacctgtggtcctgccaccagcctgatccttctagaagcgaatctggttcagttaccccagggcatgcatagctccagagcttggaagcttggaagccccagactctgttcttcctagccaggccttcttccatgttgcgtttgcctctcctccttcctccagggtgcagtctctgctcctgccccgctgacttactcctaagaagatgaactgtggtgtctccgtgacatcattcacgcagtggccacggctgtccttcctgcccgctctgcctctgcccactggccacatctccttccagcatcttccagacccagcattgctccaggaagccacaccgagatcactccaccccacaggccctgttggggtctctcctgggttcctctagtttgctcactgtgctgtattaaaactttgggttcccctctctctcccaccaatgttaaactacttcagagaagcaagtgtccgtagcgttccatgcgtgtgtgtaaacagacgttactaggattattttcagtgggttgctgattaggaagagctttggtctacattattatttctgtgacacatttatctacgaaagagacacagcgaacccccttatgcagtgaagatggtgaggctctaggaggttaacacagaaataagggacttttccaagcctatacataaattatagaggaattcaaaaggaagggagtcagcaggaaagaggaaacaggttacaactatagcaggaaggatttctgtagcttaaaaaggaaaaaaaaaacccatcatagaaaaatttctcaagatctggcatgggtacaaaagagaacataaaatctttgctagatttgttttagcaaattttcattgtttaaaaatatttcataaacacctatagtatttcaggcactaaatacctctactagagatgagaacttgatgaacacgtaaaagccagacagggggagctgagaatagcccgtgtggcagccccgggagaggcgcgccctgtggtgcggtctcctcctcccctcatcaggggagctcgggaggaagctggggctgggaggcagcaccgcccttccctgctccgctgggtttttccctgttctgggcaacctgctgggtcacgtatgtagagagagccttcccggaacacatgagaatgctagataaaacaagggggaaatctcttctaatgaagtgtggctggtccgatagtaagcagggaagaataaacgcaggcaaaaatgaggataaggagatattgtgaggtcgagcactgttctgagcagtgcctgtcctgcaggcttatgtgagtctctgccatctagaccagaggttcagtggggggccaagcagggtgtggggggtcggatccgagtcggcattcccatagagcagactcaacggcgtgaccttggaagaacctcactgtgaagaaggaggcttgcatcttcaggtgggagtgtggcaaagagcaaggggtaaaaactgccctctcagatttctttagctcacacttcagccagttggaagccaaaatcctcactgctagtatggcctgaaaaactccaatccaaacttatagtttttagaggttccagattggtagcacccagaggaccaggcagaggcaaatgtaagtacaatcaggaggaacatgctttaaacacgtgtcacagtttaaacgggaaatttctaaggggcatgagctcgcaaacataaatcactaaataatcacagatacaaactgtgggcaagagtcagcagagacaacaaattccaaaatcagacctgtacagatagcaaaggttaggaatttgtataaataatataaaatatgtgtcttcaatacatttgaaaaacagcaaggaaggttgaagcattacaagaaaacaagagattataaaatgaccaagcagatttgtaaaaataagtaaaactttaaaattgaaacagtaataatttaaataaaaaattcaatagattggccaggtgtggtggctcatgcttataatcccagcactttgggaggctgaggtgggcggatcacttgaagtcaggagttcaagaccagcctggccaacatggcgaaaccccatctctactaaaaatacaaaaatcagccagtgtagtggtgcatgcctgtaatcccagctacacggactgaggcaggagaatagtttgaacctgggaggcggggggtgcagtgagccgagatcacaccactgcactccagcctgggtaaaagagtgagactctgtcacaaaaaaaaaaaaaaaaaaaaaaaaaaaaaaaaaaaaaaaaaaaaattcaatagatcaattaacagcagtttgggcaaagtccaacaaagagttggtaaaagagacgttggatctgatgataattgagagaaagacagaaatacaggaaatatgaaaggggggttaggaaatatggaagatagaaggagaaaaatccagcatgcctctgactattagaatgagacagaagaaacaaagaaaaacagaaaagcactattcaaagaggtgaggcaatactgcagaatttttcagagtagataaaatataccgatcttcatatttataaagacccccaaaatccccaggaggattcaatgaaaagaaaatgatacctaaatacatcatattaaatatttgaaataccaaaaaccgaaaaaaaaaatctctccagagcaaccagaagaaaagacaacttttctacaaatgaatgttaattactgtcagctaccatctcaacagcaatattggaagctgagagagtggaataatatatgcgatgtgctaagagaaaataactttaaccttgaattctctgtcctacaaaaaaaaaatctttcacaaacaaggacaaaacaaagacatttccaagtaaacaatcgaagaaaattctcacttccagtgaaattgtgtgggtaaagctagacacacacgagctgcatgaaagtaaatcatttgtgtattgtataatttgtggacttaagttggaattgatgtcttaaatatgctatttaaaaatagcatatacgggacagtgatcagttaaaaccttctaatgttttcatatttttctgaagataaagaggcttgattacctttagacaaaaattcaatagattggttaagcatacatgctaaagtttccaaagcaatcaattaaaggaatataaatccaatgtgtaattgccaaactaatagaggtcaaagtatagaacaagaaaaaaatttcaaatgatagtaagaaagcaggaaaaaagacacctggaaaaagcaggataagtaaaaaaaataccaactgttgggaagggccaccgccatgggtcctgagcgtcactgcaccttcttgctgagtatgtgacgaatgtcaggcactgaccactgttaacccaggccattgctcagtgtcacatttgcagtgagcaaccttgggaaatgaggtaacattttcctccaagacaaaagcaggcttgctgacctcttgttaaagaacaccaggttccccaagctcagctttcctcaactgagatgcagttttactgtaaacatagaatgcatctaggcccccataggatgtggggggcaaaggagtcctatgcaaatatgatactcatgccattttctgttccttgaattaaaatgtcctttatctctgatcttccaatatccaccaactcttctagtagctattattgggctaattagtagtttgtaagtgaggcaaaataaaatcctagaccatatacaatctaaatagaaataaatcaaaatatgtaaaaaaataaagtcaatgttaatgagctaaactctctagttaaaagacaaagagtgccaaataggtttacaataaatttagttatagaaaaacatatataacaagatacataaaaagtttcaaataaaataatggaaatagatacatcatgcaaaaactaatgaaaagaagtaacattaatgtcatacataggatgcaacaagcattcatagatatagaaaaagcactacatattgatgaacgtttcaattcaccaggaggatacaataattctaagcttacatgcaccaaataatatagcttcaaaatgtattaatcaaaaaatgacaaaaccaaaaggagaaattgacaaatccattattatttagaaaaatttttgtctcaatatatgtcttgggccattgtatatcttgctactctcatctggacgatgtggtacctgccttcaattttgtttaccaagattaatactgaatcctcctaaagttctgacctccgctgtcagtccttcaaggatgctctctgtgacccccagacttagtcaggtgccctggcagatgctcttaagatactaggaatttcttagatgggaatacttacttaggtgtatgtgtgtgagcatttaattaatgcttttattagactgtaaaccctgtgagggcaggaattgtgtctccttggcaaatcactatacacagtgcctgttactgatggctgatctacttagaacaaatatttgctgaatggatagacgagtgaaagcagtcactgaactggcagccagatggccactactgcttttttgacatgcactttgtgccacaggatggaagtgcagaatgaggattaacttgtgacaattggttccctctctctcttctcctctccttcccttttcctctttttaagccagtaattagcacataaccttgggcaactgaggcaataagtcagtaactctacatactatttttagatttgctaagggcatacaacatgtactattcaaaaacgaaaagaaagggaattatctagtagggcacagatgttatattcacaatggtacatcctgaagttcaacacagggaaaagcccacatttcttcaaatcaatgtgcgtcccatttactgtgcctgctcccccagtccatgacgtcacttcttccagttattcttgtgattacatgtccttccgggaacaactggctggagattctggtgacttttaggaagtttgaggctccaatcctatcatcattttccaggagcaactgctttagctaaacctcccggtattctcagggaaggatctgacttaagttgcgtgaaagtatattgcaaatgtgttttggcttagacgtattttaaataagggcccatacatattaaaaagtaaagagagaaattacagcctaggggtttgtggtgtccatgtagcattaacataatgagtgctgtggcttacttgcatcctgcaaaaagccaccttgaagtcctaacccctagtacctgtgaacatgacctcacttggaaatagggtctttgcaaatgaaatcaagttaacatgaggtcataattggattagggtggctctaaatccaatatgactggtgtccttataaggagagacacatacacacagaggaatgcctggtgaaggaggaaacagagattggagcggggcatctccaaactagggaacaccaaggattgctggcaacaccagaagctggaaagaggcatgaatcagattcttccctacagcctttagagggagtgaggcactgcccacccctgattttggagttctggtctccaaaactgtgggaggacaagttcctattattttaaactgtccaatttgtaatgctgtcttatggcagacctagaaaatgaacgaaactacttacgcatcctttaaagctagctattaaagtttcctatttgataaagacttgaaaatgtaacaagatgcataatagcatctacaagtattcacctttcaatatgaagaatggcaaagggtgaccaggctgccaataagataaattatggagctggaatcagaggcacaacgttagtttttgaattaccagtcgtgtgggggaagctgtttaagtaaaagaacactgagaatgggatcagaacacttgggctggagtttccgtttagccgctttctatatatttcccctaagcactggtacaccctgttccttctgccagtcacaaactctccacctcccctcctctctcttcaacctgctcacctctgtccctctcctaggccttggctaagactccactcctgggaggtctgccctggttcctaggctgggttacaggacctcctggagcagccctgccatgctcacgggaatgtgcccccccttctctggatctacctggagatgggggcactccaggaagcctggccccagctcatcatagtccatgttgtacccacagagttcttggcacataagaattcatttttagctctaaataagtaaaggtatgaattaaacagtagcattaactttgccatagttttgcaaactcaaagtgtggtttacatgtgtcaacatttcaacttaaccacagattattttgcctcccaatggatatttggccaagtctggagaaacttgtcagaaggtgaactaaaggatgcaaagacaatctgtgcgtgcccctcaaagctgccaaagcgggcctggagtctgcaagtgctcgttagaacaaaacgtttgcttctagggccagtcctctgtgcaattagagttgtagtggtgaggttgtaaatcagagttgatagctcctattgttagggaatttagctgtaggaattgggaaatttgccatggtccctgagcactgaacccatgacccaggggtggcttggtttccttaaacttagtgcccatctcagttgatcagagggcatctatttcagtctctcagatcacgtggaatctcttgatcggttccacatggaccagcttctgacaccctggctgcagaacagaagcggcggctgggagaggtaagtctagacccaggtagcagggacccccctggacccacacgcccacacggccattgccctgagagccaaaccttccaagaggccctgaaagagaaagaacacaaccagccaagcttgggactggacaagccagtcagcagcactgaaccttacaggataagtcctaggccacggaggagccagtcgaggtcagcctggagtcttctttattcatgacattgcatctgtgcagcgcaagggccccgccaggaagacctggtccagccgcatgccttggctggggcccctgacacgctccttcctggggtcacccgcgtcccagcctggcccttctgggccacggtgcagctctcagggaccttcttcgtttcaccaggggctcctcacaccagagcttaccccaaagaagtgaacccctaagcccccttcagttcctaggatccttgactcctaccaagcaaacccttttgtcctcaccccttttgaatctcctttgagatctcagaggtaggcatctcctgctccattctaattcaggcacctttcccctctccagcaagttctcctgcttctcaggccgtggtgggtgtgggcctctgtgcgagccgctcccctgtgtgccttcggccgccactcctccctcagctgctcgcattcccactctgtcctttctccaggctgacgcccagccctccagacctcctaccccagttcagagccacaggtcccaaagcctccgtggatgtcctccaggcactgccagggaagaattattccacaaatatctgtatatcagtatgtgccagaaatcgttctgagtcatgccgatctcccagttcaccatcttttttgccccagtgttctcctattttttttttaactctaaaccactcagtaaatgacactgatgtcatcatgatcacagttcttcaaatcatcctgatttctcccctttcacggccctcccaagcccagccccttatccacactttgcatcctgtgcgtttgatcgctctgtcaccacacgcccgcctcgtccccatggccgcaatggccagaggcatggcttcatctcttcttgccgggttagtgcagttctctgctggtggggatgtgggcctccaggattcctccccaatctgtctgcaccgctgttcagatgtgttttaaaaattcaggtctggtcaagcccttccctactctacaccgtcaataatttcctgtacttttaaggataaagttcacatctctcagctgaccacgcaaggttctacatgcccgttccacctctttccataccgctccctaacaggaactctttactactgctcttaaattatccaaacgtagcacatttgaaaaatagccccaccatttagccaattgcctctcatcctttgaaacttttaagtttttccaggaggcttcctatacccacaggacacacatacatgcacacacacacacacgcacatgctcatacacacacatgcacatgcttacacacatacatacacacatgctcacacacatgcacatgctcacacacgcacacgcacatgctcatacacacatgcacatgctgacacacatacatacacacatgctcacacacatgcacatgctcacacacacgcacatgctcatacacacacatgcacatgcttacatacatacacacatgctcacacacacgcacatgctcacacacgcacatgcttacacacatacatacacacatgctctcacacacatgcacatgctcacacacatgcacacgcacatggtcatacacacacgctcatacacacacgtgcacacacacgctcatacacatacatgcacacacgcacatggttacacacccatgcacacatgctcacacacatgcacacatgctcatacacacactcatgcacacacacgcacatgcgcacacacacacattcacacaggcacacacactcatgttcatacacacgcatgcacacagtatgcacacacacgcatgtatacacatgcacacacacatacatgcacacgcttctcctcactccctgatttttatgctgtttttctgagggcctggagaacattgtgcacgcctccatcttaccatatacaactgctgcacaatctgcctttgtacctgagactgggcaagaattacttgagagcagaagccatgtctcatttgacaaacaggcagctggcacgggaaggggacgggcatttaataaatgtttctggattgaacacgtgagtgagttcgtatattcctgaatgactcgccattttagtattttcacctatcaccgccacgcagctgacttcttaatctgtttccagctctgccctctctcactagctggaatcccgtctccaactctctgcagccgactccatctgcgcatcactccgatctgtattacagtgattactccggcgtctgcatctcgtcctgaggtcctgaactttgggatggcaccgaccatctgtgactgtccgactcaaaacatcggtgcctggcacaggaagcatctcattctgtctctcctcaccccccttatgcatttcacccatcaccaaggcccatagagtctaccttgcagcgtctcaccaattcacctgtctctctaaggccactggcacctcatgccagccctactaatgggctccttccttcgcccctcctccagtctagtcaatatgttaccaaagcattatccctctccactgctctgcccttcaatcatctgtaccacaaaatgtgactcaataaattcaagctgctattccaaacgtggcctcatttgtcacaccagcctcaagcttcatctcgcaccactcagagtctgctccacaccaaacccagcaggaccaggtagtatttccacatctgcccctcgcgttcctgcccctgcgcccgtctgcgctcctgcccctgccctcccctcttccttcttcttagatcatctatccatcttttaagtccaaacttaaataggacctttgttcatgcatttcctcatttcccattaagataaaacttatttctcctgtgaaaccctgagcactttataaccactgcagtataacttgtgttctaactagaatctgtttccgggtcatcctccctgttaaatcccatgctatgtatcgtaattcccaacaaaacaaatgagcatggtgctgagggaatcctcctcatggtatatagatttccagatttttagggaatgagagcctaatgtcaccctatctgacatttctgaggccaatggtcttttaggggtaatgaagaattattactatgataattatttgggaattataccttactcactcatgcaacccccactcccagggcaaggccttgcaggcaggaggtgctcagtaaaggaccatgcaatggatgggattgtagacccagtgagctgaagaaaaaccagaccccggggggttttcgttccacatcaagcaggtgagctgagaccacgggctgtcttccttggaaagcacagagaacctggcacgattgttttgctaccaggactgcagggctgtctttctgcgaactttcattaccagaggtttaaaggctcgccagcagaaacttcagaactgcatgcccaacatgatctcgataagtagtgggtcattgcggagggtagagagaagtagtctctgagttagtcttattaaaacaaatctttattacccttaaaagaacattggcctcagaaatgttagatggggtgacattaggctctcattccttaaaaacctggaaatttatataccatgaggaaacttccctcagcaccaggctcatttgttttgttgggaattacaaaaaaaaaaaaaaaaagcacaattaacttgtaccacaagatgctgagccagagcccctctctactgcggagggaatgagataaggcctcccctggggtttctattctggggtctcccacaggaagcctttcatcaccacattcttattcatagacattgaaacaatactagcatttaatttgcaccaggaactggggtagcaagaagagggggcattctccagctgtctagaggtgggagggagggggtccatgttcaccgtcctcttttcacggccatcactttaggctggaggtgggagggaggggggtccatgttcaccgtcctcttttcacggccatcactttaagctggaggagagaaggaggaggggtccgtgttcactgtcctcttttcacggccatcacttccgggtcaggaaatgatgatgactgttcaggcctgtgtcctgccttcactagggccagccagcggcatccatatttttgcagtgttgtatgtgagggtgaactgagtcaggcttgcccaagtaggtggcattctgctggttcaggaaaactcaaattgttggcttcaagttcacttggttctctctctgtctccagtcctggctgaaattctaagtgattttttacttctggagccatctgtaagaaaggctcttcttggaaccctgaagactgcaggtctcgtttgggcaggtgagagggatttgaggtgactgaacagaacccatgaggctcaaggtggttgggtttaatactttgaacctgaacataggaatagatcactttttaaaattgttttcagcacctaaaattatggccatggacagctccatgcaaaggtcccctgactacaaggacctgccccgtgatgtggttgtgttacccagaccctgcctgtccagctgtggaagccaggctgtcaatccgaaaatgtcagcgccttgctcagatcactccagtgtgtgaggatcacaatttagataagaacccagatttcttggtttaaaattggtattttctactttatctcatacttatatcatatatatataatttggtaaaaagcagaacatattctctacttctagaggctccatctgcaagcatttgtacaattcagcaagtacagaaaagtgttggatcatgtgggcagcaattcaaagatttttttaaccaaattatgcaattatctcaatgcacaggattatgtaagagtatctaaaaaacaggttattacaagcaataaagtcagagatttgcagttgattggttttctatgtatttctaaacttggcaatgggtttgtaatacccagtgggctcttttgttgcttagcttaacgtttttcagaagtagacaattcttcacgggaagacaacggaaatccaaggaaagctacgaaggctgttatcagagaaaaatttcctcgaagcactttagctgtcactttgaagtgttagtgacatcctttggcagtgattaaatgtgccacatgccactaatcttgtttagaatccttaaagaggacagcagcccttacacaggatgcttcgatctgatgacgatggtgtttatgcagtgatgtgtggctcacaggcacgtatacaacaccatcaactcttccatctcatacctcatcagagctttccatctgatcccatttggagaaggatatcacacctgaggaatccacgtgtaagctattgctcttgtatgagttcaggtgcacacgcactgtggacgcacactgcactgtgccccccaacggctgacaacgtggagccgggatgcaggagcatccgccttctccaagtgagttctcggcactgccgtgctttcactaaccctttatttacttctgctagtagactttcaacgccactgagtgctagaagaatttaagaatgttaaaatagatatgatgagaatactgttttttgaacatcttcacatatgaagagtaaaagtcagaggatagagcttcggattatctcatagaagaaaaacaccttcgcattacatgtggcatgagccattcgcgggtattatatcttcttcatttgctattgttttcttttaaagcatctcaccaagcactcgcttcactgtgcattttatattctggttttatttcccagttcacaattttattcagaatcttaaattaactgtccttgggaagtatacaactagttttacccaaaggatggctgaaaatgcattgtcttcaacacaagataaattaacctgttttccttgcgatgtttcccatgaggagtttgatcgtttgcaccttattctcttcggggaacttaggaaaaaccacatggaggttgtcttctcgatggcgcaaccatgaactggacacgtttcttgacttaatcaagttatgtcctatttttgcccgtattgatctttatgtcactgaaagccaatgtgtacatttgtcagtgtcagagcaccctctgaccaactcaactctgatctcttgttgttaaaatcccacccggtgacctgcttgggttcccccagctaggcgagagttgagtccttagtaatttcaggcggggcccagagatcatggaagagatgcgggtagtggtgaatcgtaccgagattttcaagctccatcttaatcagtgtagaataatggaagcttttttaaattcagcaggcaagcactataattaaactcgcatgtcatcaatattccatcagggtgcaactcagccgcctgtctccctgcctcgtgccttgggtggctgggctgtcttcatcatgctgggcccagcagcaggctatttgccagggcacccactgtggacactctgccttcccagggtagccccgggccacagaacctgccactaggcattgcccattattccatttttctctcctaatgattttctgttgttgttcagagggagtctcgttctgtctcccaggctggagtgtagtggcatgatcttggctcactgcaacctccacctcctgggttcaagcaattctcgtgcctcagcctcccaagtagctgggattacaggcatgtgccaccatgcccgactaatttttgtatgtttagtagagacagggtttcaccatgttggccaggctggtctccaacttctggcctcatgtaatccgcccgcctcagcctcccaaagtgctgggattacaggcgtgagccgccctgcctggccctaataatgtttttaaggaggtgaataattcccatcgacttaactcatcccagagatttaggtccagcagagccaggcccacacagttattgaatcagacacgagaagacggaatcgacatggcaatcagcatttagacaggctactaagtgctgccatcaatcaccttctcttcccagaaaagtacagatgtctccctggatttcttactaataaccagaaatacagctgtccaggccctgcacatattttgtatcacttgataaaaatagctaatagcattctatctgtgactcctggtttatctcataaactaaatggatggaaaagagaaaggaatgctacttgaaatcccatctcagcggcacatgaattccaggtagcggctccctggttacaggacagaagtaagtgaagtagcacacacaagagaaatatcggaaaacagaaaataacttctagaggaataatttgttgcacaaaatgcaaacaaaacatgttcattaatacgttttatttaaacatattttcaaatgcttacaattgtggattttaggaggctgtgcaaaaatcatgaatatttttaatctgtcttaacaggcttctctcccacctctcactgtgatactgagcagaactccccaaagaaaaatcatttctcaactgtgaaactagggaagactaaccagatgtgatagcacactgtattctgatcgaaagtgaactattcttccatcatattggtcaagctttcaaaaacacttacctatacttcagggcgaaagattctcagcatcctctaacaaatgtttgcctcagaaccattgaaaagaaaaggtttagaattaatgacagagaacaatgtacccacagctgcattttgctcttttgaaaattagatatttttctgcagataatactacagaaccacaataaaagttatcatcatgcttcacatctagtaatgaacgtgaaacaagcaccctcgaatagctgcatcgagcatgaaagggcacgggccccactgccggccgggtgaattctagacgggccccactgccagccgggtgaattctagcagatacttcacccaaaatgcttcagtgtgcatcaaactgacacgagctcctacacaatcacaatataatttactcgcctgagagattcagtacacaatgtccccagtttccccccaatatccttaaactgatttattctgcacaattccatcacaaagtttttcacttatttgtcgaatctcaacagtattcttgaatgaagtatcctccagtttttgttgctgtttagacatttacatttatgaacaaagagttcagggcagctgctctgtagaatgtttcatagtctggactgatttcgtggtttcttcataattagattagggtaaaatatttttagctgctgtacatcacgttaggagacctgtcatgtcaacttgcaccattgtgggagacactcgcttctgcctgccgggtcgcctttgtgaagataacctttcccatcgtaattaataagtaggatgtggggcaatagctcctcaacctttcccctcatggctttagcacttataaaaaatgtaaaaaaaaatatcaggtgtccattttcaaggctgagggtgggggaagaatctaattaactttgaacagcacctggatggcagaatccctctagacactgacaacccaccgcaaccccaaactttacaactatttcacccaactcttttcaacagaagttctcatttttgttcatatatattgaatatttccaaactattcaatttaccttccacagaaattgctcctttttattactcaaagttcatcggatcatagtaattaatgatcatacttcagtgtatctagggtaagactgactacaaggtacatcagtagtttacatgccctacaggaagaaaacaccaaggacacataacaagcatcactgcaccacccacaactgatgttggtgacaacgtgcagacacaatatttgcacccggagtcagtgaaatgtggtgaatgatgtcatgtgtgcaaagtagtacaaacaggtcagggaacaaacagagcggactcctgggaaccacgtgtatctccagtggctgccaactcaggccggtctgcagaggattctgccacagcctgggctggaggctacacacctggctggtggatctgagacagagcagggcgggtaactgaagaccaggctggaaaggttctagcttcacataaggtaccaaataaaaaattaaaactctccatcagaaccaagatgcatatgtctttcttgttataattcaaaatatctcatagctagtaagatcttactgactataaaaggttggaaacacatgaagcagccaggactcccacactgggctggcgagagtgtgaacgggcgccaccagtttggaaaacaacaatctcatcaggttgaagatgtgcaggcccacggctcagcgactccacctcaggactacatggagcagagccccagcaggtgcactcggagacacgcccaggaatacctgtagctgtctttgcaggatagccacacgccagaagtcaccacaatctctagcaatggtggaaggaacaggcgccctgcggtagatacacgtggcagaacactacacaacagtgagcatgggctgcctgagtgtgcacagcacacacctctaaacacaggggaagctcacgcctagaaccgtgaacaaaggaagagagacacggtggaagctcaccgagagcttcttatttacataagcctcaaaaacaggtaaaacacagcttattgcttagaaaatgctacatgggtaaagatataaagaaaacaaggaaatcattgacagaggggtctggcgttagcggtctctgagaggagatgaaagggagggaggggagaggcagggaagaagaagaagggggaggagagaaacaagagagggagtgggcaggacgatggtctgggaaatgctcttcgccccaacccaaaggcgtcttcctctgtgaagggttgggcgggggtggaactcggttcaccccaggggcctcccctgccctgcctgagtggtgtggctcggacacaggggcatctccccacaggcctgtgcctcctgaatgaggaacagccattcccctccagcagggcctcggcaggtgggcccggcaggtgctcccgtgactctgcctccgcctccagccctggtctctgggatgcgaagatggatggaaagaccatatgaagcagccccgatttcccggagctcccagctgaggtcgcattcatccacacaggcaacagaagcaagtgcagcactgcgcggttcacctgctgtgggaacggcaggccagaattccctgtggaaaagggaggatgggaagggccccgatccccagcccctggctcaggtaggtgccatcgcctcccagggccgttgtccagattcaccgcggtgcatgtgaaagcccgggcaaacagatggtgcccaattaacagaactattcttgcggcactggggtttggtgagactctctctgactcagagaaatgacgcaggatggccactctgtccttggggccccaagcctagaatctgagtctctgactccctgccagaacctggtcgagaccttgaactctcctagctgcttcctcacccaggaaacgggaagagccccacccccaacacagagacggtggggagcagggctggagctgcggagcaccagccgcacctggcgccaggtcccaggagccacacgaggaaaaggagaacttcatcatgggctaggaaacccactgcctgggcgggcgagggcatttctttctgtttggaaacacacagaataacaagcaaagttagataagggaatgagagtccttgtgaggggtaaatcagtgttagatgataattgtcctgcttttgacgattttctaaaaacaaaacagaacaaaaaaaaaaactttagggaagctttaaacagatacgagagaaaagtgtcttattttcaacgacaaaaatgaaagtaaattcaccaaaagatggtacagatgaagctcaaatatttatgataacaacattccttggttgtagaaaaagaggaatacgtcctcattgcctgaaactaacgacacggaacccttgtgggaaccaggggagggaggtgttggtgagcagttattatgatggttaatttaggaagttgtaggaaggttctgcagagcattcgacagatgattaaaaggacaggagccggacatctgggccttgtggtttctaaggagagtgtgctaggcgttggaaggagaagaacgggaagaggctgagccctggtgccaatttgcctcagaggtgcaggcagatttcgctcacttgagagcagggcgagttctgcttttgaggccagaagtcatacaaatgcggacaagaggcctgaagaccgaaaacctgaactgcagatgtgtttctgcagaaaacctggctgggaggaattcacttttctttctttttttgagacggagtctcaccctgtcacccaggctggagtgcagtggcgagatctcggctcaccgcaacttccacctccccggttcaagcgagtctcatggctcagcctcccaagtagctgggatacaggcatgtgccaccatgcctggctaattttgcatttttagtagagatggtgtttttccatgttggtcaggctggtcttaaactcccgacctcaggtgattcgcccacctcggcctcccaaagtgctgagagtacaggcatgagccactgtggccagcccaggattttttactcctgggcgtgatttgtgttgggggtggcaccaagttgatggcctcggtgaggaagcagggtcagccctgctgagcccagggtgcatccgtgactatgctgaacgctgcatgtgatgcccgacagccctgtgcacagccttggcccactgtacgcagagatcacaaggcttcccgagccaaacccttcaggatctcacagctgcggagctggtcgccgtgtcactcagctgtcagctgctctctccttctctggtgtttcatggatacttcactttatgcaaatcccacaaatgacacaaggcaggggtgggacagcatcgggggtcagagaccacttcaaaaccacgcactgaaaacttttcagacaaggccagactacttgataaaagtcatcttccatgtcaggatgtaccgggacaccctggcagagccagcccagggcacggggagtaggagacactgataatgataaaaacatgcgggatgggagtgccagggttcgcctgtgcaattcaagagtggtttgtggtgttgaagttggcaattctgaccttcatctgtgcaagggaaacttgttgaactatttaagtccgagaaacttaaggccctaaaccctccgtgttcctcaacggcatcactagagagactctctctggaactcgcccctgctctgtacaagacacatgggtcagcatggggtgaggagagctctgggcaaagggcagacatgctgggaacccgccccgacacgtgactgagtaattagataccccgaccaatgacatccacaggcttccccagaatcatacatgcttctccggtaaactgtggtcccagtgacccttgggaggtaagaagctccccacaacacccccccttttgtggcgcttacatggggatcacagagtcaccaactgactgtgcaaattggacaggtgtccaaaatgaagcactaatgagcatgaagaaaatgagcatgaagtcagacaggctaaaaaaaattaagacaaaaagtgccatttcccaatttcagccctattaattaaaaaccaaaattaaaactgtgtggaatcgctcattatgtttttaaattaaacacaggctgacaaaactaattgcactaacagtctcccccagctgttccctgctgacctctgcacagttctggaaggctctgggtgaggggtggccggggaggggagagggggccatcctcaggaagacgatcgtgcaggacagagccaaggccactcagggaggatggcttttgttgcttttacttcactaacctggaaagaaagtatttgcttccaaattttgtcttgttttccaaacagaggctgtagccataaatatgcatcttattgaacatctactctgtgcaaggcatagtaggttatcaatcattccagggagtggagcgtaaggagaaggagagtcatctggcaccaagaactcagagctgggggagtctgtagttatttttagtgctgccactggtcagtggacacgggtgggagccagcgctggacggcgtggtggcttgacgtcctttgcccaggctggccctgccgccgtacagctctagcaccgactgcgggatgggggaccagcgaacctcgggagcccactccctcagtgacagcatgcggtggtagctgctcttatctcactggctggttgtaagaatccaagtaaattaagaatgtttaagaactaatacattttttgtatttttttttttttagacacaaggtctctatgttgcccagtctgaccttgaactccagagttcaagtaatcctcccagctcagcctcccagcgtgttgtgctcacaggcgtgagccaccacacctggccaataattaattctataaactggaaagtgttaaacaaacatttcccattaggagaactgaggaattttaaactctgttttactttttttccactactttcaatagctcattgtttcataaattagatggatacatgatgccactttttaaaactaaagaatccataattgtactgcccataagtaatcagtgctattgttctggtccattttttctaatgtgtaagtctgcctcctgtatctcattgtgtgtgtgcatgtgtgtgtgtgtgcatgtgtgtgtgtgcgggttggtgtgtgcgtgcgtgtgtgcatgtgtgtgcatgtgtatgggcatgcgtgcgtgtgtgtgtgtgtgtgtgtgtgtgagagagagagaagaagggagggaggagagagattactgaacaaatatttgagtgtctgcctgtcacacaagacatcatgccaggcatagccttcctagggacacagtgacaaccaagataaacacagctcctgcctcataaggataaattctatttgaagaaacataaagtgaataattacctacacaattaatagtgtaatcacaaaaaggatcagtatttcaaagaatcatttgggttacatgagagtgtgtaacagaacacccaccaaacagcctttacagtatgtgctgttcttgagcccaatctcttcccttagtgctgtctagcaggcgtttcctcgggttttctgacggctgcataatatcctctttacctgggtggcatggtttgactactcccccattgatggatttttttttaaataaaaaataacagcacagagcattcatgaacgtaaatcgtgagttaattccttatggtttgcttaaaatgcgttcctgcaaattggagtactgagttaaaagtcataaaaattttgaggttaatgagacatatgtcaacttgctttgtaaaagggtgaaccaatccataatcttacctcgtgtttctcaaataatgcctgttaacattaagtattgccctttaaaaactgccaatttgtatggccaaaatctttttctttttgttgttgttgagacaggctctcgctctgtcgcccagcctggagtgcagtggtgcgatctcagctcactacaacccctgcctcctggattcaagcgattctcctgcctcagcctgctaagtagctgggatcacaggtgcccatcatcacgcatggctaatttttgcatttttaatagagacagggtttaccacgttggccaggctggtctcaaactcctaaactcaggcgatccgcccgcctcggcctccccaagttctaggattataggcatgagccaccgctgtatggccaaaatcttttactattttaatttgcatttatttgattagtagtcatgtttaaaatatttgatggctgtttgtattatttttctatttgtaaattatgtccgagtcctttgcctcatttttcctattgcagagtcagcaattttcttattgttttctaagagtttttggtatatgactgaattaactttttatcatagtctccctatataataaatataaaatctacatttatattttctagtctatttgccttatcatttttaaattttgacatattaatagttttcaatattttagtaagtcaaatcgaatagcttctttttttgtgagattttctttcctttgcatgcatgcttacaaagccttttctctttctgaaatcggttaaatattctagagtattttgtctttttttataattcagttatttttatttgactgtggcccatctggaagttgttttcgagtacactatgaagggaggagcttctttacccatagccaactttcccacatgttgtattgaatcgtacatatctctccctttataacacagtacatattgaagaactatttcaggatgttttactccagttcaattcctcgttaacacaaattcttaacgggactagtgagaatccctgctttgttcctgatttaatgggacagtattaagtgagtaaagataggggttgtttatcatattatgaatatttcttaatttttacctacttaatattttaaaatcagaaactgtctaaaatgttatcaaattattctttttaatctttgaagattatcgtaggtgttgaattctctgcttcatgtacctttaattcactggtattcttttttctgggatattgccattgtaagatttggctgctattacggggtgacagtcttttcagtaaggtaatttagctatccattggcaggcaaaggacgtatttgatgcaggggtggtaagagatgggttggcgcaggaggtatgaaaacttactccaaattacagacactttagatatctgctttctttggggacgtaagaacagctctgcttgcaaatccaatgcctatgttacaggagtgcagttttatgtttggaaagagtctcttagcattatgagggttatttatgttatgaacaccagttagtttgcaccagttccaggaaagagattcaatatgaaaatatggacacagattcagatatagtgttgggagtatatgaatttgacttgtgtatcatatacctggattctctggtttagcttgtaaacccaatatttcatcataatccagtaaaccaaattaactattatggactgaattgtgtgctctccaaattcatatgttgaagtcctaacctctggtacttagactgtgactgtgtggagagaggacctttcaaaggggaattccattaaatgaggcctcggagtgggtgcttatccgctctgactgctgtccttagaagaagaggaagtctgaatacgcagagacaccggggccgcctctgtgtatggaggaacggccacgcgaggacagggaggaggcgccatctgcaagcaagaggagagccacggaagacaccagccccaccaagacctcgaactgggcttcaagcctccagaactgagagacattaagggtctgctgtttgaactgcccagtctacttctaaaaggatgaaccaatccattgttaggggagcctgagcagactaatatgttaacagaaaactgagctgtctctactgcttctctcatcaaagatcagaattgaaaggtggccaagaaacaaaaaccaatagataatcttcctactgtatcatcccagaaggcaaggatgaaaatcttcactcaggtcagctttgctctacccaagggctattaaatgcagctggaaaagagagctcccaggagggcagaaaaacctgcgagtgacaatgaacgtgaatctcatagtgctctgcagcccaccccagcccccagaacccaggctttgcaccctgagaaagcacaaagcacagtccacttctctactgagagcgggttctccaccacggccaaggagttcttcagggaagatgctactctgtgagtggctggatagaaaaatataaacagggttattcccctctttgggtctttggtttgtcccttctccaaaaggaataccttattttccccaacagcgtggcttcctgtcgaataactattcctaccatccctctaagaacatgcaacaggggaaaacacctgctgggaagctgccgccagaggccccaccctatcccggaagggccttagaggaaggaagttggggaggaggaggagggtcagggtggatgggaggatgaacacagcaactgctgggacacaggcttcggcgctgcacccacctggagctgacagtcaagcctcacttgatgttaaagaaagaggaaatatggtatcagaaagagcatgagggtaaatggcaagacctgagtttaagttcaaaattgattattagctgtgggactccacaaaccacttagacttgagatgtctctgttttattatctgtaaagcagggccacctctacccatctcataggttttctgacagttcagtcatggttgaaagtgctttataaacattaagtgtcatagaggaaatttgttagaagcgttaataacttatgtgtccatctgcacattgcacataggataggccattctttttagcattgcctttgcaattgatttaatttcccaagctctgttcaccttctgagaccataacaaacattaccctgaagtttctgtttccatttccattggtcccactctaagtgaaccttggcaatcaaaagggcatcatcatccctccttctactgagcccagtgagctcacagctggaacgctgctccacgggactgaaagtaaacactttaagtttccgggtgataactgttggtcatggtcaatgtcagcacactcatttaagaggcgcattttcttggaaccactcactgaaatatacactcaacaccaaatgtgagcttcagaagatattttaagggcatcaggaagatgaaactgtgcctgccccttgcggcatggaggaatccacacacacacaaacatttctacacactcacacttgtattctgcttctgtgtgtttacatgttgtttcttgtaagaatagagattgcaaagctcaacttaaaaaatattgaatggtaacataaacaaattattaggccaaccacagagaattgcaaaacttttgactgttttttagttacaaaattcagttttatacattatatattaagaacctactgagcaagaaaatattctattaagtggtatttgcaagagattattctaatagagagtgtgctagaaaagaaaagaaagatgatacaacggatgaggcccctactggatatgaggtgcagagagccagctttcgcctcctgaacacagatagtcctcctgactcctttaggaacatgagctccattggaaacatctggaagttgaggataagagaaaacaagtctggccaggtgtggcggctcacacctgtaaccccagtactttgagaggctgaggcaagaggattgcttgagcccagaagttggagaccaacctgggcaaaatagtgagaccccatctctacaaaaaataaaattagccaggcatggtggcgtgtagccttcagtctcatagctgtcagggtgttcaagttctgccttccatacagaacaacatctgcagggctcacagacagaggaatgccccccaagatactaactcaggtgaaagattgtgagatttcatcctcaggtacacacaccatggtgtgacttacaggagcaccccgaggtgtataagagtgtccctaaattgatgttaagaatactaatgaaggatgaactgagtctctctgcagctgcctctgggctttgtctggtgtgcctatacccaatgtcacccaaacccaaagaagggtttgcagcagcagctgcacaaagctgctggacaaagccgaatctccaggagcccagtcccaccctcccctctgagaagacccccatgtgacttccccacctttgtggcgcatggtatgaagagtacaggaaagaacaaagggacagcagccagggcacagatgcaaactactttcagaaacgtgttctcttctgaaagactccagagccagtgcgaccctcattagaacaagcaccggagacatgaagtttgctactgaaggtctcccagcaagctgcaggcggccctgaccaagcttaggtcccatgaaatgagccccacttgcagagcttgttctgaacctcgttttggggagaaacttggttgttcatgtcacggagaaggaagccgagtgaggatgagaaaagcaaccttcacagaggcagagctggatcagaagaaggtgcagctctgctcagcacggcccccagcctgcttcctgggcaggaaattcacatgtgaaatccagtttctgagaggctcaggagccttctttgacatcatgatgatgaacccaatcatgtatatatagcttaaatcaagtggaaaagcccacatcaccacaggctgcgatctgaaggagcagagattagcaatctagaaatagaaaagttattgaaagccaatcttctcccagctgattgatccgcaaatgatggcaggaaaaagctgaactcacttcagaagttggtgtctaaaattggagactctttcagcaaggcctgcctgggtcacggggtctgccccatctagtgagtgctctgctgtgcatcagagagagggggcgggactggcatcttcccagcaaagtagggggcaagggagcactctgtaaaagcaggggatgatgtgtaaacccatccatcttcctagcgcatcaataataatgttccactagctagtcaggtactcagatcctgacatttgtcagttgtgtcaaaatgctagaaagtaccatttcaaatgctgttatgtgttgtttataaaatataaggataatttcaccaaagaagatatacaaatgaccaagaagcatatggaaagatgctcaacgccagtcactaatccttagggaaatgcaaatcaacaccacaagcaaatcaacacccgataagataccccctctcacctgttgggatagctacatcaaaacaaatagcataatgagtgttggcgagggtgctgaaaaattagaattgttgtttactgttggtggaaatgtaaaacggtgcaggagctctggaaaacagtatggccattcctcagaaagttacacatagaataaccatataatttagcaactttcacttctgagtatatacccaaaaagaatggaaagcagagcctcaaagagacatttgtacactcacattcatagcagcatcattcacagtagccaaaagatggaagcaacctcagtgttcattggtggatggatgggtagcagagtgcggtgtaggcacacaatggaaggaaatgacgacgcacgttgcaatgtggatgaacctggaggacattatgtgaagtgaaataagctgatcacaaaaagacaaatactgtatgattccgcttacgtgaggtaccgagaatactcaaatcatagagacagagagtggaatggtggcaccagaggatgaggattagggggaaaaagagttattgcttaaagggtagcatttccgttttgagaaaggaacggagttctggagaaagatggtggtgatggttgcacagcaatgtgagtgtacccaataccactgaactgcacactgacacatgcttgagacggtaaatttaacgtcacatgttttactcataattaaaaatttttaagtgtaaggataaatgtaactgcagtatatgtgcatgatatataacagcacatagttacacatagttatgtcgataatttcttattctatagcattttaaactacagaaaatatacctaatgaaaattactaatttgcctgctattttgttttaacatgcttgaaccataagctcaaaacacctgttgataccttgtgcctgcctttgaataaaacctaaatccttctaatgtcgccatagatgagatgtacaggccggatttcatgtcatttagtcaggaaaaatgtcacaggaaagcagtttctcatagatatcagctttcaaactttctacacctgaggaccacttgggtgggtctaagagagtgactgtgcaccccgaccccctgcaattgtggaaactcagaatcacgagccaaagaaggtaaccgggataaactgggtagaatcagcaacttttggagggaggggatcacacctttaacactacagctaggcgttttgaatgaggtaaaacctgaagacaatctgaataatgagaaccacagcccttggtgtcataaggaacctttcaagccagtgcctgccagactctgaaacccctgggccctgagtgtacaaagaaaagagggagttcctgcctgcgtcgttggtagaaagtaaagacacagatgccagaggggaagagcacagcccgcacacagcgggagctcatgagatgtttggagattgatgggcacatatacagaacacagtctcctggattaaagcactcagtgtgcagggtggggccagggaaaggacaatgccaggttcctggagagctggagtgacacaaacgagcaggaacaggactgcaatgccaccgagcagtgcaagcgaggtttggtttccctgagcatttggagaaactgaaggaaatgcagagtgaagacagcgttcctgaacacaaagcatgaggcgtgaagtcccaaatccaagcccaccctcgttccttcccttgtgtggggcccttggcacctcacccctcagttcatatggtggggtagtgttgagagcccgtcgctttcagccagattgtggccttttccattccaagccacaagagcgtcagacgtgaggctgtgcttcatggccaggcagggactcggcatctgaacgactcagggccaatcaggagagcgggaaccacagcagttatttcacagaaagtgtttcatacaaagaattggctgagtaaggctggaaggctggaaaggcagaggaacccccagtaaccccaagatggtaactgcagggaagcagctccttagaccgagggaagagggtggtgtcgtgacaacctgggaacactgagaacggaggcagtgctcagctgctgggagcctctctgaagaggcacagggaggctggttctgggaagcaggcaaaataaatggacatgtaaatgaaaaccagaaactggttccaatagcttttgccagaattaagaggtttcctttctttttttcttttccttttctttccttccctccatccctccctccctccctcctccatccctccctccctcccgcctttctttctcttccttccttcctttctttcttttcttttttttttttcagggcctcactctgtcacctaggcaggagttcagtgatgtgatcaccacggctccctgtagcctcgacctcccaggctcaagtgatcctcccacctcagcctcccaagaagctgggaccacaggtgtgtgcctcaccatatctggctaatttttgtattttttggttgagacggggtttcaccatgttgcccaggctggtcttgagctcctggcctcaagtgatccgcccacttcagcctcccaaagtgctgggattacaggcatgagcccccgtgcctggccagcattaggaggtcttaatggggacagtgacaggaatatgaggcagagctgggggatcagcacctgctccttcccccgggctgcctgtctctctggcaccctctattcacagggtgcatggggcagtggacatggaacatggacgaggctcccagcccatctgctcccccaggccatgtgtagagggtgggtttggagctgagagaggacagctatgtagtcaacacactgtctgatcccaaattcatgttcctggattctgcctcaccctcgcctctgttgggggttgagaacctgccccaagtcaggtcctactgcgttttcatgatggctccaaagagtctcccttgagtgctggaattgcacggggcccagcaccgttggctgcaagactgtctagtagcctgcacttccaagtctcgctgccttctgggtgtggccaaagccctgttgctgcctctgggatccctgctcctccccatcccctgccagctcactctccagcctgacccaccgcgtttgctcttggtttatcagctcatgcctgtgatgcttcatcccagtgggtgaaagacaagattctggctgctccctgcctcaccccctcctcattcctcactggtgattcctaccgaggtccagggtaggccagggcctatggggagacctactatggtttgagggtagccaccctcctgcaggtgtgatagcaaggaggaacccacgtggggcccgggaagtcctatggaggagttgccaggggcaaccactgtgggttgagggttgctcctccctcttgcaggttcagaactgcagcctttccagggcatccagagatgagggcactcaggagaagggccttgcaggcatgagcctcacagaggtgcaaatggcagtgccaacacattgaataggatgtggagaatgtacacttccagtcacaggaaagctcaggtgctgcgttcagggtgcccttccctatgtaaaggtaatagggagtggaaaatcacactcatccttcaccggtccgtgcggccttgcccttttcggcagcctggtgagaggtccatgtggtgaggctgtaagccctgcaacacgcgcatgagtgaatttgggagtgattccccaacgtcatccttcggatgagaccacagccctgcctgacagctggatgtagcctcatgaagaactgctgagctgcagccacacttctgcccccacagcaatggtgagacagtaaatgcctcttttgttttttaatgccagtaagtttgggggtaatttgttatgtactaaaggtagttagtacacctcgtaaaaaattgaaacatactatttcattctgagtaacatgactgccacactttgaagtgattagtcttcaatgagtatccctcctaaaacataagtgtgatcttaattttagacatcaagattatccaggtaaagtgggcttttgcataacattcaagaatatgaccctcacctctcagggcctttgtattcacaattttgattctcatatttgaaacgcaacaattgatagttcctacagatgatgggagtttctctactcttaaggctaccctcaaatgtcagctaaaattccactaagtgtccaacacgttatttatttatttatttttagacagggtctcactctgtcgcccaggctggagtgcaatggcatgaggtcagctgactgcaacctccacctcccaggttcaagtggttctcgtggctcagcctcctgagcagctgggattacagcctcgtgccaccacgctcagctaattttttgtagagacaggttttcgccccattggccaggttggtcttaaactcctgtcctgaagtgatccacccgtctctacctcccaaagtgttagaattctaggcatgagtcaccatgcctggccccaacatgttatttaaatgcaatgttccttttgcctgttttatgagagccatgcagagtaaatggtcatttttcagacaagtagaatgatacttctggaaaagttgaagatagtcattaaaattcaggctgagggaacaagaatctcattttgtcactagtcctggtctgttgtaattacagcaaagatggtgtgtctggtaacctctctattcagaattaaacaagacacgccaacctgtggctgcattgggtcgaaagcatttcctattaacacctgggactgctgggtctaaatagcaacaatctcaaggcagtcatattcactactcctggagcccccatggtgtactgacgctggtgacctgtatattggagggggagccgctccaccacacgactcttctcatgatcaaagtacagacactcagtttcaaccacaccagcccagccaagttattccagtaagaaaagactcaacacagcctcagatggcaaggtcagcaatctgacagcgagctgccgtgggtaatttgtcaacatccactttcttctctgtgctctgaaatctacacagcgcagggaaaaatgcaaagtcagggtgcagatatcaggctgagtctgaaaacctggtaacagggacaagcagaggctgcccagcacatgggagggaagggtggagctggacactggccagtgggctggccagagccgggatctcagagcatctcacaccagtaagtcagcagcctcagagatgcaaattgggtggggcagagctcaccgaggttcagattcgcaggaggacagcaggggattaggaaggtccattctcagttcagagggaggagtccaggggtctgacacctgtggccaaaccaggcgtgtctccacctagtcatgatttacgagttatagccaagtgcacgacctcagcatttcctgtgggtcccgctagttgctgctggattagaggttgtgtgtatattctaaagtctacttggaaaaaatgtacagacaccaaggaaaaccctgggttaaaatgttatcgggaggttaaagagacccagggcggatatgagggagggactgctccaggtatgtggggacggagaacactacggggaacaagtcccacgcacacactgagtgctgcatacctcctgcaccacaagcgatactcaaccagaagccgccaacattcagggaagagaaggaaagccggcagatactattcatctgctagattcacagcagataacaagcataaccagtcaacccacggatgctaattaaaaagatacttaactgatttcctgacctgtccccctcgagctccaactagcactgcagaatgtttccagtcatcgtctgggctctgtgggtgccatggaggcagagtacccatcgctttatttgcaggcagcaatttcaattggataccttcaattctttttcttggtttctagatttctgagtcttaccatccaaaatagtaagaaaaaaatgcttactcctctactgcgatactgtttacaaggtttattttctgagagaaaggaatgacattgtactggacagagggctgatctcagaggggggccggctcaccggatgagagcagttgaggatgccaccatcccctgtgtcccagggagcctgctgcttctgtgtgtagtggggacaggaaatccttgcctccttcacagatattgcctctccaaagggaaggaagccttccccttggctgaaagagaggcagttgccgtaagccttaagcctcggcagaaggaggctccgcactcttccgcgtccctggcttggagcgtgggtttgatgttggcgtgggcttgctgcagccagctgatgtgcagcagcctgacctgcaggctctgggtgggcccccgagccctctcccagccctccccagagctgcccttccctccccacttcctcccatctgctatactaggtgcacactcactgtaaagggagatgcagaacctcagtctcccgctgcctgtccctctggcctgtgtcacgtatgtgcctgtggatgaagggcaccttctctacactgtagcgctctgagccaccctcctccacgtgcacacagacccaggaaggcctcctctcaggaccaggggtgcaggctgcggctctagggatctctgtgctgtggagggtcttgggaagcactgatcctgggtgcagagcagtcttgtccccccagagctgtcattccaactgcagctgccataagggggtgcccaggaccaggctgcactgaggtctggctgcccagtcagtcaacaaggaccctggaggagaaatgactgagtcgctgtccctggggggctcctggtgccctgtcgacaactctgcacagccctacggactcccagctgcagagcacctggccctgagcccatggggccagctgctatttgatggatggagggtccacatggctcaggaggcacaaaacaggacaaaagtttgcaaactctaaaccaaacttgtccaaagcgcagcctgcaggcggcacgcagcccaggtcagctttgaatgtggcccaacacaaatttgtaaactttctaaaaatattatttcttttgtgatttttctttttttagctcatcagctattgttagtgtattttatgtgtggcccagagaacccaaagattgggcagccctgccaaactaagcttgccgtaagacatgccaaagcatccaaaatttccttaccatttgctgttaaaaatagctttgatttgttatccagacctactgtgccgttctaaagagttaccatcagataaatatacataaagagccatgaacattttctcctcagtgaaattctatggagctgttgctatcttcacaaagcgtgtcaacagccctgaagagagctgcatcgctggggaaagagagttcgggcaagattgttgattcttctttctgatcaagaaaattgtgtactggtactcttagagccctggagagtctgcaaacaggaaatgctgagttcctcatcaagacaatcttttatagccatccatgtcaataaatagattatttttaaaaaggaaagcaacataatgcattcaggaagttatttgtgggaacaggaaacctcttatttgaaagagttattgactttgattggggacagtagtgctttgaacatggcaggtgggcgctgggcagaggctgctgcctggctgagggggacacaggcatgttagaggcctgtggtgtccgttctgatggggaccacgctaaaccgtgggactgctgccctgggagcagggagaggcagctcaggggtggtctgtctgagcaacagcaggacacgcaacccagcaggcaccaaggacaagaggtcgatatctttagagggagaccgggtgaggaaagggcttgggaattaggaaatacaaaataggaaatcaaggaatgtgttcagaagctgtttatggaaataagaaaactcttacttcaaagatatgggacatgaaccagaaataagcatcatgatgatgaagacagtgttttgtttttgtttctgagatggagtctcactctgttgcccacaatggagtgcaatggtgcaatctgggcttgctgcaacctccgcctcccgggttcaagctattctcctgcctcagcctctcaagtagctgggattacaggcccctgccaccacgcccagctaatttttgtatttttagtagagatggggtttcaccatgttggccaggctggtctctaactcctgacctcaggtgatccacccacctgggcctcccaaagtgctgggattataggcatgagccactgtgcctggcgaaaagacaatgtttaaacttcatatttctacgaaatattctgccaccaacacagacacataaagagtgagctgcagtgcaccaaacgaatcaggtcctgtggttctcaggttcttctgttctccttgggttccagtgccatggccagggctttctgcatagggatcctctgcccagcttgccagcaagcggagggcactcacactggggacagggcccaagtcttctgcttaaaagaaaacaggacgaaagccaaagggaagagggtctctcccacatatcatcttcatgcctgggaggaggccggcctccccttcccagtggggaagcccctgcagttccagcccacctacccctgctccttcagtcccactttctctccctctcccccagcccaacctgccatctctcagccctggtcctgccccagtttccacgctgttaatcagctgcctttaaagatgttcgtggcacagtcgtacctgcaaaggtaaccaatcccacaagagcagagaggctgtgacacccggcaaggccctggaaaatcccctccccagccccagcgcgacgtgctcctgagatcagccctgctgggtggtcccctccacagccatggacaacatgcaggctccttccttctcggtgggttaagacataaggaactcaccaataggaaatatgaagatctagtaaagtttcctctcatttcaatcctattttgtgcctgtttccagttccactcactagaattcctcaacactgtcccaatatttgtttttgtgttttagcactcctattttaaatcgggaggaatgctttcacttttccagttattccttatttgtttcatcctgtttgttttttggctattgtgtcatatcttcacagtctctctaggtttttaaaggtctctgttccctgagttctatatgctgcttctgaggtcaccatttgtttgcttttctctgggcaggtaaggaagctgtcaatcgtcataacagaaagttgagtgtaaacaggcttcgccgtaagggattcactggctcgccaatgaaaagtcctgggaggccgggtgcggtggctcatacctgtcatcccagcactttgggaggccgaggggggatggatcacttgaggtcaggcgttggagaccagcctggccaacatgatgaaaccttgtctctaccaaaaacacaaaaattagctggccgtggtggcatacacctgtaatcccagctactcaggaggctgaggcaggagaatcacttgaaaccaggaggcggaggttgcagtgaaccaagatcatgccactgcactccagcctatgcaacagacttaagactctgtctcaaaaaaaaaaaaaaaaaatgtcctgggaggtgcagcctgcacaactgccttatccacttctcttctcctgaagggctggccctgccccaggccggtctcccctagaaagtgtggccggttgatctccggaagcgcaagtccaccctgtgattccacgcctcaccctctagcggctcggctccctattacacgggaagattcctcttgatttgaagtcagccatgatcagatctcacctaatctccatgtagaacttgtaaccaggaccgttccaggcacacacttcagactgtcccctcctggaggtgtccctgtgctgagccctcccgtgaggccgggcatcagataataagacttttccccttgaaactccacagccatctgcttcatgtttccacagcacttaccacactctgctgcgaacactgctcccaacgtctacatattcacgctcaaccagatttaaacttccttcaatctacatgtttgtatgtatcctacaataccaaacacaatttactacacttcaaagaggctcatgattatgaattgaattttttctcttgtccttcttgttttgactgattagttattggagaaactggaactgagaaaggatttctttaatggtccagcacataggagtagtgtgtcgtgatgttctcttgagaaagcctgggcttctcttcaacggagttttagttaacttggagaaatcttctgtttccagtatgctcaattctaccaaatttaggtgaatttatatatagttgttttgcgtattttgaaaatttataaccttcaagggctaccaggtgtcttcacaacagaaagcttgaggtagtactaggatggaaggtcagaggttgacaccttccagaaagacggaacggaaggacatgggcatcaagccaaggttaggttttatacctaagaggcagaaccgcctgattctgagaaatagagatataaaatagtagaagatactatacaatacaaataccttctactgtgtagttaaaaataagaaacgtgttcatatcagtttttttttttttttttgagacagggtctcactttgtcacccaggctgaagtgtagtggcatgatgtcggctcactgcaacctcctcctccaggctcaagcaaccctcttgcctcagccttccgagtagctgggactacaggcatgcaccaccactcccagctaatttttgtatttttagtagagacaaggccaggctggtctcaaattcctggcctcaagtgatctgcctgcctgggcttcccaaagtgctgggattacaggcatgtatttaccaacctgagtaggtattaatgctattccatctttatccttgaaaaggggaaggaagatatttttggattattctaaaattaaaagtaaattatatgatgcctaggacttgccacaaaataacctggagctgtgtgggtaggtggagaaggagagggagtggacacataaataaaacaagactggcctggtctggtaattttggaaattatctgagacagatctgtggggatttattacattctttgcttccacatgtgcttgcattttttatgataaaactcatcttttttaaagcaggggtttaacctctcaagcaaatgagtgtgactgtcacttttaaaatgcttctgatattaaaatcactcccagaacagcataaaataagtcatttttaaagctggtgtgggatgtagctgtgatcctgggaaaatataaagctggtttccggtatggatccacacctgtgctgtgttcataccaacagcccggctcaagaacatatgccagccgtcaagttgtgcaaccagcaccaatttctcctgccagccagagcctccttaccttcccaccttatttccggccacttcccagcacccattcttactccaggtgggtctaaatcctctctgctcctcacgaggctcttccacgcttatcctggctcagaacatctctcatccccctgactgggcctccaccctccacggggaaccaaatcatgggaaagctggattccacaagccgccctgcaagcccactgaccgcagaaggttgccttctacaacagcttagctcaaaaccttcttttcgctaaataaagttgtattttacttccatgcaaaataaacaaaaactcagtttcctgccttcaatccttctctcttttatttcacagaaggaactttggttctcttaaataaggcttccactctgcatgtctttcccaacagataagatcgtttacgtctacttacagttctcaatgtttgctgttctgcgtcaccctcagagttacagatgactgtgactcacgcctggagaagcagcaaggtggggtgagaaaggccaggtggtgacctttgtccaaccatggctggcaagcgacaaagaaagggggctcaaaacgtggcctctgaagtctcgatcccccgcatttctgctgcgccttgagccccctgtgcttcatggggctgggctctcaaccgcaaagcaggtattttttgaccacagatgaatttctaaaatttggcaaaaggatttaaaaactctagaaatagtgtgtatttagatatctgttccccagataaatttgagtatgactttttttgatcatggtcattagtagataaaaccgtatttgtttacaagtaatattaattctataggatttagttcacgttacaaaacctggttgaccaattaccagcactaacagaactaaatagtaagtttggagaaagaaactgtgaacagaaaggctattcagtaggagatgttgctttttaagtcacaacaaaaaaataataaatattgtcaccgggcgtggtggctcatgcctataatcccagcactttgggagactgaggcgggtggatcacctgaggtcaggagttcgagaccagcctggccaagatggcaaaaccccaactctctttaaaaaaaaaaaaaatacaaaaattagccaggcatggtggcgggtgcctgtaatcacagctattcaggaggctgaggcagaagaatcacttgaacctgggaggtggaggtttcagtgagctgagatcacaccactgcactccagcctgggcaacagagtgagactccatctcaataataataataataataaataaatattgtcacttatttttgccagtgcaaatctagaaaacatgagatgaaggataatgtgtaggacatagccaaaaagagcttgaacgtgaaagtgagaggtaacaacgtgctagcagccctggctcgctctcggcacctcctcaacctggcggcgctcctcgatctggccgcgctcgaggagcccttcagcccgctgctgtgctgtgggggcccatctctggggctggccgaggccggagccggctctctctgctggtggggaggtgtggagggagcggcgcgggcgggagctggggttgcgagtggtgctcactggctggcgcgggttccaggtgagcgcggctcggcaagccccgcactcagcgcggttggccagcgcctgctgggcttgatgggggacgagctccctctgggctgcaggagtacctggactaggtgccgcaaagtccctcggcagtgccagtgagaggtgaagccagctgggcttctgggatgggtggggacttggagaatttttctgtctagctaaaggattgtaaacccaccagtcagcactctgtgtctagctaaaggtttgtaaacgcaccaatcagcactctgtgtctagctaacggtttgtaaacgtgccaatcagcacttgtttagctaaaggtatgtaaacgcaccaatcagcactctgtgtctagctaatctggtggggacttggagaacttttgtgtctaactaaaggattgtaaacacaccaatcagcactctgtgtctagctaaaggttcgtaaacacaccaatcagcactctgtcaaaactgaccaatcagctctctgtaaaacggaccaatcagctctgtaaaatggaccaatcagctctctgtaaaatggaccaatcagcaggatgtgggtggggccagataagggaataaaagcaggccgccccagccaggagacctacctgctctggtccccttccacgttgtggaaggtttgtttttttgctctttgtagtaaatcttgctggtgcccactttttgggtctgtgccgcttttgtgaactgtaacatctccacgaaggtttgcagcttcactcctgaagccagtgacagcacgagcccgccaggagggacgaacaactctggacgtgccaaccttatgaactgtaacactcactgtgaaggtttgcagcttcattcctaaagtcagcgagaccatgaacccaccagaaggaaaaaattctggacatatctgaacatctgaaggaacaagctccagacataccatctttaagaactgtaacactcatcactagggtctgtggcttcattcttgaagtcagggagaccgagaacccaccaattctggacacaaaaggagacttgctgaggccagaggcacagttcaaacttcagtcagatgcagaatcggaaaagtttcagccttgctgcccctctcctcccatttttgactctggaaaggcctgtgagggacctgtttggcgtatcgagtgaggactgctcttttttaacagcagccgcttgtctctcccatatcttctcaccccttctgctctgaatcaggctttgttccctagtgaagcacagaaagcagggaaaattggagaaggtggaaagggcagagaggcagcgccagagcacagatctagccacaacgtgtccaccccactgcgtttagaaaatgcaaggaaggatgtaccaaaactgcaggttacaacactgtatcttagaaattttctgagcttaagaaatagatgccataccccacgacaaaaagaagtgggttgcacaatggacttgtaccatttcctgatacaaatgatgcttatttcccaagaaaaatacgaggcatagccaatggcctaggatgcaaaattataaaccaactcattgctccactggaaaccacgcccttcttctagattccgtcttgacataaggtccaagtttcttatctgcaccctccacacggcatctcctacccctaattcctctctgacacctgcagccacggctgaccagtgtgaccagtgctgatcggtggccccaggaaggctgagctctctccctgcaagttgcaccaggattctgtgccccgaagggaaaactgttcctggtgattcccgtgtcccagttccttccttttgtgattccagctcacaggaccaggcctctccctggatctccccctgcccgcccccccccccgcccccgcccaagatcttgctcttggtggcctgtctcccagagatgaaaagtcctgtcttgacccttgtttgacccttgtggcccagggctggggcctgacacctgcagcaggtgcctagaatgttaatgccaccaacttttcctgtcctctgctgggaatgccttgtccaccagcagctcctgccgagatcccttgatcggctccttctgtgagtctcgacaccacccaccaccgcactgttctcccgcagagatgacagacagcttaggtttaagtcttctgatgcccagcaagaatatacaaagaaaactggcctaaccaatgtattaatagtaaaatctggttcattcgtaagtagagttctgagggttttgagatgctgctgttatgtttaagctacaggcaatttacccaaggaatgtgatgttgaaatatgtttcagaataaacttccgcttgaaaattacaggcaataaaatgtaccagctttctccttttcttcttcattaatgaattgaggaacataaaagctcaattaaaaataaagactcatgcgtcacttagttgtttttagtcctttcaatttaataaaacattggtattgaggtgtcgtaggaaaatggaaagtcactgctccgtgtctggctcagtatccacgtttggcttacatcataaatccagagccatggggagtgtcttttccctacttcatcggagcctagaatgcccacaggtggggtccggtgtgggcagcacaggggaagcatagagagggtgagacagccctggggaaaggcaggggcagggagcaagctccgagggcagggccaacatgtcaggtttactgctgaactccagggtctagaacagagtgagagggaggagggactccataattagctgtcgaataagtggaatcccaagaagaaaactgggtgggagtgtggagataaacactagcaacaacgacacaaagaaagcaaggattgcttcatagccgggacaagctcattcatcggaaaccatgaaatggaacctgtctccccacacccagcaaaataacagccctactgcctgtcctcagagcgccctatgaccaccacctacctcagtaaagagacaacccatgcatttgaccacatcctaagccctttttccccttctctgtttcttctcaaaggccaggtgatcatgtgggttccagctttataaccacattccttagacccaaaccaatgagttgaaggcatgaatgaagtaggtaagtgaaggcatgaatgaagaaatgcaacgagaaactaggggaaggcctaccagctgatggacgtcagatgggtctcgccgcttgccctcggtgaagcccagcctgagaccacagctggcagctgtgcttctgtgggagaagatccaagcgctgctcaggggtcacaacatgcaacatgactctttctacagggcaggggcaagcccttaaccatggaaacacatgcatttccacgacaactcatacctacgtgtgcctctgtgttggagagtattgcatattgcagatgtccaaaagtgcacaaagttttaactttatcaattacatgaagtgatgctctcctaactcagagttacattttggcaagagccagaaatgtaccaatgtatttccaagcaagcagtgagtaaacaggaagcaaagtgtttgctccccatgatcaattataatctacagaccacattccttccactctagagacctagaaatatgtttttaaagtatctcattagtttaaattatgattttaaattactttattagttacttgtgtggccatttaaataagtcagattttactgggaataaatcaatgattcatctaaggacaatgtgtgactcaaatatttccttccattaatcagtaaatgttccttttcccaacgtgcttccccgccaaggaaatcaatgtctctggataactaggtaggcgcaaatatgtcagagcacatcagactgagaacacagaagggaaacacatctggagcttttcgcatccagggcctcactccaccgctgatacgctggtagctgaatctcgtccgaccacatggtgggtgaggctgggacagcctggagatacaggagagagcagctagcgagaggtccttggggtgttcggcagctgtggtccctaaggttccagcccccaggcaggcctacaacagccacggcacctccccttcccttctcaggacccagagctcaccaggcagcagcaaggggctaccgtgcaggagttcatcttggaccctatcccagacacgctcttgtaggaacccaagataactggaggagtctataaggaggtgttgtcatctagatgtagctggggacagagatcagaaaacagggcccaacctccccagtgaggtaggagacgggacttgactctggaggcagggttcagatactggaccaaactgagaccctgctaacacagggacggaggtcaggggatgtacccatcagtgtgccatgtctgtttactattgccatggcaacccccaggcattaccgccccttttcatagcaatgaccccacaacccaaaagttactgcccttttcctagaaatttctgcataaactgccccttaatctacatgtaatttaaagtgcgtataaatatgactgcaggcctgccctgagctgctactttctgcctagcaggtaactctgctctgcaggagcagtcacagagctgtaacactgctgcttcaacacagctgttttcttccaccctaccgtctgcttgctcttgaattctctcctgggtgaagccaagaccctttgaaggctaagccccaatttgaggctcacctgtcctgcatcaccaggaagaccagagaccaaaggtggggtctcaccgggtgcagtcatcctcaagccttcaccctgctctctgccctcctctgctctgccccagaggccccaggaatccggcagatgccgttggatgtatccacagtgcagctccatccccgaaagcctcacctccagcctacatcgcttttacctcccaacttgaacatttatcacccttccccctgaacaacttgatttgttttctaagaaaaattctgaacctactttttaataattaaatgccctttctccttctttccaatttataataagagaatgtcttacaaatctgaaaagcaacaagaaacattgtgccagaggaggagctaaaagaggctatccttacttgagagagcgtggtactgggagccacactgcagggaggcccttgcaggaagagggagatgtcactgcgggatggtagctccagagccctgcaagggccaaccggcttccatggaagcaccccaacctcgaagtccccatccagtgggcggagctcagcactacaaggaagctcagacatgaccctgatggagtatgggtgggtgtgcaggctgcggggacagaggccgaggaaagctcaggcaggaccctgatggagtgtggagtgtgtatgcaggctgggaggacagaggccgaggaaagctcaggcaggaccctgatggagtgtggggtgtgtgtgcaggctggaaggacagaggccgaggaaagctcaggcaggaccctgatggagtgtggggtgtgtgtgcaggctgggaggacagaggctgagaagggcaatggttaaaatgatctgttggccatttctatcactgtccatcccacttgtcctccctcagacactcgggacaagagtccaaggatcccagacctctgactttctttctgccctagtttcatggaggtgaactgatggattcatagccatgcatctttgagagttgttggagtacagtttcattccctaggattagggaagatcttggattcaaatccatagactcttcctgagctcccactgcatcccagcttttgaaagaattcctccccgtgcaccaccactcttcaccctcacgacaattctatgggcatcacgtttcttatggcaaagagccttgtaggactgaggttcaagctgggttcacacagccaggtacttggtgccctttctcccaccacatctcctaccacctccttgctgccttgctccccggctaagctgggtctgtgcctctatctccatggtatctacatcactgcttttaactcctaccatcgagtgatcccgcagacaatgcaccatggtgatggacgatgggcccatgccctaggagggagggggacagagggcgaacgaaggggctgagacgaaggagctgtgaggtctttacattcacagcctcaggtcttagggctaatgagaacgaatgactgggataagccaggtgcctttccagacacctacggaaggatcgagaatcttatttggcagtgacaccagttctaccccacagagatgggaagagatcaggacagcattgacctaagggccatcctatgctcatgtaaggtcggtcctgctgagtcctgccgccaggaacaggagtcagggtgcatatcgggcaccaggcatgaggatttgtcactgggaacaaggatgtgtggagaccgtgcaaagcaacccgacctctcctactgtgggaccctctggcccagggttatctccatgtcacctggtgggctcctgagcaacttttctgcttttttgtatgcagggaggtgaaatgacccagaacaagccctgaaatccaagcaggttggtgtgaacttctgaaacctctgatgccaaaccagcacctcccagatactctggagccagcacacatgctctgcacccaaggccatgtggcttctgctgacaggccccagcccatcagtgcatctgatcctgcagcccatgtggcttagctttccttctctctctgccccgaattctccacccctcactggctcacttctgctcatgcttcagcctcctggcttcctctgggaagctgccttgctccccggctgagctgggtccatgcctgtatctccatggtacctatgtcactgcttttaactgtgctatgttttgaggacctgttcaggagctgtttcctgcaccaagccgagagcactcacagcagcacccatggtaggagctctgtgcatacctggtggattaacatgtgccaattacagtgtggccacaaatccaggacagcaccaccacttccttcacccgaggtttgaaggagaaagaacaggggtgaggggagaataggatcgagtacaagtccggagggactgactgggtgcagggcagagggcagctctgtctgcgcccattctccatgctattgagatagccatatgaagacacaagccaaccaaggcatctgccctgccttcacggacacctgcgactctgcctgggccgtggagatccagacacagacagcaatgccccagcaactgcctccacggtctctgtggggagtagcagcattgtgatcattgcaacagcagccaccgcgggcagagttcctcctgcgtgccaggagccatggcaggtgcgatacctgcctcgcttcgttgaccctgacaaggtcacagggcaggggatcattagacccaaatttcaaatgaggaacacacagctgtagtctgcactggacacgcacatgccttgatagcacaaggcaccattactgagtgtccatggtgctgtgtatatattcactattgaaagaacaacagtggcacctccctgcctgtgagcgtggccttgttgctgttctagtgggggcagggggacaccagtagaggccagcggggtttttcacccagaagctaaagaaaaggaagaggtggtttggagggaaaattgttgactgaagaattcaactattgggagccagctgactccactctatttatttttctattaagatggtttactgaattatttgaattgcaggaatccagtcattttaatttgctcagatgtggcttattgaactttgattttctgtgctgaagagcaaacagaacgttcaaacaaatttaagttgggcacgtttaaatgaagcgcagcattgcgtcggcggctctgtgtggagcgttatcaggatttgctcaatgcgtgtgcacagagatgcaaaattgcctttaccagaatcaatcttgggttatgtgtggtccaaagaatgcttctaagccccctgcggtaggagtgagacctggaagatatgggcaatgagacaaaggcccccagaccaccactggggagggggttctattcacaggacgggggagcctgcttgggaaggagcagggacagagctgggctgctctgcatgacacagcgggacagggattggctgggaggagatggagtgagtattcaaaaggcaggaggagggagacagggccgcagacctcagggtgggaggggtatgtggggttgggaggccctgacgggtctctggaaggcgaaggagctggcagggcttccaggttcactgtggagcagctggggtgctcttttgtctgctctgcctgcctccgaggtctctgggtgtctccctggctcactaaagctcgtgtgtggtggatctttgagggggaacttgaaaaagacacaagctttgccactgggacactgcacagggcccccgccagggtcctcaacctcaatttcccactcgtgtcccacctgcccggccccctctgctcatccccggccttgccaggggcacatttttacctccagtgcagctgcagagggagctggccacgggtggctgggttcacaagtcaggaccaagtgattaagcagggccacgtgtgccccctagcaatgagcagaaccgtggggtaaaacaaaatcactgggtttggaggatgaaagggtaagaagcaggtggctaggagaggggcacacagtgtcaccatgaggaggtgacatgatccccaggtagggggcgggaaggcgagagcgacagcgtcagcgtgaggctggcaacagacagcgttgaaaccgcagttgtgcttaggggctaggacgtgcctaaggttagccaaacaacagaaaccccgcatgggggcagcctgggagccctctttccacaccttcatgtccacatgaacccatgtggggccatctcctgtctcagtttcctcatctgcaaaatgagatcgtaattgtgctcctaaaaaattacaaggactaagtgaattattacatgcaacaaagttagaatgccctcaccatgcacagcctgaatgcagagcaagagatttcagtggagtggaaagaaatccacccttgcttcagggctaactttaatagcatccccgaaaacaaaggaaactccctgagtacaaggggaacctcctgccgaaggccagccctgagcaggtcctccccactcgcccaggtgagcagggctctggccgccctgtgcctggaggctgcgccaaaagcgctcccctaccaaagccctcgctttctcagtgccgagcaccatgtttccatgtggatttacaccacttctttacccctgcagagaagactggtttcctgtcccaaaaacagaactcgtgtctgaattgacaccaagatgaactcaaggccaggagcccgggatgaaggtagcatcccaaggcactcctgcagcgttagcagaactctctgcacacaggcacctgccacggatatgtgtgcgtggcttcccaacgtgatacaaggaaaagagtagacatgaccacagtggaacaaacaataaatatttaattgaatgaaaaaataagtaaggatcccgaggaaagtgttggttaaactgagcatggccagttccgatttttagaacctccaggggatcctggaatctgcttctccccactggattcgtaggtgttgggctctgctggccctgtggtcagaggtgataccccccaggcaggccagggggacctagtgggacaggtgtgggagactgagtgcaggcatctcagacagctgtttgaagcctcgggcattttaataaatgtccccctatttcataggcaaaagtttggtgtccctgaacaaaaccatccaactgtagctgagtgaagacagcactggtggaagcagctctgtgcccatgagggttctgctctgcaaggctctgtgcacacaccgaggacaccaggaccagagaaagccacatgaaagttttaatattcggccctcaggccaagtggcaggaagcaaagctgaggcccacccacctcaccaggaggcctctggtcctgctgctgtggccaaggagtccacactgcgttccctccccaaggaggtggcagagctgcacggtcccgcaatcccaccgcatggctccggtctagggattgggtgaggggctctgggagccctggaggtggcctgtcaggggaaggaccaagctgaggggtggagggaggagggtgaagtgtgaggctgctttgggaccacatcacaacccaccagtctgacgtgagcacccagcattggggtgacggggtcttttctcccacagctttttcacataaatccactgctctgggaggggagtgtcaagctgtccttacatccagagtgagtccttgagggccaccactgagacctgttcattccacaccatcagggctaaactggtctattccttgacagagcatcctagccccagaggcaatacggaaatacagacatgtcagcacagaaaggcaacaggattcccatcaagtgtctatcacaagatcagacagtctgagccacctgcgtggctagaattatgtctcaaggtgccaaacagctttacacagttctcgggattcttcaaagggagaagaactccctctatgagctcgaagacacgcgtcggaactccaggcgtcctctgacacctcgatgcagctccgtgagccttggttttcctctctgtggatgaggacacatccgctccctgggggcaggaggggacgggggctcagctctgcaggtccacagtgagactccctgggttgcactcctcaaagtcccttccgctagataagcctcagtttcctcagctataaaacggacgtacaccatctacttagcaaacactgcccctgcactgtggcaagtcttagaattctcattttttctcaggggaaatctctgaccacggagaccctgaacaggcatgctgtggacaggtgtttacagggcttactctgtggcatgccatcttgattataatgttttataaaggacattaattacatgaaagcattaaataaataattaatgtgatcatcaacagtaaacagcataataatcaacagcacacagtccatataatatattcttgatggttttaaaccataacgaaaatagaaaatgaaaaactgtaggttctagaagattcaagcgttgccaactcatgccgggagacctgcgctctgtcataatgttgcttctccttttatacctgactctgccatctgattgccctgaaaattacggccccgggttctagcctccactaagagtgctgccaggacttgacctcaggagttccttggattctttccttctctgttttcacggcccgcatgccaggttaggccctcctcatcttatgactcactcatgctataacaaccttcaaaacgatttcctgcttttaatctctctccactccagtccagcctgagacctgccaggctattcccaaaataactcttctcgtgtgtcactccctgccccaggcgcccgacaccttccccgccaagctctctgttcccctgctcctggctctctctcctgcacacaagcgcatctcacctcccggttttcagggtactgtgctcagcccgggcctcccctgctgccctgttagaagccctcctccctcagagtccagggagctccgaccctctccgtgatgtgttcttaactttactccacattttgacacgacttacctgcaccccaccattagtaccatgcgtgccatgacatatgtgacattttctaaggcccctatctaaatatttcatcttcaaaaggagtggaggctcctttggtttgaggcaaaagcatgttacaaaagaacaatgctaactagattgcaggcatttatgtaattatctatttatccatcttctatacccttacacggggaaaggaaatgagaaattgaaatgccagcaaaagaaaacaaagaccagaatgagagctcaagaagcacgtgaggccgggaggaagccacacaggccacaggctcctgggcagctattccccgtgtcccaggagcagtcacccatcagctgaaatcctccctccctctggagttagttacaggtcagggcgtcctgtgttgggggaaagaactgcagattcacaagcgtgcattaaaattaaatgacatggaagaggaagaagcagagaagtggacgtgtgggttctccacctcccacaagtgtcccctgtcaagatttgttgtcttgggaagataaaataagggaagaacagaagagtaaaagggataaagtgaggcgatagagagaaaagaaaagtaaggaaagaagtagtcagaaaaaaataaaagaagcaaacagcgcttatcctcctacctctgctcaagctataaactaaaatcgccccctactgaatatatgcccaagaagaagatgctgtgagaaaagtgttctgtcgaacccagggaccagcgtgtgcagagatggacgatggaaacccagccatggcaaactcaaggacaagacagaataacactggacagagagcagacgctctgctgagcaggaaacttttgcaagccaaagtttaaagatacataggaacaaagtagaataaagtagaataaacaaggacagaaaacatgagaaaattggatgctaaaaaaacctactctaagctgcatattaagtaaaatattaagaaataaggaaaaaaaagttacaaatgtcatccgttattatgccaaataataactaactggcctgtttggcttccagagcggatcaggaaccatcttaaaaacaaaaccaaacaacacggcaggctccaaagtgctttttaacaaggtaaacaagggtacttactaacaatatcccatagaacttagagaaggcttggcggaggagagagagcatgtcgcctaagttagaaatgatgacgattttggccagggagccacactgtctttctcttcaagcatggagcatctcactcctccacatttcagagagcaaacctccacgggagtatgtaaacattcaggctaattgtcactcgggatcatccgaaactcaggagagggcaagaggcagttgattgcagcaaggatatgacaatgtcacttttagtaactgactcagtccaacacctcagagtcaagtgcttaatatagggctactctttccgttgggtggcaagtttagcgaaattgaccacctgttcccttgcaagtctgcctgtctccagcctaaatcagaaggagcacctggcaccgcagctcgcaggaggtgctgcagcgattggattttgcctcctatcactgcctgtgaaatccagatgttctgggaccttctccactcctgagaaggctgcagatcaagctgctaaacacgcggaagtgattcttgttgtttttaatatccttagttatgtgtcttttctggagattctatttttgtaagtttaaaactctggtttccttgcacatcagcagggcctctactaaagaaatggaaaaaaggagcgtctcagccgtgcactcagggtcctgcgcctccatcgcaaagccccaggaggactccctgttccatatttgtggactgctccaagtccacttagccaggatctctcgcctggtctgtggccagggagatcgagggtacactcaatttgttcataaaatgtctccagcagttttttagaaagtctgcaccattaatatccccctcccccgcaatttaacatgatgtcgtttgcatccttgtgaatacagtgtgccaccaatttgaaactctagccgtgtccactaggtttttgtcctgggctttcccaaacaacagcttaattggagtcagcaatttgagggagaaaggccacaaaaataaaagtaactcataaaaaacaagttccactcaccaagcttagacacaccccttaggcacaggttactcctgtggtttgctggtgaaggccagaacctcacctcttccttagacatccctctgtcccctacctcaaagaaattcctttctcccttaacgatagttctcgccattctgttaaatgacaaaattgatagaatgtctctattgtgcattgtgtgacattgcagctcatcaggaatttatgagtcatttttgacaagacgatggcgaacctctttatgactggggctcgctgcccttatatctccaaagggctggatggcccacatgctctctgcctcccacacacggaggttctttgccatgtggatacccagagacttgagaaggaatttcacttggcagatcacttgaccaacacaggaaccggctgctttatttcctgttgaagcactcacctgggccacagaggagcgggagttggacggcctggctggcacttctcctcctttaggtgaacttgctgggaacatcccatattgtttagaagactctgtagtctctttctgttcacccatctctccattcacggtcttccaatacaataaagtcactactccagtgattcttgattccttaactaaattgtggagagatttctagtaacgtccaggataaaaaaatgtctgaaactgcgaagaacaaagcctggcccagaagagttcgtctaacactttttgaggctctgaccacctggtaactgggcaggggcactgcattccaaagtcgcaattgcaggatccaggaagctgatgcgaacctctccctacatggtgagaaccctttaccttcccgtagctttaaatatcactcgcattctgctagagtgattctgtgcctctagtcgaatctactgttgttggtgggaaacataccacaaagcataattatctgaatgacctgagcccttactgcatctttccacgttgagagagaaagagagtaattcattcatttaagaaatattgattgagcatgcttgccgtttcatcatctaatgtatttaccattcctcccagctgggttttagataccaatgtgatccatatgctatttgcttacataagtctgcttgtaatatccatttattcaataaatagatattaatcacttaggctatgggatcagctctggaaacacagtggtgaggaagagagatgctatcctggccaccaaggagctaatattccggtggagaaaatgtcactaagcaaataacgacatagacaaatctatgaatacagttgatatggctgctgtgcagtgagttgctatgcgaatggactcaggaagacttgaacccaggttggagagacaggaacatcctctctgagaaaaggtcactaactctgaaactcaaaaggtgggtccagattctctaggcaaagagaagtgtgcagagcagcccgcttgaagaatacccaatggcaaaacaaacacaacacaaacagaacaacccccaggagcaaacccggagccagagaaaagcgcagtgtcattgaggagacccacagagacgtacatggccagaactggccagaaaatggggtaagctcttgttaacatgtttaggttttatcctaagtgcagtgagggtcttgcagggttttaattagaagaatgtatttttctgattatgtctgttagactgggttcccaatcctcaggcctcagactggtacaggtccatggcttgtaggaaccaggccgcacagcaggaggtgagtagcaggcaagcgagtgttacctctctagcctgagctctgcctcctgtcagatcagcaacagaactagattctcctaggagcactggattctcctaggagcactggattctcctaggagcactggattctcacaggagcactggattctcacaggagcactggattctcataggagcactggattctcacaggagcactggattctcataggagcactggattctcacaggagcactggattctcacaggagcactggattctcataggagcactaaattctcataggagcactagattctcacaggagcactagattctcataggagctggaaccctactgtgaactgcgcatgcgggaatccaggttgcacactccttatgagaatccaatggctgatgatctgaggtggaacagcttcatccccaaacattttccctccctgcactcccccctcttccacggaaacattgtcttccacgaaaccggtccctgatgtcaaaaaggttggggacggccgttttaggctgcacagcaactgactctgatatggggaagagccggagtgggattagcagctctccaggaaacagcaggatgtctcctgcacttaggctgtggggagaagcagccccacgtgagatctgggtggtagtctatcagctgggtgcggactgaatcaatacgggggtgatcagaaatgagagatgggagatgctcatcggaaacctgaataggtagatggaaatgcatcatttgtattcagatgatttctccaagtttatctctatcctggacttaccttctgagcttcagactaatatctccactctctggtagaaacctttattctaatattccccaggaaactcagtgaacatatccacagctcaaatcattgcccctgaaccatccattaaaacagttcctcccccatttttccttaaccgagcaaatgtttatcagctgaaacggtccattttctacgtcaacttgacagggctgcacggtgcccagatactggtcagggttattatgaatgtgtccgtgagggtattctgggaggagacgaacatttaaattggtgaatggagtcaagcagatgccctctccaatgtgggtgggtctcacccaatcagtgaaaggacagaacagaaaagccaactcccccacaagtgagagggaccccttcccgcctggccaccttgagctggggcagcaatctttttctgcctttggactcaacctgaaacaccagctcttcctgggttttgagccttccagctctcaaactataccattggctctcctggttttcaggcttttggactcagactagaacttacaccatgggcccttctgggacttcagcctgccaactgcacagatctttggacttgtctgcctccatagttgtacgaaccaattccttacaataaaatctgtgtgtgtatatatatgtgtgtgtgtgtgtgtgtgtgtatttgtatgtgtgtatatgtgtgtgtgtatggatacaaatatagatatagatacatatcctatcggttttgtttctctggtgaaccctaatacaccagctacagaggaaataatattgtctagggagaaggtaaagttaaaaaaaagactcatataagctataggatatccccacattgtaaataaaccatagtgcaacccaagaaatagaaatgaaagcggaagttgaccacaaatcaagtaggctggaactgtggcagaatgtcccctgggcatgcagccacctggctggagatggagactacatttcccagctccattctgtcaagtgtagccatggggctaggttcagatcaatggtatatgagggaatcgatgaactcccaaggaatctccataaagatgaagccactgtcgtagacttcttccttttctgttttctgaaggctgaatatccaatttgaaactgacccagtttaaactctgcaaacaagaaccacaccctaaaagatggtagagcgagaagatggagggaaccttggttgctggatgacctggtggagcagagcttccacaccagcctggactgttcagctgtgggccggatcccagaagggaggctaatatctctcctatttaagtcccaacattctgaaatctctttgctacagggtttgtttggcttgtactgaactgaaacagacatggaaacacacacacccgactaagcaacatggatggatggccgttccctcgactggaacagaaggcatgtctgcctgctctgctcacttctgtagccccagaaaatgaggcaggatctggcacggggaggactcggcggctgtatgtggaatgaatggatattggaagaaatacagactggcagtagaaggatggtgaagaagtggggaaagagtcgatagttaaatctctttacaaggatttgctgtgcagagaagagagtgactgtaaggactggggtccggctgggattcctgtctgtgccgtgcaatgggcatgtgtgtacatgggtgacataggaaatgctggggcatatttccacaaaaatataaaaaatccgacaagagaaaggactgcgacacaaaatagagtgtcataaatttcctggtatgtgtagcaggtgaagtactttcttcatatcaccagaagggaagaagaggatgggtcggtatacagcaaaatctgttgggtcacaggcaggaattttaggatgtatctgagtgatgactcttaaaaaacttctgtctggtgggaagcaaggtcaacctctggagagaatgctggccagtggaagtcaggctgaggtcaatggagaaggttgaaaacagtcattgtggagtgagagcaaagtgagtatagggctatggtcagaataaagggaagttctcaaaggctgatgaggttgggtaccatgcatttttatagtaaccatctgcccagtgtgtgtctttcccagcaactgtcaggtattagacagacatggagaacaggaaacactcgacttcttctggggctgtgattttccccaatgatcaaaattaaaaggctgaagggcaacttccgttgaatattgcaatagagtagttactgcctctctgttggagagggaagaagctgctggcaggaagggctggtggatgaggtggcgaactcgtcagcggacgggaggttctgataggacaggcatctgcactgtggctttttaaccagcctggttggaggacggaaaatggaggcaagagaatgtgctcaatgattttgtcaattagaagtgattaagtttccaggatgacaaagtttagaatgacggctaatttggagtagagataaacatcactggagatgaggaggcgaggaacgaagaggtcaggtggtcagatgtgtttttcaggaggatgtggaagatgccgagtagatagcaggcatggtagtgatgaggaagactggcatggattccagcgacccctatgagtgcaccgtagtaacacaggtggagtagatgacaactaagaggagaggagaggcggcatcatcaggttgcatgagatttaaagaagcaaatgtttgtccagctaatagaaaggctgtggtcagaaaactacctgaagaggaaggatgacctggcactcaggtctcaggggcaaagagagagcaaattgcttccacttgagaggatcacaaaggaagtgggttctcaggagccatcagatcctagttaaggaaagcaagaagaatcttgagagaagagtcaaaggtaaaagggcatttttttggataaaactacaaaaaaaacttgctttctgagaacattaaggaaaacactttaaatcattttcaaaatgtctaattgatatgatcttcagaaaaacattatctagtctgtatagaaattcatcttgaaataagaatgaggcagagtgatctttttaaagggtgatatatacaagtctttagatcagtgtaacatgactgtgatcatcttaccaacaaaactcaaaatcaattcagagagcagcatggccttggagaccacccacacccaacacaattgtacatactgggctttgctgtcaagttaaggagtgagcaaatgagttcggtatcaaaggtcatatgttttcacagtcattcgaattatatcccaaaaacttgtcttgtattctctatcttttgacttttttttccaaagaactgattgcacagtatacagaaatcctgctatattttactactttaggtggagtctaattttttgtttttaatttatcagtgcttaaaaatcttcaaaatagcttagtgaggctcatgacagtgctggccacatggaaatgtagccttttgttgcctttaaacactgtcacaccatctatgactgtcccattggtctgaagtgtactggcaaactaagcatcctgtaagacaagctaaagcttgctttttgccaatcagttgaaagtcctgcatctcttcattgatgcactttctttaggtattgatagtcaaaagcacaaagcatttattatgcattcaatcatgtagctaaacaaaaaactgcagtctcctgaagccatttaaaccagccgttccaaaatcttctgccaccactttgttagtaccatcagaaactttctcaactataaatgaaagaataaatggtagtgctgctctccagatataaggcactgctctgtatctttgaacatttgatttttttaactcataactgtgtcaaaagcctcaaaaaaccctgaaattaattttccagctttactgtcaccagccagaagtaaaattcttaatttgcctattagctgttgctgttaaattttaaatttattttttaaaaaacggttggacttctatcattataaagtatataaaattttcaaaaaaaaaagaacaattttgcttttcattgtattactgaatacccgaggtagttgagtaaaaatgcacgttttatacccctgtcaacaccgttcagcacttcccttaggttactcatgttagtgttaagtaaaaataaaactgagaacagtttttccatgctaatggcttaacatttaagttcctgtaataattattctgctccaattttaacaattggatttaggaacaatctatttgatgaatttagtgaaagcatcattaagccaatttctggcattatgggggaatattaagaataattagaatatctgttatactgtgagactacaacaaagggaagtgcagagctcttctctttcccccctctgccaccctttttttgtgtgtttgttttaaagctgggtgtcatacatttcagagagcataaagtacacattctcacagagacaggagttcaaaagttgcctggtcctcagaaacaagtggctaggtaaaaacttgtgcatgtgattctggatagggggtcagcgcctgtctgtttgttaagcaatctgtctttggtttggcatctgcctccgtggtgggctgtttcctgagccttacttccgtcttgactgaggtggtccactttgcagagccttctgttgttgctgctgctttacctgagtcagaatttcctgaatttttctctgggcaacctggcaagcatagaagtgaccagttattttgacaaccacttggtcattctcatcaggtgtctggtcacaagggacaacaacttctgcacttgacaaattctgaagttcattcaccgttttgcctccttttccagtaactgccagcagcaaaggatggcactctgatatgagcttcaagtttcacctcttctttaggactaacgaagttttcttctttcatttttccataattcttccctgagccttgaaccgagcctctggtgatccagcgatcatcaccatcctcaccttagcatctggtgcttccactggagcaatcttacttgaagctccagcaaagcgagaaagctgcttgatgtgctggccctgcttgctgatgagggctctgactgatagagccgggataaacagatgaacagtctcggattctgattgctcagactgcggggagggaggagtcatggctgaagggggccctgaggtgggaggtggcatccctgaagtgggtgggaacagacccaaggcgttcagatttaatccaggaattaaatgtgcttgaaatcatagaagtgatatcattttcctaacgctccctgattttcttcatgatctcttcctcagctttggcacatgtctcaacattgcctttagctgtaatggtgtgttctggattatactgcatcagttcctgcaatggagatatcgtgattttagtgtctgtgtcttgctcaatttttttaagatttcttccttctttaccaataagacggccaacaaagttattttgagctaaaatcttcaaggggatctcttctgtgaattttacatcttgagtttccttacgcataatctccagaatagacttacaagccgcagaggtgccttcaggagtagagaggatagtaatcgacttctcagcagcccctgcattttctttacggtggacatcgattttagactgggtctgtttggtgatgttccgaatggtggcaccttcttttcctataatggctccaacaaattgggtgggaaccagcaggcacagaggcaaatcacatggtttctgcttggacacggatcctggagacccctgccttgaggagcccctctgcccaagcccccggcgacctcggggctgcagaaaggggttttgctgggtggccatttcatcagggatataggctactttcaaggtgaaattctctaactgaaatccattcagtttgtctagtgcttgtctagcgcttgtctagcttggtccttactggaataggttacatttacaactgcagtttccgagtcagtgttcacttgctgacagctctccaccactccatactggactagtcaactatccagcacctcccactgtaagtgaggagggatatttcgtatctgaagtttccgaatcctttgcctttttgggaccgagtgctcaacttctatgggtttcccgtgcagttctattttacctgaaagcgcctcaatggccttgagggcccagatctcgtctgggcagtccacgaacgcgtagccaatcttcaccaggaagggtcccgacacggggatcttggcgtccttcaagataccttctaggtccaagggggcggcgttctcgctgaggtttctgatatacggtttgttcattgtgaagaatggttgtttaaaaaaaattaatgagaaaaacgaaaattaaaaccacccacggtgatggatggatccagctggttttgttcccctcgtcttctcgcctttaaaatacacaaacacagtaagaaccaagcacaagaacgaggagcaaaaaatcagatccgaggcttgtttttccttgtctagatatgttttaaaagagaaagaaaagaaaaagcctagctacaaccgaaacgcatccaccaggcttgaattgagctaacttttcacagtcattttttaaccataatgctcatctaccaagcaatacaggggcagtcgtgtttatcacctatgttataattttattagctgcggaatgcttattcgtatatggatgtcaatggctacatgtattgattaaaactcccttcccaattatgttactatgggaacagctagaaacatttcaaatgttaattaccttttgttacacctgggtcacattagcagtcactgcatgggaggggtgctcgctttgtttggattggcattctgcctcctacacggggttcaattaacattagctgagactattttttaattcaaagaatatgcatattgtcttcattatgaagcctagaacatgattttctcaggttgccacatcagtcagatagagataccgtgtagtttataatcacagctaaggcagctcagcagcgtgttacatccaagaggctgacatacaggagagatgtcatttccttcttagtctgcatcattaaaaagatctttttttcttctgaagtctttctcttggttgctcaacatttcttcacagaaggaatatgaaggaaataaagtgatacatagcaggcgaaatcacggaagcaggattttgtttagaagaatgcaaggctgcactgactgactacaattcagaagagctgcagctgccaatgtcctttctgcaattcattaaccttatatgtacctttccactttaagggattttttccactcaagaaaaaaacaaaaggagaatggaaaaaattatagaaatatgaaatgggacttacaatgaaatagaataatttgcatatttttctcaggtaacatattttataagacaatttcaattcttccagctgctgtcttcagaagagcttaaatataattctggatattattttcatttaaaagaagatattggctcacacttcttgcagaaagctgaggagccagaacttgacttcgtataacagaggtgagagttatatccggaaaagaacaattctcccctccaaattaggacaagttcaacaatatcctaaatcacagtgattttaaatacttttcatgcttataagagattttaaaatgaaacagcaatctgtgaggtgttgatagcatgcagtatgtagccaaggtgacccaaggtcagtgtctccttctagatgcatctgcaggtagttagcattcgccacccacacacctggcccaacaggaacactgacgaggcatgcgcatactgctgatgaaatgcagcctggtttgctccagagcacatgttttctaaaacacacgtgtaactgatagacttagcgactgactaggtgtgaagataatataaaagttgcattagtcatgagccaatttctctgatgcactcacgttttaagtcaccgtgtaacagcaggtctgtgctataacacaaaggactgtgacacaggtgaacacagcaagacaccaggaacacacttggatgcccatcggccccaggtttcttctgctggtcctgtctggccatgtgtttgggtttgaaagtgtccagattgcctggttctcctggatcttcacgcaaaagaaacgagcacatgatggtgacctggaactctcctcgctggcgtcactgcatttttgcaaagcctgtaactgtcctgtctgcattctgggctccaaggctcagtcctctgatctttcctgacctgtccttcccctaggctgccttcctctttttccttattacagtaaagttctgtatgtactgcagcatattccatttattgggaattgaatatatttcttctatgccaggatttaaaattaggattgttaatattgtggtttgtgctctggttacagaatttctaaggtttgggtgttctatcccagcaccatattttctcaaagccttgctctctgcagtgggtgattttgcacaatgcaaacttctcaggtactttcttctgagctccaggtccccatatccaacatctactcaacatcttattctgagatgttcacctcaaacatgtgagaatcaacatgtcaacatgtcaatacctcttgcaggatttcctaactccacagatggtatccgtccaattgtgcaagccaagagcaaggcgccagctgggacgtttcccatacccaatctatcatcatgtcccattaaattttaccagtagtgtttctcgaatgtgtccgtttctctttgtctctgctgccaccttcatcttacacctgaatcactgcagcagcctcctccctggccacagcagtctatgaaacactaatctgagcagatcaccaccctccgcacaaacccttagggaactagaagaaaagtcgctcaacttggtaaaggctacattacaaaaacaaccagtaaacatcacactcagtggagaaactttaaaatcagaagcaaagatgcccattaacatcacaactgcttagcatggtactaaaggtccttacagacaaaaaagaagaaagaagcaagaaggagagagtcagaaaacaaaataaattagtggtataagatttggaaggaagataaaaaacatccttattggcagatgacacaatcctagacatagacactccaacagaatagagactattaaaactaacgagagttcagtgatgttgatggatttacagtgggcttaaaaattactagcaattatcctcacctattgatacagactgaatgtttgtgtctcccctaactcttatgttgaaatctaatcccaagtgtgatggtatttggaggggggtctgggaggtgattaggtcatgagagcaaagccctcatgaatgggattataaaagagaccttatgaaagagactctagagagggccctcacaccttccaccacgtgaggacttggcaagaaggcactgtctgtgaaccagggagcaagtgtccaccagacactggatctgtgggttcctcgatcttggacttccagcctccagaactgtgagaaacgaatttctgttgtttataagccactccgtttatcgtttttcattacagcatcccaaatggactaacacacctgcaataaccaattacagtttttattaaacttaagtggtgaaattttatcaaatacctctctgtaccaattgagaggaccacatggctcatgttgctatcaacaagaaaagataggcaacccaacccaaaaaacaggccaggaatgaaaacagttcacagcaagagaaatgtaaatgactggcaagtatgtgaagagttcctcaactcagtcaatgtaaccagaagaaataaaatgaggagaagacaattcaagccatcatatttataaaatgtaaaggcgtcatacaaccaagagttggtgagcgtgggaaggaagatctggggcctcctgcaattcttctggaagcgtcccctgccgtgactgcatggagaacacttgagcagtcatgaagatgaagaacgagtatcatctgtgctctttccatcccatgctgcatagcctggagaccccagacccccagccctccacgactggatgggtacccaggcaaggggacagctagttaggcaggctttacgcacagtacccagggggaagtaaagccccgtgccaactgtctgtgcaaaatgaaatatcacacgcacagcctgttactgtgtatcttaaaggatacattcatatctaagaatatagagagggtgggatcgggaggaaaagtaaaatagtattaaacaagaagagtcttattttgacagttgtgctagagttccttgaatagtagtaacaaaactctgcataggaagtttttgaaaaacattaagagtaaatggtcttcagatttattggtggaagggtgacagccattcaaatggataagttcaatttaggagtgaatattactcaaaatagaacaaagtccaacatacctataattagtgtgcaggaagaagaaaagtacccagcaaacttgagagtaaaggctgatcagagaagagagttagcaggcaaaggaagagaaaaccagcatctgctagatgccttccttgtggcagcactggacagataaccctttgtgcaatgccggggttgccgggaagggggcagctctgctctctgtgcagatggacggcagcccggcagccacgcagcccgcagagcagagccgggttagagcacagttccgtctcacccacacggttagggagctccaaccatgtggcagggagactttcaggaataagtgaaggtcggtttccaaagtgcagcatgattcttagtaagcaaatattgttgattcattacaaaggtaaatagaaacagtttcaatggagcagtgaggaacaaaaccaggtgactgggtggtggggaagtggcagaggaatgaaaatgacttataaattaaggatagtgaatatctgggcacgtttaaagttatggatgacagtaatggaaggagtgcagaatcaaggcccagggtcattataaaggaggaggtccagacaggtgcacctggatcagattgggaggtgactaaacaagtgacctaaaatgtataaatatagtaccttaattatggtgatcattattacttatcttcagagagtaatctttctttctttctctctctctctctcttttttttcagggtcttactttgttgcccaggctgaagtacagtggtgcgatcttggctcctaggctggtggccttgacctcccaggctcaagcaatcctcccgcctcagcctccagagtagctggaactacaggtgtgcaccaccgtgcccagataatttttgaatattttacagagacagggtctcactatgttgcctaggccggtcttgaactgctggccttaagtattccacctgcctcagcctcccaaagtgctgagattacaggcatgagccaccacaactggcctgagaataatttcttttgctaatattgtacaaccacagaaaaaaggaaaatattctccggtagaattaaatctatatacttacacttatttattaaaaatatttgtgttttttattggatctagaaaaaaacctgatttaattcaatatatttttgtcactatgtattaattctgttggaaacataataggattgagcttgatgtcaaataacaggatgaaatcttttttttgcataaaggaacataaaactatttattgaccactcttcacaagtatttacaataaagtaaacattatacagttggataacattctgattactgcaaagtggtttttcctggcttttgaaatcacttttaagaatagttaacctggacttgacacagaaaaatctcaactctcaaaaagctaagccacaccaaagaaactgctttatcaggttgttgaaaacatttaggatgttaaaaataatttcagtataaacaaaaatgctttcttccttgcaacttccattcctcctgccttggaaccctggcaaaagctaagaagttagaagacattccaagacgtttcgcaggtcctgagaaggtacttacacacccgctgagagttctcgtcaccaggcagtgcacactgctaaacaggctttaccagtaggcctttactagtactatttacagttacaataaataactttctctaaagttttaccacagtgacttccttctcatacaattgaacttgctcactttcaagtgtaattatatttttgaaatacatacttctgaactgaagtctccaccattaattttcatgggcaatacatgataaaataaatgcattgtaccacaaattgcaatgtattaagttctgtggagtaagtgaagccagtcatgtagacaactgggagagatatgaaatagaagtgacacaccgctccgtgttgatattcaaagtagagaaacaaggaagaggtgtgagccacaagctgtgagcctgcagtggggttccatacacattcccccagccgggtactatcggcttgttttagcacgcctcttatccgggttgtgcctcagtttcctcctccttaaagcagcactgaagttcatctcacctctgcttccctcaccggttgtcataaagatgtaacaagataacggatgtggggtgcttgtcaagctgggcacgcatgtagaaaatcattacttttattaatggaggaataagaacaatagtcccagaagtcagaaataaagacacaacatatcctcaaaatatccttaaaaataaacacatgggctgagtaagttggctcacgcctgtcatcccggcactttgggtggccgaggcaggaggattgctggaacccaggtgctggaggctagcctgtgcaacatagtgacactccatctgtaccaaaataaataaataaataaacacatgaccaaaaagaaaaaactatttgatggcttcgctttatcctaatctcaaatcacattgttattctttacatcatctttctttcttcataaaagtcagaatctcaaaggaagttggtcaagatcctgatgtgcagatgggttaagaggattagtaaatgtcaaataacaaaataaaaagaagaaagggatgaaattaagtcctggcacattcctcagttagttgtatttcctctttctggcccagacatcccctggatttataggtgcgtaagtgtcccttctcgtcaccaggacagctttaactaccatcaagaagtatttttcaaataaacacttcagtctctgtgtctgaagtgtttatttgactgatcacagctgagaacaagttaggggttgacaaggtcctattgtgggcagaacaactgtgattttctaaatggaagcacatctttaaaactgtaagagggtttcagttttcatgtacgccatattctattatcgaaccagaatcttcactctgaagtactattcaaaatcctgatggaataataatcaaattgatgcaacttaggtttaatcctgttcacttcttaaattatcacacaatgtcttttttccctatccttacaaatctcatagtttacctttgtaagtatatgtgtatgtcaatttaaaaaaatacaatgaaatccctgaacatctgaaagattccattcaattttgctgttcttattaaaacttatttcaaatctggagtattcaaagtaacacttgagtcataatctctacagcatgctttagcctttaatcagttatattggacagatcatcctcaaacactgctctcagcaccctgatgtcctcccaccataatgtactttgttctgtactctttgatatatttttttgtaaaatatgtatatatgcatgcacgagtgtgtgtgtgtatgtgtacggtgtttgtggggtatatgtgtatggtatgtgttgtgtgagtgtgtgtgtgtgtgtgtgtgtgtggtgtgtgtgtgttatgtgtggtgtgtatgtgtgtttgcattgtgtgtctgtgtgtgtgtctatgccatcaaatactatctcttttgattacatcctggaggtgcatgtgttatgcatccttcttctcttccaggaagatggactaggcatgtatttccctattcttcccactaagtacagttggaaaccctggacacttcctggaagatgactctgacaggaggagagaagaagtcaggatagctaagggcctcaggacttgaggagcaagctggtggagaattccctgggttttcctttgcctcatgtgtactagacctgaagccaaataaatcagcaacccaggaattccagcaggcacagacaaaataaaatcccaacaaaagcctctagccacaggaccagggaagggggcagaaaactcttagatgataactgctctactttagccaaacaacacagaaaaaccttggccccaccttcacccatgccagtaaaggctgtgtgggtggcctagaattccaccctcattagtctgtaaggaggtgccccaacatccccccaggggtggtgtccactggtggtggtggaggacactgaggactctgaccactgcccaggggtaacaaggccataagtcttcttgggattagtggaggccacagagggagctggagcctccacccccacaaagcaggaatagccccacaacttccttcattgcagtaatgaggtggtgcccccacttcctaggttggagtcacgtgagacccagtctgttaaaacagaaagcttatataagatccagagtctcataacatagtgccccaaaagtctaggttccaatttaaaaaaaaatcactaattacacaaagaaccaggaagatctcaaacagaaaaaaaaaagatgccaaaccaagatgacagaatgttagatatatctgacaaagatttcaaagcagccatgataaaaatgcttcaacaagcaatcacaaaccagcctaaaaccaatggagaaacagagcctcagctaaggaatgggagatataaagaagaaccaaatggaagttttagacatgaaaaatacaaaaccaaaatgaaaagtgcacagactgggcttaatagctgagtcgagggaacaaaggaaagaaacagtgaaatgaaggatgaagcaacagatgttctcacctcaaaacccagagaaataagagcagcataaacccaaagcaagcataagaaagaacataaataaataaaaggaagtgaagaaagaaagagagagagagagagagacagaggagaaatccatgaaactgcaaacaaaaacaacagaaaaaacccatgaaacaatgagctgattaaaaaaaaacaagaccaataaaattgacaaatctcttgcaagactgattgacagagagagagagaggagatacaagttcatatattaccagtatcaggaatgaaacagagaatcattacagatcctgcagacttggcaaggataataagggcacactgtgaacacctctatacacatggatttgataaatcagacagaatgtacgtagggatgcccaccctgctggtgcagcctgctcaggagtggctggacctaggtaagaggtccacatgggtttcaaaaagaggctcagggtcactgggggaggaaattctggcagcccaggtacctggagaatgtttttggagggaagggtgcaaactgtggataggcacatcacctgaccttcaaagactctcatctggtggtgagggcaaggccagcagcaggcagaaggagctctcaaatgctcagcgtcagggcaggggcccctctggtccagctctaaacactgtgctgagtacagatggtttttttcttgacattgccaatgagataacactcgtcaaaacagaggacgactaaggatctggagtcaagagttaacagccttcaggaaggcttagcaggctttgcagctattcctttcattatctaacaagtatctgtgagggttcttgctataactcagtatctgggccaagcatgcagtgtggggttagaaagagacgcacggacgggctgtggcagcctggggagagtgccatgcacctgcagaagtagtgtgagcctctcacgccatgatgaggtcacagttcccctgcactatctcttgatgtgtgatgtcccaccgaggcccacaggtgggctgtgtccctcgatgtctggaacatacattgaggtcacagggttctgccttcccggcgcccccttctagatgttgccacgtggtcaatggataagcagacagcacccgaggagctgctgaaacacagcgtctatcccgagctttctcttccttagtgctacttgctcaacactgcctgtgcctcatgtctcgctctctctcccctgggtgggagcacagggagaccactctgtgaagctctgggttcccgacagcctcattagaaatgaagccaaaaagcacaggcacagatcaggagaacagggttgtgacccctggaaatgacacgtctgtccctggaggtggcgtccttccccatgcttcttcccaaggtcagtttctgatgagcttccatgacctcctctgccaggccacctgtgccttcccactgcagagctcttccccatcccccggaacacaactcactttctctcttttcagggcggaggaaacccagctccagggtgacccacagccacttggatctccgggtatcagaagactggcgccaggcccatagccgggttttcacaccggaggaggtgggaggggttttcattttgttttgttttgttttgttttaataaagtcatgcttgattaaataaaatgagagaaaagtaaatttaaggaattgtgagggagaagaaagagcagattgttgtgaacagttggtgggatatctatgcagatagacagtgcacaaaaattataggacacagctactgattttttctctgttctccttttaaaggaccagtgcgtagatatctgggtcacagccctggggagaaatacaaaaacattcacgcatgatatggagagaaaataaagaatagaaatatccatgactggctgaaaacacatgaagaacaaacacagatgcacgatttatgtgttctggaagcaaaaccattcctgcctaatgcagccatttattcagctttattattctagcaagtaaaaaacacaaaactgcgctttgtgaaatatccggagggaagcagaggaggaaagtgctgcctgtgatgtcctggggtcagcactggccacgttatctgcagagacgactggggtcatggtgtgaagttccgtcgtggaggaagctgacaggcttgttagtgcgcccctcatagtcagcggtcaccacaccctgtcacccacgttaacctatcgctgctgccatcacccagttccaagtcccagtgcttcatacctcagcttccacaatggcctccctgatcccgcctttccctatgggtttatgccaacagcccagttgggttaggcttccccacaccctgttccaaccatgtccatctcctggccagccatcagtgatgaattattccttcctgtgacttcgagcctaatcccagcccacagggtatcaggcagggttacccccagcacgctgtggggatgggaagaggtgcaggccagtgttctttctgtgctactggtttgaaacacagaacacattctcacacagagacaacagcttgaattgtgcttgggttctcatgagaaacacagaaaaggcatttgactcagagctgagccctggtgctcttgtttcgggtcctgggaagagacagctgtgagatggaggcagtaggaggtgaaagaaaatagttatttactggttccttatggttgaattgtataccctcaaaaagatgcgttgatgtcctaacctctggaactgtgaatgtgatgtgacctcatctggaaatagggtatatgccaatattagcaaattaagacaaggtcactggggtgagccctaactgtgcctgactggtgtccctaaaggaggagagacagagacgcacagagggaagacagccacctggagacagaggcagaggcggggcaatgcgtccacaagccaaggagcacccgaaccgcctgaagcaccagaagcaaagagaagggcctggaacaggctgtccctccccgcctcagcaggagcccactctgccacacctccaactcggacttccagcctctggatgggagagaacagagtcccttgcttggccacacagtttgtggaactttgtttaccacagccccaggacaccaataccaggtcccaggcaaatttttgtcagaaatgcaagttggctttggcagcctgtgctgggcccgtattctggtctgttctctctgctgcaggccaggcctcaggctgtactgggcaccctcccttcccgtccggcctgtgctccttcttcagctcaccctgaggaaactccctctccaaacaccaacacatccaaagcagggggctgaggagcaaacctcaccaaagccttctgccttgcagacgtgagaaaggaaaggcagtggagggtgggcaggtggagcactgggaggccccagagactgcagagcacccctccaggcagcccgaggcgggaagcaagcccagcacagcccctcctggtggcttccctccaacttggctgggtcagttagtgactccgctgcagaaggagctgcgtcttcaaatgggaggcatggacggtagctgccaccatagaagccgggccttctccctgcatggggcacttgaattagtctgaccaggcttcctgccagctgcctcttaaaaaggagtaaacttatccaggagacaaaattgtggggatagccaaaaaatgctgggtgagaagaggaatgagagacagcttatcctagcaaatactaaaatacgatattaataatagcacaaaaaggcaaattaatggaacagaaaaatccaacaacagatgcaagcacagccgtgcatcacttaacaacggggatacgttctgagaaaggcgtcattaggtgattttgttgttgtgagaacatgacagagtgccctggcacacaccgaggctatctggtgtagcccatggctcctaggccggagcctgcacacacacggctgcgctgaacactggaggcagctgcagcttcctggtcgtgtatccaaacatagaaaagctgggccaggcatggtggctcacgcctgtaatcccagcactttgggaggccgaggcaggcggatcatctgaggtcaggagttcaagaccagcccgggcaacatggtgaaaccccgtctctactaaaaatacaaaaattagctgggcatggagacgcatgcctgtaatcccagctacttgggaggctgaggcaaaagaatcgcttgagccctggaggtggaggttgcagtgagccgagactgcaccactgcactacagcctggctgacagagtgagactccatcaaaaaaaaaaaaaaaaaaaaaaaaaagaaggaaagaaagaaagaaaagctgtaagtcctcacttcaagtcattgtaaggttttggaaacagacttgaagcaaaatgacatataactaaaccagttttatcacaggttaactgatgtcaacaagagttaaattcctgcagcatatttcaagccacaaaaccgtcaccaagcctctaaataaagaccaaaccgcttctaatattgaacatggaaataaatgtaagctatgcggacatttaagaaaaacagaaaaacaaataggacgatgatttcccaccgactccaggccagggtctcgagttgccggagcctgtcccggcagctcagcctgtcctgcgaggcagcccccatcctggccaggacatcatcccagcgggcatcaattctttttcacatcatcactgtatcgaaatgacattgaatgaaacgacgtcatttgaggacctgctgcacaggtaaaataccgtattatactcttatgggaccaccttcagatgtgcggtctgctggcgaccaaaacgtccctctgcactgcacggctgcatatgtaagaggttaagacatcgtgatttgtgaagtcagaatggaaaaggggggttgtaataacaaattattcatttggaaaaatagttaaatccctcattatatacctcacaacctaaaatgtcagaaaagacaaaagcaaacgtgaaaatttaacacggaagtaccagaataaagtaagggtgatcatttatgccatcttttgatggatacaacttttccaagtgtaaagcatgactaaatttaaaactttcggatgtcaaaacactgtaaccgaaatttaaataaactgcaaaaaaaaggttttgcgacatgcatgcaaagcatcagtgctccacgtacagaactcacacaaatgaggaagagaacaaggaccttgctcatggctgtgtaggaggatccggagccagaaggagcagggagtgaggatggagaatgggctgctgggacacatgtgggagggagatcaggacacaggctgcgagtggaggccacgcgctcacctctgcaacagagggaaggaggtggagtgtgtctgtgggcaactagcaggtaaggaagaggagtctgagttcgtctgaggctcaggttttgcaagggggtggaggcatcgccattgctgggaacaaggagcagagcattgcaaagaggttaccaaaaacagtgaacatctgggatcattgctgtgtattccccgcaacagagagctgcagaatggcccaggtgcgctgtaggagatggaagagaacaggaaccaaagaccagccacagcctggaggaatggttgccaaagaggctggcgctgggcacacactggcaccaggagtctctcccagctctgctctgccaccctgagaatgggaagaaggccagggaattttgcaagtgggagccaggtgaggagagctggggttccaaggaaactgggatgttaacagggaagagctcagcagaccactggcagtgacagatcccgcgggtgaagttggagcagcgtggggttggaagggagtggggtgcacagcacacgttccatccagggcgagttttagattccagtggtagtgcatatctctctaagatccagagtgcaccagaaacacaggtcagcatgctgaaatgacccagaaattttaccaggggtgcctctcacaattaactgtacttgaggcaagcccatttgttatagatttttcgccgatgattgttttattatttgtcatttttcttttttcttcttttctttcttttttttttttagacggagtttttgctcttgttgcccaggctggagtgcaatggcacgatctcagctaactgtaacctccacctcctggttcaggcgattctcctgcgtcagcctcccacgtagctgggattacaggtgcccgctaccacgcccagctaatttttgtatttttagtagagacaggttttgccatgttggccaggctagcctcaaactcctgacctctggtgatccacccacctcggcctcccaaagtgctgggattacaggcgtgaaccactgtgcccggccctatttgtcatttttctatgaaggcaaaagcaactgtgcacatttaccctcacttccccttaagtagctttctgagctccaggcacaaagggaactagggaaggtcttatctagcacagggcaccatgcagactggcagatagcagttatcagaggctggcatggggggaggttagtccccacagtgccgatgtaggaaataatgctcagccttatgtgaggctgtttgagtttccaaggcacccctaaactaatccatcaggaaggcagaaaaggctttggagatcattttccccttaaaaagactaagcattccatgttcgtttgaagaaaagtaatagttgtaaggccatatcaaaatctaaaccaatacatattgacttttttatcatacaataaaatgcaaccgtatctgaaaatacaagacacgagtatttgtacacattctctttaaagtggttaaaataacttggcccccaaacatgaattaatgaggacatgcacccgagaaagtagcacatacttcaatacagacgtatctgtaaatctcacccgctggtgtaagatagctgccccgcacatgtgcacagaggtgacataaacttggcaggactttcagatcggttatgtctcaataactgaccttaacttaatgaaaagtgagatcccaatatttctaaacacaccgaacagctcttttgctttttcatgaacctagagaggggtggaacaggctaattaggttaaaagtctaaccattagattttttcttatttgtgtgtctgtatacaggcatatatgagtaaggattaaaaacattaacatttaaaggttattgactttgacaacaaggccaatatacttggcaccagccggcaaacttttctctacatgtacaggtagcaaacatttttggggccacacaacctctgtcacgcctgctcaaccctgtctttacaggggaaactgccacagacaacacgtaaatgaatgtgcatggctgcgttcttagaatgcgtattggacattgctaccatttagtgagctcctcttatgtgcttggaatgcactatttataaactctcaggttgggaacataatgttaattacattattcatcttccaagctcactacaaagaataggtttccacaaatgcttatttatggacattgagatttgaatttcatacaatttttatgcatcatgaaatcttcttttgacttttttccaactgttaaaatatgtaaaaatcatccctagctcacatagccagaatgtatgcaaggtttgatatcaatgagagctttaaatgaatttaagcttgtttggaaagacaagtaacctgcaatctctccttctctgccattttaactgcctttgaacaacacatgtctgtgacgatgtatctatgaaaatacatctattttgcatggtcttcttaaaccccacaatggatactctgaaactaactcagtgtttgatcatgtattattaaatgtcaaaggaatgattaaatgaatgcatctccaactctactcacttatcattaaaacgttcatcaacggagggatagtcaatctcactagtttcagactgaaagccgactactttcggctcaggaactgcaagggagcatgatcatcagtcttgcattgatcccaacaagcatcatcctagttatgctgattagagtatatctgggagatcttataaagaatgttcatattataatttgcaaatgctatgtgccaactttcaaccacagtttccagaaggaatttcatggcaaatttctgaaagagtggcagctttgagatatgtgggagaaagaagttaactctaaacctttagctggcttaaattcccaattcagaaatcttcaagccccaaaataccctgagtgctatttcttataattactattaataagactttcacttatgtaaggattcctcattgaaataattcaaggcacacttttaaacaacaaaacattgtaaagtgggcatctttgtattaaattcctattcctattttattttaggtaataagtattcaaattttggtgaaccctatacaacaataactaccatttagtgagctcctcttatgtgcttggaatgcactatttataaactcataagttgggaacatcatattaattacattattcatcttctaagctcactacaaagaacaggtttctaatcattataataaatggagaaatatgtcacctaaataaaagaatggatgggtgatattgaacacagaatatctgcaatgcacttcttttccccaaaggaacccaggaacccagatgaaaatccaaggctctctgactgcagaaacggagctgtcagtcaccacctagaaatctctccccaaaaataaaagtgtaagagaaagaaaggcattatcaaagaatctaggaagtccttgtatgagaaactagcactaaataattcactttttgagatagtttgaacatatttctaactctaaataaagggaaatacttggtcataagaaaaatgacctctgtgtattaaatgtctagtttgtgcctcgcattttacattcatatcatatcctcattatggacagagtagcccattccaatcacccttattttactcagaaggaaactccggcacagcgagtttgatttgtgcagagcagcaaggccgtacctgcctagctgccactaaatcacagggagcctagaacctcccacgaagcagggatgagctcctgtgtttaatctcagatagttgaggagaagacgctttgagaagctgcatgtttaacactaaagggtgatttcacagttaaaagtcatcttacatacacttcacaggaaatggaaatgaccccactagtctgtgtacctcttaacacctgagttcacacaagcaagtgctccatcgttactttacaaggtgactaatttcttaacaatttcacgaggatccctacttgaaatctgtcactcagattggtgtgtctaatgaaatggtttaacatcaaaacatctatggataaggacaaataacacaggaaaggtggaaaggcgggggacatcgggggtgcgactgagggtctcctctgcttggatgggtttcctcaaaagactgcagcctccaacaagagagggaaaataccggagaggcaaagttacatctgacaacacttagaattcatctgacggccaggacccgggagcacaggcctagcccagacactgggtcctgacgtggccacagccacagctgaaccccctccattgccacatccctcccttgccagagattttaccagatggtgcctagtaaaagaattttaaaacttctagaagatcaagctttccaaatggctctttcttaacagaaactttctagtttcacgaacaaaatcacagatgaacatgctagagcttcgtaaagctaggcagctttccgggcagtgctgggtgatcgcagtgggtctgcgtctgggcccctccttctaagaccgagtctcggggacgggaaagatgcacagctgcttcaggagcatttcacccagtgggcgggcggcagagttagcagagctggactttaacagaagctcccgccccaccttgcaacctcgctcatcagctcagctgcttcccccaggaggtgccagctcagaggaggagccggtgccagctcagaggaggagccggtgccagcctcggccccggatccagatcctctgactcaaaaatagcctgattcctatcatgcttcctcgccggcagggataccaccatttgtgcaaaatgtttaggtacacatttcacacatatagactcattaaaatagtccactttatttggaatgtcatagtggagtaaatataaatacagtaggaaaatataaccagaaccaaaatataatcagaatataatacaatcagaaaaattagaaatataagcagaataactcagtaggtaaaagcagtttgcattttaggagttggtgaagaaagtggagtgtgactcagaaggtccaatcatccatcctaaattccagccctgtgttccaacccctgcatgattctgccccaattcaaaaccatgctggaacgtgagcttggagactggagatcccacacacagaaggagaagctgaagacgcttagagtggaaaagcgttttgtaaggcgggtcagacactcaacaaagcaggtgaaagtgatggaaaaatggaggagccgcagggggtgggaggcacagagggctccccttatcttattgtattttccctctttcggttgtgaggacagtccatcctggttctaaaatcaccgtggcccacgccacgtggaacccacagggcccacagccacagaggctggggtggcacttccaagactggtggctgcaatgggagtggaatgtccacctggctttgggtccgtgaccctcactagcctatccctggagttctgtaaaaagaagagccaggacacctttctgatggggctgcccgagcttgttgtggatgcggagctgttgaattctccaatcccattctctgaaacgcttgatacacgtgcttctccacgtgaagcaaatgcctccctttttgagattcgtccttcagtctactacttagactttacctccagtgacacttcagtttccatgagcttcaatcgctgcattttcagcccattcctctctgcatttctggagtaatttcggttactctttgcacagctccctctccgagtccacaggactcatcacaactcgcgagacaccaccgcctccaaggtctgtctgtgcctacacttggcgactatgacaaccgttaagcgatgcaaggtttggggcgctgcaaggacttagagaaaaagctctgtggagactacagtaaaagagcccagaatactgttggagtaaggcccaagtaaagttgtcaacaagtcagggcagatgtaccttaaatggacccccgcctggtgggaaggctgggctggggctggcaggcttgggttgcccctgcctcgaacgtttcctagccctgccatcctggctcagtgcccagcctcttgctcaagtccccccttctggaaagtaaagcactaacttttaaggaccagctgaggtgccgcagtgaagaaggtggcctaggccccccagatggtgtgggagcgacagaacatgaatgcactgccttcctcaccccaggggggtcccacacgtgtgcaccgccttccttacccctggggggtcccacacgtgtgcactaccttcttcaccccaggggggtcccacatgtatgcaccgccttcctcagctggtgccaggggacccccagtagtaccaggaaggccgtgccagtacatcaaagtggcagccaggatctaataacaatacgtaaatacaaacagaagcgagggcactgtttctcagttgggtgcactgtgattagaaaataaagtccgaactaactctatagttaggaaatgaccgaatttttccctgagtcataatttcctttttctttttttcttttcttttcttttttttttttttgagatggagtctcattctgtcgcccaggctggagtgcaatggcgcgatcttggctcactactacctctgcctcccggttcaagcgattctcctgcctcagcctcctgagtagctgggattacaggcacgcgccaccacgcccagctaatttttgtatttttagtagagatggggtttctccatgttggccaggctggcctcgaactcctgacctcaggtgatccactcttctcagcctcccacagtgctgagattacaggtgtgagccactgtgcctggcccctgagtcataacttaaagtatgtttttgtaatatgtttcatggacacttaaaaggtaagtataatctattttcagggtgtggatttctctctttctctgcatatatgtcatacacatgcacatgtatggacatatgtatgtatgagtatatcaaatatgctatattaagtgtgtatgtgtgtgtgtatataaatatatttgcctctgatttgtggtatcctaacagcaatgagttaaagtttcctaactttgtaatactttttcttcttgtattttctgcagtttttgcttcataaattttgacgctgttacttgatttatggaggtccacggcagctagctctttgttgtagactgtgcctttatcattattctaagggcccttaacatttctttgttgaatttaaccttgcttgttattcatattgaaaactgatattaaaaaaaaaaacaccaaaatccttttataccagactttttgagttactctttcacagacacattatttaaggtgcatttcttaatccaagtgggtcatttttgcttcttcccgccatctgagaactttgtgaggtgtgctcaccccacttatgctttgtgacacggccacggcctcagctttgtcaccatacgtcaccgcacaggtcctggttttcctgccgcctgtttctaatctgtggccatttggcctggtttcctagtcctatgctgagggtgcaggttcctattcttttaacgtggaccatctgcaactggttttaatttaagagttttatgatcaagacaaacatctatttcttgattcatcagctttacacagactcctgtcatagcctagtctgaaagataaacaagttagctcacgccctcccctcctctccacttgcatttttggtttattagattataatacttagtttttccacccattcaatacctttgtattcgacttctcaagttgaaatgctctctactaactctctgctcagagagttgaggaaatgaaaacagactcttctcacctcatcttccactgttctagcttttgttatgttctcttctgagagcaaaaatgccaaagaataatcccacgttctttggctttagttttatattcaaatagactttttctatttttcatggtttttccatttatcccttggtttcctggactgagtaaaaaaaagtcttttattttttttaaagaaaggcttatgtttttatgtcactccattatctgatttttctcatatttaaaaatgtctcagttttctttctccttgaaaacaaccttagctctgtattaaatcctcacagattatgtcacatggtgtttttctctttaaaaattccatttgggaacaaaatgtaaatattataatgacagagactaggtaggcacatgacagaaggaaactggtctaccaggtgcctctggtcgccacccctcaccctccccttcagcctcctagcccagcccagcctctttctccagcctccgagagcccacagcaggtggacagctccaggcagtcagggggagcatccctgggagccacctctgtgggtgcctcgaagggaggtggaggaggtggggcgcacacacggaaccaaaggagtgtgaaaggacaaggagctgggtgagccagtggggggtggggtgggcccacggggagaccctcactccacctgccttctcttcagatgctggggacgagagtgaagctccgagtttctgcttgcacagcttcctcgggccagcgtggacgttcccgacctgccccacagcacagagactggctccaggtatgccgggcagggaggctcctggcggcgcaggcccagagggaaagcagtgtcagctgaggggtggggaggaggcagagggcgcatcacttgtgattccccagctttgagaggagctcacagaggcagcttttggggaaccgacagatttactaaatagcaccatgctgaatttgaaacagccacgccccagaagctgatcagaaaagattgttttcaggccaagagtaagatgtaagaatgtgctgtgaacctttatgattctgtgaaaacacgtggcttttaggtcctacagaaatgcccttaggctacaatatagaagatttttttttttttttagtttaaaatcttacttcacataactactttgataaatctactatttataagcaaagtcctagccacggccatctgatgtggtagaagaataaactgaaaagcagacagtacctaggacaaggacagaccagaggctgacggcttgcaagtagatgtggaagataaagaagtagcaatcctggggaaagggctaaactccactgggggaaagttccattccacctccgattcctagagctgcaagcagcaagttgacacaacacttagcaaactcttagtcacctcccgagagcccagaccctgtagcagaggcttctgtcaccaatgatcattccccaagtcagagacatggaagggaaatgaaagaaggacatgcatcctgccgcccatgtcagacacacgtcccttgcatgaagaacttaagacgtttctgaagtgactcaccaactgatccaaaatatataaccgtgatcaccttaaatcacataaacatgatcaccttaaacagagaactggatctcgtgtactgatgctgctggcagcattggaaagtgactcttacaacttcagttgcgataccggtttccataagcttctgtgaattcttgtcaaagctttaaaactgaacacggcaacaactctaggtgaggagtgtttggcagatgaaacccctccaccagggaggtgacgggtctcagggagtgtgtctggcgggtggggaggaatcccaggcctggaatctaccgtcctgggtgctgtctcctccaccacgtaagccaaacctgatttccgtgaagaatttcccacttgcactcatgaagacatggccattcccaggtatctaggtgttcctccactgatcagaaacttacacgactttatcagaagcactctgagatggacactgctgtgttcgttcaccaggaccacatatcccaacagttccccataacctgggggtggtttctcctgagggcatttatataattagcagctagcatcctctttttcaggtagctcataaagacctggtccaacaacaaaacacacctcacatgtcgttcaacaggccatggaatcattctgctgatgtgtgaaagaattgaaagtaatgcagtttacatcatattattatatcgcatcttataattatagatcatacttaaacaaacaaacacacacacacacacacacacacacacacagctgtaatgcaatatatgctgtaatgtgttaccagttcctgaggtttggaagatgggtcatgaaggttgtgatgcctggtggcagtgctgctcctaaaacaacaccagggccagcacccagaacatcagcaccctcaggtatcagcaccctaagcaccggcactgtaatgtgccagcaccctaaggtaccagaatcctcagggacggcacccaaagccaccagccccctaaggtacagcaccctaagcaccggcactctaatgtaccagcaccctaaggcaccagcatcctgaacaccctcaggtatcagcgccctaaagcaccagcaccctaagtcaccagcaccctaaaatatcagcaccttaaggcaccagcagcctaaactatcagcaacctaatgtggccccctggcctggtgcagtgctgctagataaaggggtcaggaattgtcaagaggtaaagccacagtttgtaaaaaacagcagcttgcaaagctgaaaatcaaaggccagactacagcttcaggagccgagcaccagtgaccctctgataggggtttgccacccatgaattcaaccaactgaggaccaaaaatatttgggaataaaaccagatggtcatgtccatactaaacagactttttcccttgtcatcattccctaaacaatatggtatagcaactatttccatagcacttaccttgcattgggtattataagtaatctagagataattacagaatacagaaggatgtgcttaggccatgtggaaataccatgccattttataggagggacttgagcagtgcaaattttggtgtcgacagaggtcctggaaccagatgcagaggggtggctgtactggggtgggtgctcatctgtacgaatggggcggactggccagggtgattcagaacaacgttcccaggcccagtcactcatcagatccctgcccctcatggcagagacccaggttccacgtggtgtgggcaattcccatgacctggacgcaggggtcccccggggtctcgtgagcttccagggtaagaaactgctgtcccagggagcgttgcagtggataaaaaagagtcacccatgggtacatgacaagcctattcttctctcttccagtttgggcccctttactctggtctctgagccacgtttctgcagtgcccagggaaagagtggacggcttccttcagctgactcagagaagccctcctccccgtcagccagactcacaccctccagcacacaatccagacaaattgcttgaccagaggaagctggaaattattagtgttgtcttgattttacaatagaatctgtggaatgtaggatcaataccacgtgcttactttctcacttctaaaaaacggtatggtctcgacgcatacagatcagctcttgctttacagctggagagagctgggcatggggactgcctggaggggtcgggcacccgccaggcaggtctcatgtgggtgatgtccacgacattcttggaaacaatcattttagtgtgctaaaactggcatttctcaacctgtgaggtgtagctgcatccctcctttggtttactttacttcagcatttacttggtgtgctgcccttcactagccagacagaccaaaggaggaagtgactgctgcaaaaagtgaccacaggctgacacatggagtgctcccctgcggaagggccaccccacagcaggtgtgccagcatgctcttccctctcatcgctccctctagccctcctgccagggctgctgagtagggggtagcctaggcagagcgtgaaacaagattgacatccatcggccagacaaccccttccagctgtcacctctgctgcccattcacagagcaagcagtcgagggcccttcatggctgcctacaagccctggtgcagggaacgcacactgcctcaggcaaacagagccagccacagggagtgagacatcaaagtcacctgccattgctcaggatgttatttctttctctttctgtgtgtgatggggtctcactctgtcacccagactggagtgcagtggtgcaatcacggctcactgcagcttccacctcctggggctcagatgatcctctcacctcagcctcctgagtagctgagaccacaggtatgcaccactatacccagctaatttttttgcagagatggaattttgccatgttgcccaagctggtcttgaactcctgggctcgagcagtctgcccaccttggcctcccaaactgttgggattacagacataagccaccacactcaccctgaaacatttatcttgaaggtctaagaaagcaatgttttcctctaacgtaacttgattctgttctctcggcttttcttgaaatgtctggatcgttcaatgcaaccaagaaacttcccatgctgttagtaagggccatatatttccctgatcaaagtactagttttcttatttatattcccctgtaacatagtgtgtgataaccctggacacccacttcctgtgtgtgacgaaattcaagggcccttctcatcaggtttgactgccaggttgtctaaatgggcttcccatgaggagaagcaatcccactgcaggagggtttttctccaccttttttcgtaactggtctaaagaaataaagattttatgtttcatcaagataattttctgtgttgcctttattagattttctgattgcttggaaaaactgagctttagaaggattaagattctcacatgcatgtaactttctatattgcttttgaagtctttgatcatcactctggttaactgaataactgttattttacagtgacttgtgattctgtctcgctcaactgttttgaatcttttgatatctttggcacatttctccagaacttttatctggtaaactgtatgggaggcattgtcaaatgataaattatatgggaacttctttagtttggtttatgagttatggacatttatgagtatgttattgatataaatattctaaaagttatataaattcataaaaatatgtcatcagtcataattttgatgttgttaaatgttttataaaattatgtggatgttattgtgaatattctgatgattatatgaaatttgcaaaagtctaatgatcctgacatgacactgtcattcataattctggttgttaccttagaatgctgcgtgtcatagaaccaactaaattttcttgtcaattgaaaattttcatcaaattttaaccatggctagtctaagtttttgtcattcacagcttttattctaaattcttctctataaacatttgaaatcagctctagtccaaaagtgcttttcatgaaaaagactctaataaatataggtacaaaaagagaaaaaaatagtacaattaatcaaagaatacgcaaatttatgttctggttttgttaaatggttatcatgtttattttcccccaatctgggaaactcattttgatgctgttaagtatgtgctgctatgaagaatctgtagtatccgggtagtcatccggttgaggtggtttgttaggtgcaggaaaggcaacattagaaaaaaatctcagatcatgataattaaaaaatagatgtcatccgccgggtgcagtggctcttgcctgtaatcccagcactttgggaggccgaggcgggcggatcacctgaggtcgggcgtttgagaccagcctgaccaacatggtgaaaccccatctctactaaaaatacaaaattagccgggcgtgctggcgcatgcctgtaatcccagctactcgggaggttggggcaggacaattgcttgaacccgggaggtggaggttgcggtgagccgagattgcgccattgcactccagtctgggcaacaagagcaaaactccgtctcaaaaaaaagaaaaaagaaaaaagccatccaaagtgtgttttccaatgaagaggcaagtatgttcgttgggccctacatttattccttgcaactacagctagaagctgccgactgccctagtaaagatccccctagccattagagacaatcagcattggtcttgtaaatgcaaccaagtagctgatttatgattaaaagggggaaggaggggcgtggtgggggcggggcaaggaacttgtgagacaaagtaacaaatgtcggaagccatgtctgtttctttctgcttgccaacagcacttcagaaaacccctgattctgtaatgacctctagctctccagaaagatgctttgaagacaaagcaggacagagcacacagcccccggcatctcctgcttgagtcgctccattcctcaggaggtaaatgaccctggccttgccttttcctacacacaacctctgatgaggttagccgcaatgcttctgtaatctgcgaccagatgtacacttacgcccaaacctggatgtgaatttgcacggactgaagctccaccacctagatagaagtggtgggtggaaaccctgtgtggggcggtcccatggaacctctctaaaggactcccccggggccatcacctcagtctacagtcctcagcaaagctcctgaataaaactaactttaattatttaaaagcctgatttgttctttagtcagcattatttaataaatattctttcaaagtacaaaagtagatggaaaggcctcatagaaattttttattagtggtggctactgaggagacgggaagggatgggattggggagaaataacaaaactggaataccttttccagagaccttaattcctttttcttttcctttttgttttaccaataaataaataaataaccaagaaaaatactttaatacaatgtgccaaaaacagtaacatcaacctggatgctgggaacctggcatctgttaaagtcttcccgcacttctgtatagcttcatgattcccccaaaatagactgataaaaatacaatttagaagtatgtctttccattgggatgaagcattctcagaaatatctcagaaaagtccaccatgaagccagtggcacatggggtctgattattggaggctgttggagagagctgggtcaccaagccgcacagcccaggccttgatatttgcctgtccacctggagggatgtgacttccatcaggctacaaacatcctgggacagtgaaccgggaatcactgaaccttatcacatgggcttgctatgggagttcacatgatttgaaaaacagatgcccactccaagtccattcaacagccatccactgcatccagactgttgaatcttcaaccagcatcaaagaaaggagccgcctttgcagggattgctgtctaggggatggaagcgcaaagaagctcggagctcccacagatgatgttaggtgcagagatgggggtgcacccagggcacagcacaggggcccggtcagagcctcttcctaccagaggtgatgacagggggatgacagggggagctgtgaaggccaccggaggctgagtctggtggaaggaggcagggaacagccaaagtgaaggctgctctggttcaagttggtgttcaaataaaagtaagtcacaacaaaacaaaagacctgaagtgaagcctgctggcttagaggaaatgaggaaccggagcggctggggtgcagggtgggaggcaggggtgcacacttatgcatttgcccagttttgcatcggatttctggaggtttgggaccctctttgcagaagctttcacgagcctaagggtgagatgctctgccccctgtggatcgagcctaccctgtactcagggccatgccaaaccattgcacatcattttgagccttcagaacatgatatcaaattatacttggatgtcacattatcggccagaatgggagtacttttgaaagcctaatagccttaggctgcaagagtcctgtggacggcactgttcccaaagtcacagaccctttatggacatgcaggactgatgccgccactgtcagtaacagcagtggtgttggccgtcttgatcagtttattatgtcttggaactcatccttgaattaattggaatgttcttttgcattgtcgtccaggaaatttagaggccaacgagggcaggatctactcccaaaaagacatagggacccttacagtacgagttttgggtactaaccccatggctgacctttctgatctttcctcattcggatcttatattccttcttctcatctcattttcttcgtctgataatcttaattttatcttgtagcatgtatgtatggaagccagtgccagtctctttaggaaaaaggtttggtaacacggaggtcactagcatccctcgtggacagtttccatggaatgtcccaggcacaggtcacatttcagcgggttccggagctcactctaagtggggaagtggaggctgccctggtaggtgccatccctaaactgtttgggagagaagaggaagagagaagtaaaaggaaggtttctgcgtttttctgtttataaagcggatatgagcaggtttacaggctgaacagagtaaaccaatagaaagagaaatggtaaaatgaaaaactgagatttctaaggaaactgtagggtgtggagtaggatcactgctagggtgtgggaacagaggactgaggggtgttgacctccaaaagcaaaggtgcatgcaagcgaagggacattggtaagagggaggcaggaagttgaggtaagctgatagattgcttcaattttccccaacaataggatatgagatcacctgtttagaggttgggacaggccctgaggggagagaggaaagttaggtatggcccctgaggggcaagggggccgagggctcctggcaggagcttaggattcatggctagcagcaattctcactcttcttactagtttataactcccattagcagaacccgagcactcttgcctcgtatacctgtttctctccttagcaggggtctaagatgttgacatcgaccctttggagtaagggtttatactgacatgaattctcaactcaagattttctccctaagggccacctacccaaacggaagagcaataggtcctcttttccatattcaggtgctaggaaataaacgtaagctatcagcaagccatcaccatcttaccatccaatggtatataattactctgtgctcacaagcagcggctgatattggtgaagtaattaggaggttcccggcaatcatttctttcatgtcccaattaagacactcagccattgttcattaggggtgttaagaaagtcaatgaatttaagcacaggtctgtggggcctgaagcactgcaagagtcactgggggcgtgctgattttccctgtgacaatgtgccttattcaacatgagagggagcgtgtgtggctgaggctggcatacctaagaccatggaactggtgctaagcagtgccctgctttatttataaatcacttcctcctttgggggtacttaaatattttataaatttgtctcataaaatgttaaacatcctcacctttaccatgacagtgttttcacatacagaatgagaaaatatcacagattttgaaagttcctatcctcttgttatggcaatcagtgaaacattattcagtcagaaagaagtctcagtttagaaactgtaaacctttatgtctatagccttgcactgccactgaatttagatccaatttctgaattatatcattcacaaaaagaccatcttggattaagtttccatcaaacttggagaactctgagaaggccctaagcgtgtccatgctggagaagctttggcaggataagaagagctggaaggggcatcctcctgcccagccactccgcttcaggctgtgctgcagagaaacttctgcacccatcaacaaggaaatatgtttatagcaattatttgcaaaagcaaacaacgtgacacaaaacaaaacaaaaaactgaaacaacgtgaacatctatagtaggaattgacaatactctcatggcggactagtctccatttagggcagcagtccccaatctttttggcaccagggactggttttgtggcagataattttccatggatgagggtgggggacagtttcaggatgattcaagcacatgacatttattgtgtactttattcctatccttattacactgtaatatatcatgaaataattatagaactcaccatcatgtagaatcagtgggagtcctaagcttgttttcccgcaactaaacggtctcatgtgggggtgatgggagatggtgacagatcatcgggcattagattctcaggagcatgcaacctagatccctcgtgtgcacagttcacaatagggttcaagttcctatgagaatctaatgctgctgctgacctgataggaggcagagctcaggcgataatgcaactgatgggaagcagctgtcaatacagatgaagcttcgctcactcacctgccactcacctcctgctgtgtggcctagttcctaacaggacatggtctgtggccgaggggttgaggactcctgatttaggaaaacactacaacagacagctctgaaaagcttcgtaagaaagaggcagcacactgggtgatttataggtacaaatatgatccaactgaataatgtactcattgttaaaaataggtgtaggttcccaagtgataaagaccatggtaaaatttctggaacagtcagacccctcgaccaatgcagaacagctgattttctagttatttatcacctaagtaaggctgaacatatacaagtaagttggacataaaatctacttgtgtgatattatctgtttcaacatcagaaaattattggggcttacagagctgaggacatttggactttatgtcttacatgacagagttgaagttatttgtctcaaagtatattcaatccactgggtcattttgttctgctctttcttggatgctacttcaaagcagtgatctccactgagattttctcaagagtcccgtggcatcattctgtacagcaggggcacaccgtaactgtgtgttgcctgaagactattctcaggtgattttcacattaaccctttacttctgccaccttgctatttgccacttagtgtcattaacagattggattccataatgctccccatgtccttttcttcctattccttttgatttctccagtaaaatatatccaaactcaatggaaggtcacaaaatatcaagattccatgtcttagggaaagtgaagatcattccattttttttcctggcaacaaaaaacccactccaaagtgtgcaaaactctaagataccatccacagttcatcctgtccagacagcgggcctgcatccatgaggctggccgagggtcgccacccaccccgccctgaaagctctatggcctgtgtcagtgtatcaggaagtgagctctcctctcagctggaagcaggaagaccagagaggctgactaatgatgggaatttcagagggagcccgagaagcctttctcttccagttgtaaagttcatgaatcaccatccagctgccagtcatgatggcaagaggaaatgaaaacagaatatctcctagcagaattgacaaaatgggaaaatccctgaagacatgtactcccagaaccataaccgatgcagggggtggggagggaggggctgggaggggagaaaagggggcaggaagggaaagagagcggcaaagcgcatggagcctacgcttttttacagacgcaaaaagatagatgcacattctttgtcaactgtcacaaacgaggtccttgattttcaatttcctgcaatcctggctaagagacacaatttttaagacattcctcatcagttgccaaatattgattattctctgtttagtctacaatgaaccagatcacacttgtaatattatttagaagcaaataaatctgcaaggctattggcgtctctccctaataaatcgtgtggctgccatgacccttcaccccagcggcagcctggtgtgataattggtaggtaaccagtttgcttttcactctaaaaagtgcttaattgtctcccttagatttgtaggcatgcatagccagacacctcgagaaatgacgcacgccttactcatttataatcagcatcaagcagacagtgaaaaatctataaattagagataagcatcacactccagaggcattaaagagaattctaaacgtctcctttgcaaattgttcaattaaaaacagaatgagctttttcacaggaaactactactgactccttttaagcttctaagacattcactgaggggcccctcccagctttccaggctaacgtccggataatccccccaggtacctgggccatggatctaactcctgtgatgctataaaggactctggtgacggttctgaacttgacaaatgccgtacccaaaatagtatattccctgtttagacgaactctaaattaaactcaaatccctttggttatttttaaatctgtattagttattttctcataaacagaaataactttgattatgaaacgaagctatttctcattgtgaaagaaataaaacatacagaaaagtatacaaagtaaaataaaaatgtcatgccatcgctcagagagaatccttttaatattgtttacatcctcctagaatttatatgcattcataccatattgtattcatttttaaattaaagtactatttttgctatattactgtcccatgacctgccttttgcatttagtacatgtggatatttcttccctatcaatgaacatattgaatgctagtattttattgttaaatattccaatcctgtatgaatgtacacataggttatctccagttcattattattattttaaataaaatgacagaaagagtaattataactcaaacagtcctgaaagccactgttttggaggaagtcctccaacatttggaaacccatccagtgaattccccagttggttacccagtggtctggaaggcagcagggaggtggctgggaagtggggctttgaaggaaggcctcggggggatggtccagggagaagaaaagggtctaaggccaagagcagagaccctacagcaggaaggccaaggtggaccctcaaaacagaggaattcatcacaaggacaaggaccgagaatcaggcaggcagccccagctgacactcacaaggagattgcacagtaccttggaggcaggcactgcctttcaagcccggcgtgtgtaactgtcttactaggttgactcatttaactgtccccatggccctggacatgttaccagtattgttcccattttacatgggaagaaagagaatatggctttaaataaaaacgacgtcactggataccatgacgtctgccaggaagacagcaaactttcacatagaactggaaagatatcaatccacggagttgcaaaagaaaagtattaatagagaaatgcttgagtccagcaatggaatctgccactaagaaaatttccagagacattagaggccatccatcatttcctgccaatggctcttgggaaacattcccaagctttacacagcaaatatgtagttacagcctagatatccaggtgtgcatgtctgcaagatgagtgctcctgaaaacacctataggtttccaaatgtgaacaactgaatacaaatgctagcaatattgcttcactggaaactgtaggaaaaatcaagagtaattcttaaagccacagggagggtggagaaaaacaccctaacatcagaaataaaatttacaagaattagcaaatatttataaaattcatgacaagctaagtatctgcagtgagtcactcagatttaacttgtctaaactcatggctttgacaattttaacatttcctcttttctttgatatttctcatggtgctattccatatgtaaatagttttaaatctgcacagtgctaacgctggaatgcaaaaacactttaagcagataaacttagaaatatgaactctaggaaaccctctaggtaaggatccctaactaaattacttgagcacagctgttaagtgaaagcacaaccctagacattgtggaaacccttaagcctcccactaagggaattcccattagagctcgtctctaaaatccgggccctggcgtttctactgtgagctcacagagcaggctgggagtctgttggcttcactgggagcttttgctcagtgtctaagtcaggcaaccgaatgagagagcgggtacggaaaagacaggaaaagagggtgtcgtgtgattcaggaatatcaggttaaggggaccccacggtcattgagaccaatcacactctgcaaatccctctgtctgtgccaatgcagcctccgcctaaaagactccggtgatgggagagacatctccacgtaggagccactggatcttccaaagttctggatttgaaagagctaagtgtgcacggggcttggctccgtgcagcttccactcgtggtcccgtggtatcaggagggcagtcgggacaagcccaacccctttccgtaacacagccaagtgttggaaagcctgccttcttactgtgttcttcctctcatgtggatgacaccagcaccttcattgtttcctacagggcctgctttaagtattcattaaatatttatgggacacctaccagggctaggcctgtgctatgcacacacaccagtgcccagggccctgatgtcccagtgggtgaggagctggtccctgagcattctctatgaacatgctcttcgtggcttcttgcccttagaagacaggatgtggactggacacagtgactagggtgtggtctgaccaccagagacacctaccttgtggtagcttctgctgcaccctgagaaaccatctggattaagtccagcactgttaaaaattatgattcaaaatgaacaagctgccctactgcttattttgaaaataatgttcaacctattatctgtttactttactggtgactggggggctctcagtacccaaaacacagttaaaatctatcaaagtagcagagaggaaaacagactcctcaaagatcagctgtgcaattaatccatggagagcctttctatcagaaaaatgaaattagattcctatattattccatatacaaaatcaaactgagtataacaatttaacaataaggaagaacaacccagtctttatgttcttaagtgggaatagcttctttaaaaaattcaaaataaaagcacaaaaatattgaaagttaaaaactttcttcttacaaaagaactcacacatagacaaagttaaagatagaaaactctttgaagatgtttgcagcatttgtgacaaaggactgatttccagaatttataaagaccatcaacaaaaagacagtaacccagtggaaatataaacaaagggtatgagctggcaattcgcaaatgggaaaaccaaaatgtccaagtaaatatttgaacagatacccagcctcaccagtaacaggaaaatgcagatgaaaatattccatgcattgcgtgggcaaaacgtttgaaatgtctgaaagcatcaaggagtgccccctctgttaacagaactcacaacagagggtaattggcagtaccaactggaaatgcgcgtatgtcacgacacggctccatgcctacatgcacaactgccagacacatgcagcaacgttcaacagcccagatgaggaggtaatgcaggcgctcatccaaaggggtacagataagcaaaatcagtgacacctgaaggagaaaagatggcttgcagaaaaacatgtacagtataattccattgatgagacttaaacacacaaagccattctatgcaccgtttatacacattgtttatgcatacattgcttatatgtaaagacgtggataagaaggtttgcacacggaattcaagccagtggatggcgttggtgggaaaggaaggggtggtgggtgccactgagagctctacaaagggaacgtcagctttatcttaacatgatctgaggcacatggtctaaatgtgattctggctcgccagggactcaaatgttatatctaagttttgagtgttgaatgtcaaatcattctctgcactttcctatatttaatttcctgccacatcgaaaaacggaaagcacaaaaattaaataaatattaaaccggcactcaagtggataatttaacagcctctaattacagaccaacggattgaattaggatcattagagccccggtgtcctttagtactgtgctgagggatcacccactgcttatgtgtaccctaagtatgcaagccacgagcagtcatacccaatgggtggctcttcaccagccctccagggccccgccttcaagggccaagagtgaggttaacggaagggacagaaaccccagaaaattgctctcctgggagttccatctgggtagccccgtttccagcattcttctgctctcaccgtaccagccctgacagctgcctcaagaaaggccaggccgggcgcagtggctcgcacctgtaatcccagcactttaagaggccgaggaaggcggatcacctgaggtcgggagttcaagaccaccccggccaacatagtgaaacccccgtctctactaaaaatacaaaaattagcatggcatggtggcgggcgcctgtaatcccagctactcagaaggctgaggcaggagaatcgcttgaatttgagaggcggctgttgcagtgagccaagctgagatcacaccactgcactccagcctgggtaacagagcgagactccatctcaaaaacaaaaaacaaaacaaaaaaagacaggccaacagccctgggctgagtaccattaacactgaaataaatagggccccatcactaatgctctgcacagattgtgtgcacagggcttttcaaatgtctgtccacgcacaggagtgaacaaaggcagctcaagaagaaatctcttcaagaagaaatgttgaattctctgatttctcacgaaaacatttattgctgagggaacccttggtgtggtatcctctccggtgtgggtctcagagttgtgtcataagagagacacagacctatgattctagttaaaggagaaaatgcatttgcgtggcaaaatgcaaaaagtaatgctaacctgcaaccaaatccatgaggatttcccttctgcctcctcctgacacaaacacgaggagctgtggcagctctccctgcggtggccacgggaggggaggacggctctaagctgtactgcatcctaggtccttcatccgcctctcattcctgcagcatccttcccagcaacaccttcctcttctgtgcttctctccactgcacccaccaacatgccacactgcatactttttattactcataatgtctgctcaatgcatcatttcattaactcttagttccaagctagcagggatttttcattattttgttaacaggtgaatggagcactctgtgtcccgtccgtgcctgcaaaacactgagaagccagacacacaaacagaccccatagaacgggagcgttcccattatggaggcacaagttgctctgactaatggcgctgaaataacgcaaaatcatccacctaccagagagcagaattcttcccaagacatttgtcacagagctagaatactggtatgaaagcagctagcgcacttccccaaagacactctggtaacaaaagaggacaagaatggcctgctgcaacacatacacaaactagcacttatgtacttgatttctgcatatctctctagcaactggcccaagaccctggagccgaggccagctccgtggcccccaccagccagcattaaacttgcaaactgtcaccaaaacacggttcacaaaggaaacttcacagctcactctccttttgaggatgggctatgaaaactcacactgcgggacttcaaactcatggtgcccagcacaggccaggaccctggtgccattcccccaggaagggctggagaacactgccctcgtgaacatgcccacagaacgcccagcaaccaggccgaagaacaatcccaaacccaagcacacttccaatttcagcgactttagccacatcacggcttttaatgagtgtggaacatgaaagacacagttgggcaggtgcttgaggccacacacacttacacatcagcagaaagtgctggtccttggttgctataacaacagtgccacctaatctacaaagagcttggaggcctctccacaccccggggagctaccgccgtctcttgtaaccctttggtatattgagacatgcacacactgacacgggcattttaggacatttttatgcccctggcggcgccatgcatcctgcgagagggattctctgccttctctttaacttttcacccgtagaacgttaacaaaccaggcccacggcagacagggctttggctggtggtcagtgcacagcagacagggctttggctggtggtcagtgcacggcagacagggctttggctggtggtcagtgcacggcagacagggctttggcggtggtcagtgcacggcaccatctcccttagcagcagaaacacagagtgagacaatgagaggtctgaatattttcccttttaatccagcttctggcactttccgaagatctgtctttcctgtcaaccaccgagtgcagtgctggggccctgagccatcccacccgtgtctcaaattcataccctgagcacctgagtatcccctaggaagttctgtctcccatagacaggggtaaacacccacccacgctagtgtggtcactcccttccattccacacagcactctgcattcatgaaattccatccaccgacctggattttcctttttaaaaagtctctgaggacagccagccctgtggatgcagtggcctctgggggctggtggcagggtccctggctctccaactgggaggcaaaggcaccggcctcggccagcgtgtgcaggggttccccgtgcctctgggccatgctggcctcgccgcagacctgagacgcggccccgggcccggggagtcggaggggaatgggagcgttgctgcccgctgaggcctctgggggtaggctgggtcccgggggcctgcactcctttcaaaacacaggctctatggcgacagacttaagaaaaaacggtgctgggcctcagcccccagggactgcctcagaggagactgcgctgcagcagggcccaggctggagagccgcgcacccgtgcagcagggcccaccctgtgggccaggcccagacacccccgagggtcctcccgcgctgccccttcagacctctgcaacatctgcttgagggcaggccccaggagaggaggagatgacacctgggggcatgcaggcctgggcttggctctggatttaaagcggcactccacgtccctggcggcggtggggtcgcgagcctgcacctgactccagttgaagacactagagggagcaccctcagtactgggccctcccttcctaaagcttagggggcctgggccttccccggctctgggaatggagtctacctctgcctgcctttcctcatgggtgcactgggctgtatgagtcagctcaggctgcgtaacaaataacagaggctcgtggttggaacagcagacattcacttctcacggttctggaggctggaagtagagatgaggatgttggcagggttggcttctagggggaccttgctctttggctttggagacagtgtccttccccctgtcctcatgtggccctttctctgtgtgtgtctgtgtcctaatcggccttttttttttttttttttttgagagagagttttgcccttgttgcccaggctggagtgcagtggcgccatctcggctcactgcaacctctgcctcctgggttcaagcgattcccctgcctcagcctcctgagtagctgggatttcaggtgtgtgccaccatgcctggctaatttttgtatttttagtagaaatggggttttaccatgttggtcaagctggtctcgaactcctgacctcaggtgatccacctgccttggcctcccaaagtgttgggattccaggtgtgagccactgcacccggccctaatctcctcttatcataaagacaccagtcagattggacaagggcccaccttcaagaccattttaccttcatcacctctctaaggaccctccctcccaatacagtcccattctggggtcctgggcttagagttccaacatacatttgcgagggcacagttcagcctataataacaacagaaccccaaagcctgggtttccacccaatattcactcagagaacgagagggggtgacaacagtgcctgggcgctgcggcaaaaatgctgagagctggcagctccacgtgcagcactgttctatctacctcgggtgtgtgaggctgaggagactctcaggcctgccacaactccctagtgtgtcatggtttaaaaattatctaccgaaatgtggaggttagaatccatcgtctctacaactggtgactcaaaaaatagagactaatttggaaaagagctgtcaggcccaacagaatattaatgttgctgctgtggttgcccagtgaggacatgaggaacgaaacacagaacatcactcgctcacatctgagccagcggtgctgctgtgagtctctaagaagtatccgtgttgcagctactgagacacgctttttcctgcccgggtcaccttccgcctctacagatttctttagatggtcctttcagcaaagaagccagtggacagctgagtggccagtgccttgggacgcacacacccagctggagtatgcaggctctccccagagcaggcaaggccatgtgataagaacaacaccgagctttcctctgagctcctgcacccctgcacctaccagtcatgtgactggatccaaactcacctgttgaggctaatttcccatttcagtatctgggataaggacacaggaaaactcagcgtgtgttttcctgttctcacacagtcaacccaacactctgacaccatatgttggagacctatcaaagtgtttatcctactctgtactctcaggcaataccacatttcacctgcagtctccacagtgcctggggatttcttcccagcagcaaccgatcagttctgcacagacaccagcaagatgtcctttaattcaattcgaattctgacactaccgacctggagatagcctcagattccacaagttgagggctcagtcccagaaggctacccctcacttcagatgccagtcgtaagccccaggctgtagcctgtgcttttaaccaactggctataaataggggttcctattgtcttcaactaatttgcttcaagttccctccttgtcttccactaatttcaactaaataggggttcctattgaaggggttccttcaactaaataggggttcctattgtcttcaactaatttgcctcaagttccctccttgtcttcaactaatttgctagagcagctcatagaacccagagaaccacattattaaggtttgctggtttgctgtaaaggatattacaggacacagatgggcagccaaatggagatggacatggggtgaagcatggggaagggtgtggagcttccgtgccctctgggcagcacgaccctgcggaatcctccggctgttcagtaatccgaagctccccagccccagtccttttgaattgttatggaggctccattacatagacgggctttatcaaatcattggccattggtgataagcttgaccgtcagcccctctcctcttcctgggggttgggggtggggatgaaagtctcaaccctctaatcctgcctgtggtctctggggtgaccagcccccatcctgaagctactcaggggccctcagccaccagtcctcccattcgtgtacaaaggacactcatcacttcaccgattccaaggggttcaggaaatgggaagaaagagcacatatatgtattttggtatcgcagatactgcctgcctcaaggattgtcaggagcactcaaccataatggaagaatggcccagttggaagacaccttagaggctatttcaaacttttgcacaccgacaatgttctacaacatccttcacaaatgcacatcgcatgtcttagtgacacaagcccgactcacagatttccagctttgtgcagctatgtgtggccgctcctcctcctcctcccaaagcttccttccccctttccaccacacagactaaggcatgaggctgggcagggggaagggggatactgagtgaggaaaacagagagggcggtggaggtggccacacagcatagctggtgtgctctttacagcaaggcttcagagcagcgctggtgtgtgcgtggatgctgaggatgaactcaggtccaagctgcctgactgtactcccatgggtacgcctagctggggtgcttcctttccaatgcaaacgacctctgcaggagacaggatggcacaggggcctcctcctgaagctcttacagcagattctcgacctctgcagctgtgagaaggcagcggctgtgtacggacacagagcagacacaggcactgtgcagaggggtgtgtgcttgacattctgccctgagttgcccatgccagtgaatgtgccaacggtccctgtagatctgcaggagcctggaaatgtctcatttgtcccgagggcaaatgctggacagggggtggtgaccagggtgaacgagacttatcctgtcacttttgtatagactctgtaactttagaaccatgcgaagagattacttctgaaaaatggaaattagcagcaaccgtagaggaagctggtcagaggagtgtggcacgtgctgtcttcaggagggcgggatgagggcagcccgggagggagtgcgggccaggcttccggctccatgctcccactgccagcgccaccacctccccaggcaggagaaacagctaaatcctgaaaactaacaagtaatgggtgtttctgcggtgtcttccaccggcagaaactccaccgagtgcctcagcgaaatgactccatctgatcctggccacaggctagtgagggggaactgcgccgggaaagatgccggtgcggggctggaggatgctgggcagagggggcagatcagcctccatgggggccccacctcctcgggccccccatccccttgggcccccacctcctcaggcccccacctcctcgggcccccatttcctcaggcccccatttccctgggcccccacctcctcaggcccccatccccttgggcccccacctcctcaggcccccatctcctcggtcccccatttcctcaggcccccacctcctcaggcccccatctcctcaggcccccatctcctcaggcccccatctcctcgggcccccatccccttgggcccccatttcctcaggcccccatctctcaggcccccatctcctcggtcccccatttcctcaggcccccacctcctcaggcccccatctcctcgggcccccatccccttgggcccccatttcctcaggcccccatctcctcaggcccccatctcctcggtcccccatttcctcaggcccccacctcctcaggcccccatctcctcgggcccccatccccttgggcccccatttcctcaggcccccacctcctcaggcccccatctcctcggtcccccatttcctcaggcccccacctcctcaggcccccacctcctcaggcccccatctcctcaggcccccacctcctcaggcccccatcttctcgggcccccatcttctcgggcccccatttcctcaggcccccatctcctcggtcccccatttcctcaggcccccacctcctcaggcccccacctcctcaggcccccatttcctcaggcccccatctcctcaggcccccacctcctcaggcccccatctcctcaggcccccatctcctcaggcccccatcttctcgggcccccatcttctcgggcccccatttcctcaggcccccatcttctcgggcccccatttcctcaggcccccacctcctcaggcccccacctcctcaggcccccatctcctcaggcccccacctcctcaggcccccatcttctcgggcccccatcttctcgggcccccatttcctcaggcccccatcttctcgggcccccatttcctcaggcccccatctcctcgggcccccatttcctcaggcccccacctcctcaggcccccatctcctcgggcccccatttcctcagacccccacctcctcaggcccccatccccttgagcccccacctcctcaggcccccatctcctcggtcccccatttcctcaggcccccacctcctcaggccccccatccccttgggcccctcttcctcaggcccccatctcctcaggcccccatttcctcaggtccccatctccatcctccttaatgtctgcactgcctggctgggagctgcagcgggagcctggcctctcctcctcctcctcctcccaaagcttccttccccctttccaccacacagactaaggcaggaggctgggcaaggggaagggggatactgagtgaggaaaacagagagggcggtggaggtggccacacagtcagcatcggaagcagagctggcatgtcccttctgagtccagcccggcttgagtcagcggggaggggcagggaggagggggccttcctgggagaaggcaggggccgcaccaagtgcccctgaggtgcccatgccggagagaagttggcttcctggagccccactctgtgctactgtgaagggcggttccatccgcctaggttttgttagttctgtgagccatacaggattagcgtgccctgcagtgctgcagagacatcgggcgtgctcccctcctgtgtcctcagcttctcccctgggggggtgctcaccagcccagggccccaccccaaccctagaggtccctgggattccctgagttctcaccagccttggaggccccgagtcaccccacgcagtgcacgcacatctgtgacacactcctcccacacagtctccctcagcccctcttgaccctcctcctcctcagacacacgcctttccggggcctgtacttgtcaatccccagacatccctggctgcttcctacatgcccaggctctgcgcttgctggcccaggaactgccctccgtgcctcttctgactctgtcacaacgggggtttctgcatctgtgctgtcttcccttctactgtggctgaggaccgcaggtgccacccgagcccgagctccttgagcatcccttgtgcctagaacatgccaggcacgcagcacagatgggtgtcattggtctgggacattgccacggaagtctccagccctcatgcaccagaaagagaagagtgacaaggatcatactgaggaggtcaggaactctagctgagaattggtctaaagcaatggaaatgggaaattctgtaaatccaagctctgctccttggaatcatttagaaactggccaagggctaagacatccctcttgctgcgtagactgtgatcatattcaggaggaaaagcacaactctctgaggggacaaattctatttgcctaaacagaggtgaggctgctgacactctagaaagtgtgaagtgtgcttttgtgaccgaagctggcctctgcatcccctaactcagcacctcacaaagtttataaccctcacgcagtgcccccgagctgcaggtgacggcaggcctccaggttcagcggtgaaatagcggagcagtaagatcttacagcattacttccccaagtcagccggaagttttgccagccccgtgctcctccctgaaacctcaaaaagcctgcttccaagccgcctgcttgttcttcccaaggtggaggcaagaccagcgccctctggccaggtgcgttcaggaaggggcagagattacacaggaattcagatgagttccagggacggcagctgccagggtcccgtcaaacgcacagtcacaggagggcttcccctgagttggccctgagtcagccagctgggctgtggtctgctctgcagcaggaggcagctgagcagagcctgtaacccctcaggggaggcaaagctgcaccgcagggcgtggaggaggtgcaggccggccagcccaaggcagataacagatggcgacaggggcttgaggcttggcttctctgctggcctaggtgtctggaacggctgggccgccactggagccgtggaaagaggggtctaagtgtctgagcttggaatcaaggtattcccaaattttctgctcgaagccccacaagtttccattttccaccacagccagttggatcaaactttgcaccattcgcatcctagtgaagtccaatagtcagccgatttggggattctatgcaaagccaaacagtggcacagactctaggaaatctacagaatgagcagaacatgtcttcatgacgattcaaggtcaggccctgtggaccaaggacagcatggagcacagaggccagactccgtggagcacagaagccagacgctgtggaacacagaggccagactccatggagcacagaggccagactccgtggagcacagaagccagactccttggagaaaggggccccagaagacaaaggggccagcacaggccagccaaggagtacctgagacctcaaaggcgacaccaggtccatttgtacctgggtattcaatgtctcatgtgcatttgttagaaattagataaaatcaatgcttattattttaaataaagacatcgtttctaactattttagtcattaataacctgtgatcttccagatgggccggcctagccaatgggcggtatagccacaacccaggtcctctgtgagtatgatgaagacatcacacagagtgaacagcctctgaaacgtagggctgtgaagcgcgtccacagtcaccgcagagcaagaccagagtacacatcctttaccaacctcagcttcacattcaacagcgagcggacacactgaagtctagagaggcaatttagaatgaatggaaagagaaaccttaagagacagaaaggcagagagagatttttcaaaatcttattttataattagtaaaaatataggaatacagtcacttcaaaagctgacattagctaagaacattaatgggttattaaatatttaatttaattcagagatgatagacccataatgatgattaaggttattatagaaaaggatgattcttggtgttagagatcatttactcaaacccttgtattttaaaagaaagaaagactgagactaacagagttaattgatttctcccaaggaaaagcacggatcacaacctggttctcccacctgcggtccccacaccattttatgtggttgttagcctctccccctgactctccccatagttttgtgcttgttgttgctggtttcttggtaaaatctgcatcaagtagatggatactcttggggtaatggtggcccactccctaaccactgtgttaagccttgtatactctgctgagtaggtaaatatttttgtcccctaactctgcacctggatttatttgctgtgaaacgcagggcccattcctaccgactataagcaatttattctgtgggtttagtcactgcagagggcagaaacaagataccactccctttatggggcattaaaaacaaactcctctttgctggtgaccctgtttctgtaggaagtgtgtggtttacctagagcaaaggggctggctgtcctgccagacttaagccagatgtagggctccatctatcttgttcatggtttcaccccagtccccagctggtataaccggagcacccagtaaagaagaatctacgcaagggaagaacagtccccctcaggctgaacaaggagacgccacctctgcttatacagcagcactcaactgactttctctgtccattcttcactaaactccttaaaaataaaattttagttataacttcagaaaattaacctctgtaaagaatcaataatatactttaaaacatgtgtaatgctgttggaatttttttcttgtcttatgaacacaaaatgtcctatatttatataaaaatcactgtgttgacctttctacatgttcttccacagctatctattaatactatgacatcatattgcaaaaacaaacacacacagcaactcggatgtgtttgataataaaatcacacagcagtttaaaaattcatccacagggacataaagttaactgttgttattatgaaagtttgtcacctccctacaaacacatcttgactgttatttagattgtgttaatgtgtggtgttattataataaagcccttattaccacacttattgtggttgttaaacagtcattagcaaccatgaaactgggaaaatacactgagctgcgttgcccatgagctatcacggttaataatgaagaaaacagatcaagagctctgggatcctctacaagaagatgcccactttcccgaaatttcaagagagacgactgtcagaaacgtactaacccaacacaagcatgatgaggaacccaaattctggaaagtgcctttggccatgcttgaacttgatctgtaatgctctcctgtgccgtccgtcttcccgtgagaatccagccccgagccccagccacacaagacctcagtctccctgaggcccgaggtgcatgcagtgatgactgcctaggaccgcctcagtgcctggaacggtttctcaggcacaattctcacctatttttgcatttcccacatcatgtatgttggaagaatcttgaatacacaaaagctaccagttttaaaaacaactgacagtgttttaaaacttaggctctattattattcaggtgtggcagggcaacaggtcaggagacaactgtcagcgaaaagagagtttgttactcacagatcccaagagagggggccaagccctggggaccactcagggatgcactgagcctgtctggaggcagaggggtgcaggaacgtgtgggcaggggcctttcacgtggcttccagggaaggaacaggtgagccagggtgagcctgcatgggactggttggtaagggcagttcccgtgggccctgctgcacagggggttgccctcgctggctggtactgggccctgggaggattagggcaggaggatgtggcccagagcgtgagagtccataaaggaggtggtgggggtgggctctggtttgcatttgaaaagtgcactcctgggtgagttgcctgctgtgtctgggaattagaaaccctgggggagcagcctctccagggccagcaagcctccccctgctccccaccaatgtcaaagcatcagatgcggaaaatgacaaggcctggttagtgtagacaggtagaggtccctttcccagtcctcaggctggtgtgctgcaccctcccaatgccatgtttgaccattgtggtctcagggaagggctctgagatgggtgcccagggcggcgggttcaggccctgccctgtcgctcactcgtcacagggtgaacttgggtcaggaatctcaactctcggcctcagcctcctcatgtgtgcaatgaaggggttgggctctgtgatttcaatgaccccttccagcttccagattccacgagcccctcctcgtaacctggaacacagaaaatctataatcctgtgcttgtcaaggagcccagacccagggccactgaattccaacaaatgtatgattcctcagccaaagccgtgaagggtggcttggaggtttgcatccacgcatacttctaggtggcctcagatggcccctggggtaaaggcagatcttccaagggcagcttgctggtctctgcagtgtggattcccagtaggagtgctttctctgctttccgttttagccttaccgccccagcctacaaccccgggcatggcaaaaaccttatgaagagatgcattgggcctcctagatgcattctgttcagggtgttcactcctttatacggtgaactctccaggagaaccagcaggagatgtttcttacagggctcggaacagaaagagatgtgtttacctacacaactggggtttatttatttatttatttattttgcttgttttgtttttatgtttccagtctgccctgctgcgctccactccttgagaatccagcaatctcagaatcacacccaggcccaccttccgcagggctgggggtcctttcgacacgcaccatggctgctgcgctccggcccagcttcctacctcctcctttccttcacctaaacaaacgcacttatggattagcttagccttgtatggaatataggtaagtttactgacatctttcggacgtaagacggggtgtcggtaaggaaatacccccactgatgtgactttatttaaatcagagcaaacaactgcatgagaagctgatgtcaagatgtaacggactcagggctgagctgggtaaggagctggaattcacacttagagacctgtctgtgcttgtcacgtgtggataagccacttgttttctttatgctcagttttcttaattccaaaagttgaagtaaacaactttcattcacattatataattatttaaaataatattatttcaggagtaatttcaaaataaaatataaatattccttaaaattatattctgtggccgaggcgggtggatcatgaggtcaggagatggagaccatcctggctaacacggtgaaaccctgtctctactaaaaatacaaaaaattagccaggcgtggtggcaggagcctgtagtcccagctactcgggagggtgaggcaggagaatggcgtgaacccaggaggcagagcttgcagtgagccgagatcgcaccactgcactccagcctgggcaacagagcgagactccgtctcaaaaaaaaaccaaaaacaaaatgtgcacacagttggaaagtcacagattttctttcaaaataatgtcatacccatgggtctgtcagtgatttctagaacactgtatttcatattttttctttttaaaaagaattacatgagttacacttaacagcaatttctcaacagattgtaggagcaattagcatgacctggtttggatcctaatctgatgcactctgattacatatgattataaacacgtttgggttaactcacttaaaaatgggcaatctcggctgggtgtggcggctcacacctgtaatcccacctctttgggaggccaaggtgggtggatcacctgaggtcaggagttcgagaccaacctgaccaacatggagaaaccccatctctactaaaatacaaaattagccaggcatggtggcgcatgcctgtaatcccagctacttagggggctgaggcaggagaactgcttgaacccgggaggcggaggttgtggtgagccgagatggcgccattgcactccagcctaggcaacaacagcgaaactccgtctcaaaaaataaaataaaataaaaataaatagtaaaataaaatgggcaacctcaagggtgggaggaatgaggagtgtttaatgggaacagagcttcagtttgggatgatgaaaacgtcgcggagatggcggtggtggtggctgcccaatgtgaatatacttaatgccgctgaactgtgcacttaaaaatggttaaaactgaaaaatcttacgcacatttcaccatcacataaaaaaaagcagaaacaattttttaaagggcaaactgctagctcttgaagagttggttctcttcacccaaaactttaccttttagtaacagtaaaaataaacgtcagctttgtcatattttctcccctttgcttctgcacttgcagaaaaattacggacacccttcccctcagttgtgaaaatacacttgggaacagaaacattaagttttcttgggctcaaacacaccctcaaacacaagataaattaaaaacaaggcaaacttcagccagacatgaggacctgctcttggcaccgctccgagacctgtgttcatgatctgtgagattccactccgcccagaaaacagcttgcccctggccgcccaagctctgtcacacccgtgatttcccagcagtaaataaaaactgccaagctccctgggacccccatttcctgcgagccctcccttacctttctgaggaacagtctctgcagcttcttgtgtggcagcctgatcatcatgatgcactccccaggtcccgggggccgggctccccttgccgtccagccattctgccagggcagccgccactccttttatcaccttgtgggctgctgcgcccgtcctcgtcaccaggcagccaccccgcacacctcctcttccctcccctcacccctctccaggcagccacagattcccaagccgggagtcctgcccctcacaggcaccagctgtgagttgaaaaaactctggctgcagacaaaacccccgctttgcaaactcagaagcaaaggagagaagctgagaaaacctcagccccgaggctggccttctcctctgatgagaatgcgaagttactcatgctgctccgaatcccagcaggctggaacacaacatctggcagaagccggcaaagcagaagcgtcacttagaggcaatcaaatgtcagaaaccatcaaagacactctgaggggcaggcctgaggtcctcctcaacgcacacctgcccccacttgcccacagccaggctggcaacgtgccttagcagtgcatgaaaagacacttcggtccttctctgtgtcatttaaactgaaaggaggaggcaggcgtaggaggaaggtgaatgaaaatggttgcttatttctttaggtggcgctgggtcagtgaatgcacaccaagggtgcgaggatgtcatcaccctgtattacccctccagatgatgcctccgccccagagacacaggcacgtgcacatgcatgcacgttctctctacaagcttttcccgggctaactcggaatatgtcctctctggctaacataaacatttgctttgttttcctgatcaaaactgaattcccatgtttccagaacatcagcccctttcttgctttcacttgccatggagccctgccttggttctgccagaagcgtccagggctccgtgtgattggcagctgctgagtacaggcggcaggttcagagtcagacccaggacactggcggagtttcctttgtttactggtatagcttcttgttaatacataaatagctttctcctctgaaaacctacagatgcaacagaagagacctaccaactgacaatcgccttcgaggtgacagacaatagaggccacggctaaggatgcaggtgtggaaataaacagatataaaaacacaggacttgaaaagaaggaagcaaaggcaaagaggaaatttaagactgaaatggacagaaatgaccttgatttagggtagtgcattgctaaaagacggggccctgtccatcccttccttactccaagacattgagataaagaatatttccttcccaatcagacagaaatagttgaagtgcaatcgtcctttctccagtggttgctatttcaggaaatgggttctaccaaaacaacttttcacccatttcgtggcttccagagcacacatggcgtatgttctttcccttgaatgcagagctgattaaaactcatttatccaggtcaatgttgcattcgtgtgtgtgtgtgtgtgcacatgtgtgtgcctgtgtgtgcaggtctgcgtctacacagatacatacatacttcaggtaaataacaactgaaaggagctttggtcagtccttcagagggactttctaagggatcatttttattaaccctactttccactatgggaactttattaagaacctataatgtaacatttttagaaacacatgccatacatctgccattatatacacatttttttctattctggagccgttggcaaatattacttctaagcagaacggtcacacttctgagctgttactttgagaatagagcacggtttgttcacaggccaagttatggcaacagaagaaaatgcctctgtcttccaaaatttctcaattaccttttgctacttttgctggcccaaaataataacacggggagattaatagaaaataaggctctttctagtctcacgaaatttcgtctctgtgattttatgtgagtctcagcactgctggtgtgtttcagccttgacttctctctgtgaaatcatcaggagctttaaaacaatcccagttctatttcttttctccaaaatgaatccacatccacatttcacctctttgaaaatgctggatcttaaaatatatgtgcagcctttcacagaaataggcactcctgcttcctggaaacacactgctggcgtcttctcataccgtctaccgctggctgcagcctcagctcctgcggaagacacagccgcagccgagtccgtatcctcgcccagcggtcaacgcagcgccgttcccaccattgtacagagaggtttgtgcttggtgaagccctactgcaggggatttctgagtgtcgaaggaggacaatataaaatattttcctgaaaacttaactctgtggtccttcacaaatactttgttttaattttaaaatatgtagtattcaggcttgattgagatttagaaatttttactaaatttttgtttgagggtgtggtgttggggccctggtattgtttcaaatacacaggaataaaaacggaaggtttcttttggctatctgtaacctattcattcggttggcaaagatgcgtagctcatgtagggcaatgttcccagcttaggcaaatcaggggcacctggggaatggcgatttggagagaggaaggtgggctcattctggtgaacaaatatttccttaggtaattttgcacacagagtaaaagtgaaaggcttcttaagaaattgtgtttacaattgtataaacatcttctttcgaggatatattgagctggtctaatctccaaaggaaaaatacccaagtcaagcaaagcaattgaactacatcgaagatgaactcaccaaagcgatctactgaatgtcaaagtgataagatcatcgcacagagtatgtgggcaccgcccccacccccatcgcggtctggtttgagactgtgaggactccaggttgattctatcgctcctggcaacaggaaactagcataggttagatcagtgcaagccacggaaagcttgaaaatggctcggccaaaaatgctcatctttcctgcaccacatattttgctggaatcgcttgaaatagcctgctcactggcaatccctcttcccatttccaacctgatggcaacgtgcatggatactgagttggggaaagaagaatcggatgggggaaatggaggcacaaagggtccgaataatcctcacctacagtcatttgggttttggtatctgtatttacagttatcctaaatacaattcaatccaaacttccataagaattaaaaggaaattttccaggacttggtacttttgaaagtgcattagcaaaataaatcaggcctttggtctctggctaaatggtggtcatgtgagagctagtgggtttgcaatggaaacccttcattcttaatggcatttaattgcaggtggatgtgagtttgcgaactgaatgttgtcgtggtgatgatggcaagaaattgccttttattcatttctgagaccgagtcttgctctgttgcccaggctggagtgcagtggtgcgatctcggctcactgcaacctccgcctcccgggttcaagcaattgttgtattttagcctcttaagtagccaccgcacccggctaaattttgtattttttgtagagacaggatttcaccatgttgcccgggctggtctcgaactcctgacctcaagtgatctgcccgcctcagcctcccaaagtgctgggattacaggcatgagccaccacacctggctgccttttattttatgccatggggaaatcatcataacaatcttggcttactcatctaccaaatacatttttaaagacattattttgaaaacatctctggctaattggtgaaaagcagctattactgtgtattggctatggctttaaaagcattgctattgttgacaggtgagcatccaccttccagcagcagaaccaaaacgctcacacaattcagcccaaagaataaacaaccacgacacagcggaaagcatctgtttcgtgtttccattagaccatcagcgtctcagcctggaagcaatattttgtgtcttcctctgaaaaacctagtagttcacttccatatctttggacccatagagaatcagacggatgattttagcctgtgttgaagacatcactgggagtgagttgtacctttccccttcctaggccccggggagataggaaggtgggaccgcacggctgtgtcctccccattgggaatggagtggaagggaagtgtctcctcgcatttgaggcagcgttgaaggcgcaagttatcccctgcaccccagtctcatggcgagaacaaagagcccagggagggtaaagctccagatggggcagcctcgtctcccagccccctggacctcccagaaagtggccgaggataaccctgcctgtgacctcatggaaaagaagccttgcagacaggagtgagaagcaggctctatcacgtggaggccctggtgtcaccacagaggtacatggtctgtcccacctggaccaagacaagtggcagaaaccttaggtactggtttcaccaaaaggaaactgaggcccaaagaggccacacatcccaggcactaggacagtggtgtccctgcgtcctcccctccctcagtctccccacattttaccacattctccctcagacgcaaaaccgaatcatggcctctctttaccgctcagccatgtcagctcaaccttagcaccgttcaaagcaattggtatgcatgtgtgtgttcatgcagtgtgcgtgtgtgtgtttgtatgtctatgcgcatatgtgtgtgtgtgtgcatgttaaacggaggacggaatatgaagttcaaattcccccacggcacctggcgtagtccctggcacatggagtgtgtaaagtcatgttcttaagtgaaagtatcttgggaaactggcctcattttcccttacgcagctgatctcgaatcacacaggatctcgcactgggctgtaagccggcaccagggttacaacctgctgtgcaccacggtccctgagagactcagcctcacatgaaagtcctgtttgctcccagttcacaggtaaataaatcaacagctccacggagaaagaatagcaccttcccatcctgtccactcccaggaaacgaccttcacttctgccccgacttctgggagccaacaaggaaagcggagcaagccatgaccctgagccttgcaccacgagatttgaggcctgtgggcaccgaggctactgcagagcacaggtggaaacacaggtacataggtgactctccgtaggtcaaagaaacggtttcacatgcttctgtgataacagctgcaagcatgaataaagttcagtttcctttggaaggcattgatggtttcagcagctctcctcaatgcgtggatagcaaaaatatagctactacaaggtggggtctgtgatttattgttattacatttccaacagagtcttaagctaaaaatatttgggacccagtaactgagaagtcctagcagtagtatcaggatcacagaaggaaccacatttcctgccttacaggtttggtttccagacttagctgaagcctgttagatggcattcgcttagcatggaaaaagcaaagccaagaataattttaaattcttttggagtcattaaagggttacattaagaaaatggaaaaatattatttccacaaaataaactgcaagagtaaattatctttgatttcagcaaatgtctgcatcatagaatcacagttaagaccctaaagccacatggctcggttcaaatccatgactcccctacttggctgtgtcacctggtacaacttaattgcctccatgctcttatctgtaaaatgggagagagcggcaatgagagtgactacttcatctggttgttgagggtcaaatgagttcacattgcaaggtgcttagaacatactgagtattctataacgatttaccaaagaaaagcaaagcaaaaacaggagcaaggaagggaaccttggatttccttgggggaacaaccttggaaaccaaaagttaattaagaaagagctgtcaatttctttacctcctccctgtacagataagagcattgagaaaaggcgtttcgtaagtagtgaggcaccacacggatgaacggcgacgaccttgttagttcgctgttacagatcaagtcccaagggccccatgataataaccaactgcaaacgatcccagcaaaaccagagctgtgcctgtccgtgtacctcgagaaagaggggtgcacccagcagtcctttaaagattgttttcagatccatgacggcacggccggccttgtctatgtccgtcaccaaatgctgaattgtgtggcagacacaacactgtccatgacctgctgtaaagcagcttctgttagggttcttgttgttcggctagaaagaatgcgaagtgtttggggagttgtgagcgtgaggaattgccatgtgcggggcttctgagtgccctgtgccttgcatcgctgccggctctgaggaccacgcggtgctgggactccactcccactggggagggcgtgagtgagagggtgagagaaatgaggctgagccccagctcagagctgggaagacccctgggatcgcccggcacagtgtggtcagggtcatttaaggccagcgacattttagtgatgggcagagggaaggacaccagggggcgcgtgaaaaggaagactgtgaggcgggaggaagagtgggaggctctgcccagggtggccgaggagcagggtgcttcctaaaggaaggtgtcgagaacggcaagctctgaggaggtgctggaacgcggggatcaggtctaacaacacggggcccgcgcttccctcctcacaaggcagctcaatgaagctgaaggagtgaaatccagccacagtgagaaggcgggcaggggtggttgctggaggaggccatgccgcaggcctagatggggaagcagagtggggcaaggagcagggggttgggaaggggtcagggtccctgtcactgaccacattgagtgtggctgcacttccccaggcacagccgggtgccctcactctgtgaaaaacaaaccacaaggagcctgcagccatgagcccgcaacccctgacaacgggaggaagacgcgccacagggactgggacagcggccaccgcggtgacacctacagccacgcaagcacctgcgtaaacacgtgctacagtcacatgttacgtatttcacacatttacacactacacaacgtgtgtgtgttcacacacatgtgtatcaacacacatatgcaggaacgacaaagcactttggcagccttgacgttatctctaccgagttctgtcctctcatcatatgtccacggaggtggcatgaccttcccaacaccaaacggccaatggggtgaccccgcctgggtctctcagctccagcctggggctttctcctccctgccagctccagggcaggtggcaggaggaacagccaccacgctgaacaaggaaaggacccagaagttaggccacatgaagagagccacagtcctggagtgagcctccacgtggccagccagcatgggtagtgtgtgcagcatctctggactcataaacagtgctcctgacgctggactccacaaagccaagtgccatgagaagctcccagatgtttccagggctgcaggtcagcaggtgcgtccagcacaccggccctcaagtagaggatgctccgggacgcgtggtgacgacccacggccacgagcacagccagccctccttagccatggcccccgcacctgctcccacctccaagatccctgctgcccgcttagtgtggggtgacataggttccttattgcatccgcagctcagggacgggcgcagtgtgctccaagacatagaggctcaataaatcctgcagtaataacaagaaaacgactttgtttaacttttcgtagattataaaggataaccatcattccctatagctcttattttctgagacctcgatgtagaaagtgctggcttaaagtggtgtagaaggtgtaagatgtggagctggcatttaaagaagagaattcaaagagcatcttacttttttgaaaggcgtggggctaagcatcacattttacatgcacagctgagcaatcgacttaaggtgttttaggcttcatctcctcatctgtaagatggcaatactcacagtaatataaagaaacagtgattatgaagaattggctggggcaatggcaggcactcagcgactaccagcttttctgaacaggggaagggaggttgagtatacactcccttcacgctgacacagtcctccagcctgttaggaacaaaacacttcccgctttctagttcactgaaggtcaatatcataatggctgtgattacgatatgagaaattctcagggtgaattacaaattccaaacaaaacattccctttgggtagcctgaggtgtgtaattatcatgatgacgtctttggggttgcattggtaagtggcagtgacttgtttgattaatggattgaatatttcttttcatgtcactgaatagaggataccttcaattggtgaaattgcctgagagacaacacttatccatgttactaaacccaagatatattgaataacttaaatctgtatcatatcatcacccagtgagtatagtgctatttaaaaattttttaggataagctgagccttaactttaggcctataacttcaattatatttaattttcaaatataattattgtaccagtaatatagatttctttggaaattattttaaaaatgaagaaaagaaaaaatacatataattgtacaacttaatgaaaagccttggtaatttttggatttgtgtgtatgtgtgttttcctttcaagctttttctaaaaatcttgcctgtttctgtgggagttaggaggtgggctatagctgaatatgataaaactttgatgtactgttttttcccctaaaattaatgatttttctccagctatcccaaaaagacatttataagtatggcctcaatcaaaggatttttctagctcaaattctaattctgactacagcactattttctgctgaagtgcaatgcacagattttgaaagcccacccagtgactcaagtaactacaggaatgaaacagaatttgtctcttcagcggttgtttggggctggaacgcagaagcacagaggttgcgaggtgctcctttttagctgctggtatttccttttgctgccacccctgttctggaagcttcccttggcaccctactcgccccacagtgtctggacccagctgcgtggccctgtgggcctaacgtgcctctcctccctcgcctttgtttacaagtccaaagaatgtgcctccccacccccgaaccctgctgcacccagaagtctgcaccaactcaccgccacgagagtgaatgaaggtcccttccttacctgggggctgccctagcaaagaggaagggctcagctacctgtgggaaaagccagctccaccatggaatttttgtctctgaaaacagactgaagaaccagacttttgtattttatcccctagactctgcccagtttttaatgtcgcctatcacctccccatgagcaacgccatcaaaaagcaaaatacaactgcgactaccgtctcacacgcttcagcttgcaaggcagaggcacggaacgatttgatgaaaaagacagaggaaaacagaaaaatcactcctctaaccaagaccacaaaggccgcgcggatcaatgtgctccagatcaatgcggtccagaggtgaaagcgtggttagaggaagacaaaaaggacagagaagccagctcgcgctcccttcaggatcctacttggaaaattaattttgtgactcagctgagggctgctgctgtcacccaggagcccttcagactgcgctccacttgccagcaagcctcaaagggacccaggaagggtgaacattcggccagaatgtgttgagcgtccacaatgttccaggcttagcccccgcactgcagctccctaagttgctttgcaaaggactgagtttgggtcacctcattattttatttgcatatcaggttacctgacaaaagaacatattgtttcccaaattattaagaactaaagacaatacctcctcaaacacacacacacacacacacacacacacacacacacacacaccctggtgtcaggcagccggccaccacagagtgtgtgcggggattgctaaccatggcagagcctgctctcactgtttgggtgcaaaccttgggggttttatttttccacgactgtggagtctgcctctgtgtccccacatgtaaaatcgctaccttggccaccactgcaccataacaagagtgctcacatttctgtccttccaataccaggaaatctgagaaacaattactttttctttgttcaagtcccacccaatcgacagatgatggatcaatgcagctctataaaacagggcatgtgtgttcacttcaaagccataagaaaagggaagaaagaggaggaaacccagagagggcctcagcgggcagcagtggccctggacaagctccccccgttctggttgaggttgggtatggacaaaagaaaacatcctccccttggaactggaacctcctttgtgtcttttctaaaagtgatttttttataaaggcaaataaataaagagtgaaatcatgatggagaaagaggacatacaattagctgtgaaactagaggcaccttgcaggacttattaggcaaaatccatgaaagacgctgaccgctgtgttagtgccacccacgcttctgggaccatcctggtgagcggcccaatgttccttagccaagcggcaggggcagctgcctctgcttcagaggctgagtctgtgttaggagtttcagcaggagactggtataacaatctgttgaacatcaacttttgtagagtcttttaaaaaatatgtacagagagaggtgagtagggagggagagagagaggaaaacaaaacaaaacaaaaccagaatgatcagcagagggagagttaaagccttcacttggcaatcactgctgccttcctaccttttcagacttctgggctgctcccgggtgacgctgtgtgagatctgatttgcttttttcatcctgaacctacggggttcccgcctatcaaattcaaggtgaatctggaaacactgccaggagtttaacctactccgggcctaaaggcagtggaggggattttgctggccctcagcccacagagaccctgtggccacatggctccgggggttctcccatgctttgaccctaggatgtgactggacacagggtcctggcagaaacagccgctttcctgggaacactttccagttccaactatggcaacttacggttaatgcctgtgccggcctggctgttgatttaggaaggaacgactctccaagggcacccacaccctaccctggccctgaactctgtgcagcacccaccagaccaatggctgtgccattggcccaatgttcactgctatgaccaagagaggagaaacacccagtattggaacgcatcatctttatttggagtgcccaggctaggtgtggattgggatgatacagataataataaaactttttcatttgccaagaaacacagttcatcacacatttggataaagccacgtcaagtttcgctaagaatcaccaattacagcttgactctttttttcttggacagattatggaacagactgacaagagattatgagaaaggaatagaagacggtgttcctccaactccagcagaccttgtttgctgagttgatttaagttaggatgtaatccaaactgggattcaggcatttgcttaaccccttaactgaaatagtcagaaccagcttgagattctgtgtgcccacccctcacctttgcatggcctccatcaaccatacagttcaaaacacaagttccacgtccaataaggaaacttaattcatgcaaaatgcgttcagacccagatagtagtaccacaagtatggaaaaagtaaaacagtggaattcaaatgtcaagcattgtgggcaatggaatgcagtagggacctctcttccaggatttgggaccacctaaaaccaggtgggactcagcctctcccatcagggacttgcaggccccagcgacggggctgagaaaaggcggccgcatccttgtgcagtgccctccctgggcagctccgagggccacccactgcccagcaagacccctgtggcagagctcatgctgttctcataagacctttttaaccttattatatttttgctttttagcttcaggaaagctgccagaaaatcaggagtatttttgtttcaaatgaactacagcgcagtttaacgtatcaatgtagatgaacataagctcaaccagaaaccaacttccaatgacccgtttggcacctacaaggagcaggcccatctagcctgctgtgaccgctgcagaggcgcggccccaaggatgatcaatcccatggtgtcacaaccacatgtggcgtgactaccgacttactacatttcacctgagtgttgcagcccaaagcattgaaaacagctattaaactatctttaaaaatgtcttattaataaaggtattaaaaccagatagatgcttgaaataggagaaatctacctccatctaaaattatctattttagtcctaattcctagaaaagctgttgctgagccacacgcactagagtctggaggctggtcggccaccagcctgcaaacctcgagggcagacacagccccaggcagcttcagcacccccacgtttgcctcgctgccatggctcccttctgccgctggtaatttcagcttattttgaaggcacgtcgtagttttaaaaggaatattggacataaagtgatgcagagattcagaatcaaactcaaatcataatgcatggcaagatgacatcctcagtttagcacgcaaggcagcccctgctgtacaaggacattactgcacaaagcactcggattccccacaggatgccaaaaaattcacattttcctgtggagtggtccagccttctaaaagctcttcgcaccttgccttgctggactccgggcaccgtgaaacaactcaataaattgaaaaagacttcatgtttaacttaaaaaaaaaatgtaactcacataagcatggaaaaaaacaaacccacaggaacgcttcttacctctacggatccagctacctttgtcttgcaggcagctgagtcacttttgccctgtgaaaatggaaacgaagaaagaattcctttaagtcacaggacgtatttacagtcagcaacttcattagcaagggcattactaccatactcaccaggcctgtgagctttttgtttctaaacattaatctccacataattttaagtaattggaggagtttctttcgcgttcaggaagccctttagtgaaagcctacagaagaaaggaacttgcgacttttgtgcaacttttaaaatttagccaaaggaagtgatggtgtcccatcaccaacctcaaagctcaacggaaagaaagtctctttcaagctccatatgcacagcatttatcttccaagccacgcatcagtgacgagcaggcaaatgctttcaggtgactctaaactctagtctatggaagaggctcattccagctattttaatctgtagatttcatcttcatctgtaatacgctcgcatacacctagttaaaattccaatcgtgcttggtccagggcttaaacccggaagcgcgtgtgtctaggaggcctttcttcttcccaagcctctttttggccagcatggtttggaggtgacctgaagattttactcagcaacgtggttttaggactgctgagagcagagacaacggctacccttactgcggcacgttcagtgatgcaggggccacatttccatttcctactttctcctttagccttttcctgccacatttctcttctgttctctgttccttggctcatacccactgaaatataagagatgaaggaagaagccagaattcaaatgaaatctcctttgcccctactgatgactgcggttcaagtgtcagaagacagagcgttggaatcaccatctaaatgaaatgaggctaacaggagatgccagcggcctctgctgcctcacatggccctcggttgtcacgagtgagcacagctttggggctggcttctcccgagtgtgccatgaggaaaggggtccagcgattcttccctgagagaaacccctgcactgcgggtgcccattctcgcctcagcctacacctcctctgtcctccaacacagctgatgagcggccggtttatcgaggtgagaatcatagctctgtttgttttatgttcccaactggacggtaattaataactggcaagaatacagttgctaatgctgactttaccacttgtttttgccatttatgtacctgtttgtattgtactgggcatgtatggtgagcctatgtggggtttctacccagcagcccttctcccctcctggcaagcactccctttctttctatgggacactagttccatggagtccaggtgggaatgaccccaccccccagcccccccaccactgggagaaaggccctagcagggctccctcagagctgtcagcccccttgtcctgggatggccagcctggcagatgacctaagtctggggtttgtgcttgctctgccttggaaatgtgcctgcctgagaatggagtcgagcaaggaggaagagaaattcagtgtcctgccgacagcttcggacgctgggattcagacccaccagaaaccatctctttcaatggtgtgagccaacaaattgccaattttaagaaggtttgattctgtttctataacttgaaaaagatggtgagacccggtggaacataaatgacgcttttacagaaaaatacctaatagcatgaaaatcccaaatgtgccgcaatgttgtgccttcgcctatcacctcattccactccatgacctactctcagggcaaccagcttttcaaaggaagtgccccacagatggcgctactaagcccggctgtcgggacacacctgagactgtgcatccagggtatgcggtgcttggggtccctcataaaaagacacattactaaatttttcatattgtcttgtttagaatcactgactgtctttcccttctcacttcctggactctcttctttgcaaacaacattaagaatgttgttaactcccctgaattaaacaggggaatctggaatgacttggacattaaatgaggattctccagccactctgcagccacgctatccctcccacctccaccccttctcttcctccaaactggcccccacacccatcctctctacaccatggtcagcctgctgtgcgggctccacgtctgggtcaaccctgtgtgggcagagaacaggggcagcttccagctccagaaggaaatcccagctcctctactactcctttccgatccaggacacgagaggagaggactccccttacggatcccatctcctcccctgaagcatctgtgactgtgcaggttggagaaggaggcagggaagggggtgaggagagggggaagaggggtcacaggaaagcccagtgtgccctaatgaggggctttccatcacaggggagtcagagcccccacaggaaatcctgactcctgaagcaatccacttttcttttctttcttttcgtttttttttgttttgttttgttttgttgtttttgaggtggagtctcgctgtgtcacccagggtggagtacagtagtgcagtcttggctcactgcaacctctgccccccaggttccagtgattctcctgcctcagcctcgtgagtagctgggattacaggcgcccaccaccacacccagctaatttttgtgtttttagcggagacagggtttcaccattggccaggctggtctggaactcctgacctcaggtgatctgcctgctttggcctcccgaaacactgggattacaggcgtgagccactgcacctggctgcaatctgctactgtccccttcctcgtctgtccatcctgttacatacctgtgaccacattatcgtcaaaatacgtttaacatgaatttattatcatcatggctagctccaccaggaagaaaaaaaaactaccgttgagatgacataaaacgctttgtgcaaatgatcgtcctccaggggtattccgtgaagaggacacttgtcatatagccaagcatgcttgcagaaaataaatggacgtggtcagacaaatatttttgtgtgtttcattgatttgaaataaactatcagaaatttctaaacaaatactcgccaaccttttggaaaaaaatatggattgaatctttttttttaagtctagaaagtgacccagtgttgtgggagaaatgtgaaaggcaggcaccatcgctttcacggcacttggggtcatagtctggatgaccaagattcatttgatcctcaggggtcttttatgattggactgcaagtaaagctgccagccaaattttataacacaaaaggtgttccgtgtgctcacagcacccctgcttaccagatgacagaatgtcttgaagattgtgcacgttcctcaaaagacacatttagacagtcatggtcaggcagttgatagactcgatatcagctatgaatttctcagtgaaattagtgcatgggattctagaaaattggacactttcaagtggtgctgtggctggagtggtgcagccgtctttacccagcgagcgtcccggcgttggttattctgggtctttgagaatgctgtgactgtccctgctgctgctgcacccatcccagcaccacgtggctaagctctcccaagatgctacggaccatggtagggagctcagcctcccaagcagccagccagggtttatttcctggcaccagaacttaggcaagtcattggactcctcagccccaatttccctgtttgtacaattgaggaagacagtcccttacacaggggtggtgggagaaagaaatgagctggcccatattgggctcccagcagacagcagccatcagtgaacatcagcatgatgacgatgtggggaaaattaaggcgttcccagattacagcagcataaaggaccccaaaacatctcgcccttctttgagaacgctggcatgtgtgcttcttgtctgtgacctctgaggagtcggatccccaggtgcttcaatagctctgagctgtcctttattttggatgagccccgtcttccagcttttagggttgggagggcagaggagaaacggcaggtggcactgcggatatttttacacaggataatgtgacctgcccagcctgcacctgcgctcagcatcatcagagttccgtttcttatacttaattaggctacacaaccaattttacgattttaccattttgaaatcacgtgggagttaccaaaatggttaatttaaaacggttttacccagactttggggggcagtcttgattcttaaatggctttgatggctttgataaacaccctgggcccttcctccaaaaaatacacactcattgaaagccccccccacccccggccccttcgcactatgcacagccctcaggagctccacctttggttttgggggagtctctaagtgcccaaaagtttccctcgcaaatttgcacgtctaccactagatggcagcagaggacacagcaagtgagaacactccgaggcgcgtgcagccaatgaaatcctggaaacttgttacattttgttataacaaacaaaatataggccttggttttctttaatcttactgatgtgctcctggaagaagaaaaatgctaatttacacagggtccacgttgtaggaaggctgaatttggtttccatgacccccgactctccctccgctggtgctcagctctccccacacctgccagctttatttggatttctgtcagttctgaagtatcagctacctgaggctgcagcatcagccaagaaaccgtctctttcagacgcttgctggcttcagggctgcagcccggggatcttctctagataaagcgcggtggaaacacacacagacacatgacgatgctgtcgacccacatgcctgagctctgggattccacggctggagctcggaactgcgaaggggcagagactgagcgcaggcaaaggcgcacagagaggactacacaacacaaaggataatgtcctcgcgatggaggaaccactgtggacagtcaggaagacagacacgcgtggagggccagaactggaagtgagggcgggcattgctggctttatctgatcactgggaagggtggttgtgaaagccactgagggtgtgtgcctctccccagccacagcggtgctggagaggaggctggggcgctcaccactctttcctctaccatccggctctgggggccaggtccatgcaaaaatacgtggagaaagtacagcttagaggacttctacttccagcaagacgccaggcagaaatgacagagaatgatctcgctacacccactagaagtggtggataaaacacaacaaaaaaggaggttcaacgaaaagctgagttgtaagaaggaaggattaacccacaggctccagaaatgaggaggactggaagagagagaatggagtccccgcactgactttgagaccgtcctgggggcattttccgtttctgtaatcttccaggttagatttcttgtttttgtgttttaattttttttatatcgaggtgaatttcacacaacaaaattgatcgttttaacatgaatgatgaggtggcgtttagtgcattcacactgacgtgtcaccaggtaattcccaacatctgcctcttccacgcccatgaagcagttgctccccactctgccctcccagtccctggcaaccagcaatccgtgccgtctctgtgggttcacctgctctgggcatttggtatagacagaaccgcacagcgtggggtcttctgggtctggcttcttttgctctgcatgatgtgctcgaggttcgtccatgttgcagggtgtgtcaacgcttccttccctttagtggctacataacatgccattgtttgtttacaccacagtttgtgcgtccattcatccattgatggacatgtgggctgtctcttatcttttggcgactgtgagttgtgctgctataaacaagtgtgtgcgtatttttgtttcagtacctgttttcaacaatcttgggtacatacctaggagggggtcagccgcagcctttcatgtgcttctccgccatttgtagttctcttttggagaaatgtctacttaagcccatcacccattttttcattgggctggtggtctttttgttgttcaagcttgggttttaatatgctggagatacagggaaggaggatggggcggctgtgaggtgaagagctggacctgaggttgctgcgggaggcctgagcagggagcgcaaagcctggacgaaagccccgaccagctgagaagaggacgggagacatcgaacttgtcctgggctcaggttaacaatacatggattttacgtcttctctgataattaaaaatgccaggcctgtgccttccatgagtttgggtgtgaattcataatgacaagggtggctcagggtgaagtttaatgtgacagctggtctggtgccaggaacatgcctaagtcacaaacccagaactccgctgaagggaccacctgaaactgagccacggggaaagcacagagagaggaagtggcctccgagtgcacgcacagccaggagccccagaacccaggcagcgccactctgcacgatgggcagaggacacacaaaaaggcaaaaatggagccaagaattccagagaacagatgaacaatattcaggagtattaaagaagtattgttaaaagttataaaatcataaagaacatagtaaaagaaataaatgtaaacaagttggaaagaataaattaaaactgctacggttcacagatagtataaatctctacagaatccaagagaatctacagagaatttattaatttgaataagagggtatggaaaggttatggatggaaaagtaatattcaaaagcagttttggcaatacagcagaaaataattttaaatgatagcatttgcaattgtgagagagagagaaaagagaagaaaaaaccttataagctataaaagagacatctaaaaaaatgtgtaatgtctttacagaaaagatgagtaactttattgaaagatataaaagaagactaaagtaaatcttaatacagtaaatatagcaatttttccaaagtcaatctgtaaatttaatttaataaaatcataatccaaaaaggacgattttttctgaatttaaaacaaagtgattttgaaggctgaaggacagccaacaccattttaaagacacagaagcaaagacaagccctggcagggagatatcggtgcttacgttagccttagaagaactcagagggtgccacgggcgcagcagagcctggagacctgcctgcctctgtgtggggctcacgaaagggcaaagctgttagagaacagcagggtgagatggcctctgcaacgactggcgccggccaactgactgatcaacctcataccatatatatcaatacattcaagatgcgttaaaggccagaatgtgaaaaaaccaaaccacaatgttcaaaaggatatccaggagatgatatggttgttttaacttgagctactaaagaattctttaaacaactcagaacgccatacattgttttacaaattgttttttaggctgggcatggtggctcacacctgtaatctcagcactttcggaggccgagatgggtggatcacctgaggtcaggagttcaagaccagcctggccaacacggcgaaaccccgtctctactaaaaatataaaaattagacggttgtggtggcacgcgcctatagtcccagctactcgggaggctgaggcaggagaatctcttgaacccaggaggcagaggttgcagtgagccaagatcatgccattgcactccagcccgggtgacaagagtgaaactctatcaaaaaaacaacaagattaacccattaactcatgtgttaataagatgcgtccactcctgtcagagagtgagctcctggctcctacaaacagcaccgtaagcgccacgctgcgtctggtgagagttggagaagcaaaaactctggcccgttgctattgactacactgatgctctgatacacccagcattcagctgctttggagagcagtttgtcgatagcagattaacttgaaaatgcgcaaatcttgtggcctgccgatttcacattgacgtgtctagacagggagtgtaactctggcgcacactgatggggagacaggtgcgagctttctcactggcactgcttcaaagatcaaaacattgaacgtaatctaacggttccttggtgggagagtggaaaagtaaactatggcatttttcctaccgtgatgttctctacggccctcaggatggtgcaacagagctctgtcatcagcaggggtcaatcccaaaatatcctaaggagttgtttttaaagtaagcttcaaaagcaaagagactgccttccgtccagtaaagatttaaagcacacctgtaatttatagatgctgagtctcatggactgaattgtatcctcaaaattcctgtgttgaagcccggcccgcacatgtggagggtgtgagtctggaaatgctcagggacccccgggcttcacaagatgactgagacattggaggaggggcctgggagcctgtgcttgtgaccccaacccttggctggtggaataggggagagcccagggctaagggagagaaagaaccagtaacccatgtgccggagccgctccggggcctcagtctagtcaggatccagatcacacagccgtgatcgcccacatcccgtccacagagcacttgctctgtgtccttaggtgagcggccagggtgtttcctttccatgagcagattcggctcaactcatcctcctctcaccccagactctcaccaggcagaagaggaactggatggctgactgcagaagggacccatgaagtgagggcggccaagagaaataacggcaaggctggggctagcgttgccgacggctgctggaaaaggactcaccaagtccctcagctcgctagagacaaccaatgctctcagtggcaaacactggggtggcagactgggaaggagatagtttttttgaactcatcccaaggataccaccatattttaaaaagtgccaagatgacagtgctcccccttttctatgggagatagggaaaggcctcctctgcttttcttcatggtgggaggccttgctaatttctcaggcaaggggatggctcaaagcaggagaagtgttccttggcaagcaatgagtagcgtcactgtgaccaatagcagcatagttctgggctgcatcgcgtaccccaaaatccatgccttgaagtccagccccagtgcctgggaatgtgtcctgatttgggaaagggccattgcagctgggcttagctgagaggcagtcacctcggagtatgtgggcctagtccaatatgatggtgtcctcagaggcacagaaacaggtgcatgggggacaatggccacctggccatggggagagagatgggggaaggaccaccagcaaccatgaagccagagagaggcccgagcacagcctccctcacagccccagcgggagccaggcctgcggcacctggacctggggcttctggcctcgggactgtgagacgaccaacctctattgtttaagtcgcccagtctcggtgccttgttacggcagctctggcaaatgcgtataccacagaagccagaggttcccttcatgggcccacccagaggagctggagaaccaggagaaaacatcattcagtgtttaaccaaggggaggggtcagacttgaaatatgagccaatcccagatgtcgaaggtctcctggtggtcttttatgggcatttaatatgctatttatagttttcatctgcacctgtagaaaatacataattgtctcaaactaagactcagggcaaaaaagtgtgtctgcaacattgcaagtcagcctggttggattacacagatgtggacaagaccttttaaaaaatatcttgtaacaccccaggctgagcaaccaacactccccagtggactaatgcagagccacgctgcaatcaagttcatcacaatcatgactactccgatattcggacacttcgctagcagaaagagactattttactgactcctactagaagctccagttcctctcccagcctttaaggactagaaatctctctaaagaaacagtattgctgggttgtaaataagacatcactcctctaacagaaatacaaaacatgatggaccttttttctctgcttaaatttatgaaggtcatagctttagaaagaccaatcaacacatcaggttcttattaagtgtatttaagacgaaggtaggtcattatcaactattttcacaaaggaactaggaaccgcatttcactcttaattatacataagttgactgtgcattttggggattgttcaagatgacttcttaacgtcagtggcttctccctgtcacttggacgctgtcctcacaccccctggcgtgctcccagggaagactagccaacttgaccccctgctgaagcaacacaattggggtcacagctcccagcagaggcaggacttcgctctctttgggtgagaggcacctggaggggctgccacagaactacatgcacccacccaagtcaggcaggttcacctggtggggctgacccaggactgcatgcatgcacctaagttgggcagatgtacctggaggggctgctcatgtcccgtatgcactcaccccggtcaggcaggtgcttggtaaacaggcccagctgcaaatgacagaggaggccaagcaaactgggaaccttcctgaggacagatgatggagctaggagacggcatctctgagatgcagcagagacttgcaccaggagccaggagccaggcagatggagaagcaggcatggtttagagtccagaaggcaaagcttctccctcagagccgactatgggcagagtgtcccaaccaccagtgtcgacattctgagtggatgactctgtcgtggggcctgtcctgtgcatgctaggatgttcagcagtatatctggccttgacccactagtggccagtagcatgtcccccctggacagcccaagttatgacaaccaaaaatgtctctagaggccgggcatggtgactcacacctgtaatcccagcactttgggaggccaaggttggcggatcatcttgaggtcaggagtttgagaccagcctggctaacatggtgaaaccctgtttctactaaaaatacaaaaaattagccaggtgtagtggtgagcgcctgtaacccccgctactcaggagactgaggcacgagaattgcttgagcctgggaggaggaggttgcagtgagctgagattgctccactacactccagcctgagcaacagagcaagactgtctcaaaaaacaacaaccacaacaaaatgtctctagacgttgccaaatgatgtccctgagttgggtgatgcaaaattacccctggttcagaagcaattgagtctttagaagcacaagtccagcctatctggggtcccggcaggttttgaagatggagactcgggtataggaggagacacacccatgcaccagactcttaaacaaagtcctagctgtgctctcaggaccgatcagaagccagcactgaagcagcagcacgaggttagagccaccagaaggaagcgtgactcgatcccgaggcccggattgctgagttgggcctcctcaagtcctcccttggcaccagcagaattactcaaaagcctgtgtctgcatcttagaggcagatggctacagcctgctctgggagggagcggatggccaggagagagccggggccctacctgacgtcagaactgtcctcccagccccagctcagcccggatgcaacagaagccagaagtgcacccaaggtgcaggcaagcagggattgttcagcacaaatgcactcgtcagttctaacttattcttaagctgactcagcagagtgcttcttcctctgctctgggtgatcatggaggccaccccaggcttgtctaatctctctcagccaatcacaggcctctggccccaggatagctaatttgtgtccacttggctgtgctgtggtgcccagttgtttggtcaaacaccagtctaaacttgctgcagggtatcttttaggtattattattattattattattattattattattattattattattattattgtttttgagacagggcctctctgtgtcacccaggctggagtgcagtggaggcttcacagctcactgcagcctcgacctcctggaatcaagcaatcctcccgcctcagccttccaggagctggaactacaagcaggagccacgtgattaacattgaaatcagcagatttgagtaaagtagattaccttcgtaatgtgagtgggcctcgtcgaatcagttgaaggccttaagggaaaagactgagctaccctgaagaggaaggaactctgtcttcagacagccttgagactagaacatctactcccactagaattcccagcctgctggtctgccctgtgaacttgtgacttgcctgccagccccacaattgtgtgagccaattccttaacaaaagcaaattgctgtctctctctagatagacagatatagatacaaatgacatagatatatgcatacatacatatctaaaatttcatatatacacatgcacacatatctaaaactacatatatatgtacacatatctataactgcatatatacatgtgcacacctatgcatagctatgtatacacatgtgcacacctatctgtaactacatatatatgtgaacacttatttgtaatcacatacacgcgtggacacctatctaaaaccacatatacacatgtgcacatctatctataactacatatatacacgtgcacagttacctgtaaccacatatgcacacgtgcacacctatctataccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcataaccacatatgcacacgtgcacacctacgcataaccacatatgcacacgtgcacacctacgcataaccacatatgcacacgtgcacacctacgcataaccacatatgcacacgtgcacacctacgcataaccacatatgcacacgtgcacacctatctataccacatatgcacacgtgcacacctatgcataaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatacacacgtgcacacctatgcagaaccacatatacacatgtgcacacctatctataccacatatatacacgtgcacacctatgcataaccacatatgcacacgtgcacacctatctataaccacatatatacctatgtatgcatgtctatacatgagaccagagaagtcccgcagtggtctccatgtctcatccaggacagaggaagcattctaccgagtaaatttatgaataagtttggcttgatgagtgcatttgtgatgaataatccctgtttgcctcactttgcatgtgcttcctggcttctgttgtacacgggctgagctggggctgggaggatggttctgatgtcaggaaaatccccagcttgccctggctgtcaggtccttcttagagcaggttgtagctattggtcactctctgtatacacgtgtctgtatatgtgtaaatctttctgtgtttgcgtctacctatctgtctgcatctttttagatctgtttctttggagagcactgactagtacaatcccatttgcttgtaaaggcagtctcattctgaaataagacaatcttccgaattcttgatgtaagcctctgcctgtctgggacattccccggaaagcaggggagggacttggcgcttcttctcttcacccctcatgtgccaccccccactaggctgccaaggcaggtcacccagttctgccggcctcagtctcctccctaggtcgctggctccaggtttgaaaagatgtgtatagggcagggattattggctctttcagtttatgggagctgttgctcctttcttctacttacttgagggtttattattttttaagtaattactttccatagacaatggaccagaaaacacctgaaagatagcgactaagttcaaggttgctccacgccaggcatggtgctcctggttcgagagctccactcacgtggtccttacgagaatctgagcaacatgaacaccgtttttcagctgttgaacctaagactgaacaaggttaaataatttatccaaagtcacaagctagtagttgcagagccagcatttgaagtcagacttagctgagtccaagcccgtattcttaagcaccacaatttgcttccaggcatcttgtttctataaagcactcaatgattttactacaacgatcttatttatatgagacttaagtcattcaaatatgtttttaggacatgttagtataaagacaaggtattgccaaaaagattttttacctttcttcctttttgttctagaaggtcaataatgaaatctaacaaaataataataaaaatagcagataataatcaattaaataacatttggttttattttctttttaaaaatctaagaaaaaaggggttctgacaaatgtgaccagaaaaccatacaattcagatatcctttttcaacaatcatttatgggtgtttcttgttatttgagaaaattgagttaggaacagtgactcctccaatccacttacagtatggaaagctgatatcacagtacattttaagtccttctgtggtgaacagtctccttttattttgctaatcatcatggagcagaactaaatatgaacacaggagtggcagcctggctcagccagcccagaaaaatgtctttaaaaatgaacttgtctaataaaccttaattccaaatacagaacataaggaaggagaatttacaaatcatggtattagcagtaagaaaagcaaaccagttaaaaggagttaatagagaataatgattgttaatatggccatgaaaatgggagaaaatggtgacaaaactgattatcaaagtagaaaaggtaacaaaataattcatgaatgatatcacggatgcaaaaaaaaaaattctgattgcatcaacaaagatttgtagacggttgggagtagtatggaaggaagaatgtaaaagtattcttttttgtaatttacttcaaacattgctaggttaatagatattgccattttatagtagtataaacaaaaatgctacaattatacttttaaaagatgcataccttccacatcacaggaggaaaaaaatgcttaaaaaaatcatcatagcaaaagtgaagaaaactgaattatgtcatgataaatttttagtaattgtgtaatttagtgctcaaaaatagtttagttcaggtgttttatgcttaattttggttactttcatcagtagagtaatatatataattccagttccacatttttgatcctcatgaccactagagggcagaagagaaaagtacaagaggcccgagataggtcaaatgagcctgatgccattttgcaatgtgggttttaaatggccttcccaaccaggaattctgattcgtggtagacacagctatgtcggtgtgccaatatgtgtatagaaaactcaatccagaatttaaatatttttcctaaattaggccttaaaatattattttgcataaaataagatgtaaaataagcatgtttatataaaaatattcaaattatttgacccaataacttctaggagtttatccaaagataaagactgatgtatgtggatgtttatcatagtgttttttttatcatgatgtataattgaaaatttacctaagtaatcaacaataggggattgtactaataaattatggtacagctatatgatggaaaactctagctgcttttaaaaatatttaagtgttttggggaaaagttatgaaatgttaagagaatattataaaaagtatgatttgatatttatgaattatataaactgtgttgatttaaatatagaaacatatctagatactgatgataaaaatataagtctggctgtgggagtacagatatagaagtagaaatgttccaaaaaaaaaggtcacagttgaaaaaaatataccccctgttaaaagttactgtctcttctttattacatttaaatttattttaagcatttatacccttcactgggaaaactgactagccataagcagaaaactgaaactggaccccttccttacaccttatatgaaaattaactcaagatggagtaaagacttagatgtaaaacccaaagccataaaaactctagaagaaaacctaggcaacaccattcaggacatgggcatgcgcaaaaacttcatgactaaaacaccaaaagcaatggcaacaaaagccaaaattgacaaatgggatctaatcaaactaaagagcttctgcgcagcaaaagaaactagcatcagactgaacaggcaacctaaggaatgggagaacatatttgcaatctactcatctgacaaagggctaatatccagaatctacaaagaagttaaacaaatttacaaaaaaaaaaaaaaaaaaccaacccatcaaaaagtcggcaaaggatatgaaccgacacttctcaaaaaaagacatttatgcagccaacagacatatgaaaaaaagctcatcatcactgatcattaggtattatgattaggcaaatcaaaaccacaatgagataccatctcacactagtcagaatggcaatcattaaaaagtcaggaaaaaatagatgctggtgaggctgtggagaaatgggaatgcttttatgctgttggtgggagtgtaactcggttcaaccattgtggaggacagtgtggcgattcctcaaggatctagaacaagaaatatcatttgacccagcaatcccattactgggtatagacccaaaggattataaatcattttactataaagacacatgcacacctatgtttattgcagcactatttacaatagcaaagacatggaaccaacccaaatgcccatcaatgatagactggataaagaaaatgtggtacatatacaccatggaatactatgcagctataaaaaagaatgagatcatgttctttgcagggacatggatgaagctggaagccatcatcctcaacaaactaacacagaaacagaaaaccaaatactgcatgttctcattcataagtgggagctgaacaatgagaccacttggactcagggaggggaacatcacacaccggggcctgtccggggtgaggggcaaggggagggagagcatcaggacaaatacctaatgcatgtggggcttaaaacctagatgacaggttgataggtacagcaaatcatcatgacacatgtatgtatatgtaccaaacctgcacattctgcacatgtatcctggaacttaaagtaaaataaaaaataaaaataaaataggtgggtggagccaagatggctgaataggaacagctccagtctacagctcccagggtgagtgacgcagaagacaggtgatttctgcatttccatctgaggtaccaggttcatctcactagggagtgccagacagcgggcacaggacagcgggtgcagcataccgtgcgcgagctgaagcagggcgaggcattacctcactcgggaagtgcaaggggtcagggagttccctttcctagtcaaagaaaggggtgacacacggcacctggaaaatcgggtcactcccaccctaatactgcacttttcccacggccttaaaaaacagcgcaccaggagattatatcccacacctggctcggagggtcctacgcccacggagtctcgctgattgctagcacagcagtctaagatcaaactgcaaggctgcatcgaggctgggggaggggcgcccgccattgcccaggtttgattaggtaaacaaagcagctgggaagctcgaactgggtggagtccaccacagctcaaggaggccggcctgcctgcctctgtaggctccgcctctgggggcagggcacagacaaacaaaaagacagcagtaacctctgcagacttaaatgtccctgtctgacagctttgaagagagtagtggttctcccagcatgcagctggagatctgagaacaggcagactgcctcctcaagtgggtccctgacccccgagcagcttaactgggagacaccccccagtaggggcagactgacacctcacacggccgggtactcctctgagacaaaacttccagaggaacgatcaggcagcagcatttgtgggtcaccaatatccgctgttctgcagccaccactcctgatacccaggcaaacagggtctggagtggacctctagcaaagtccaacagaccttcaactgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaactggaaactctaaaaagcagagcgcctctcctcctccaaaggaatgcagctcctcaccagcaatggaacaaagctggacggagaatgactttgacgagttgagagaagaaggctttggacgatcaaactactctgagctacagaaggaaattcacaccaatggcaaagaagttaaaaactttgaaaaaaaaattagacgaatggataactagaataaccaatgcagagaagtccttaaaggagctgatggagctgaaagtcaagggtcgagaattacgtgaagaatgcagaagcctcaggagccgatgcgatcaactggaagaaagggtatctgtgatggaagacgaaatgaatgaaatgaagtgagaaaggaagtttagagaaaaaagtataaaaagaaatgaacaaagcttccaagaaatatgggactacgtgaaaagaccaaatctacatcagataggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaagctcgggttacccacaaagggaagcccatcatactaacagcggatctctcggcagaaactctacaagccagaggagagtgggggccaatattcaacattcttaaagaaaagaattttcaatgcagaatttcatgtccagccaaactaagcttcataagtgaaagagaaataaaatcctttacagacaaacaaatgctgagagattttgtcaccaccaggcctgccctaaaagagctcctgaaggaagcactaaacatggaaaggaacaaccggtaccagccactgcaaaaacatgccaaaatgtaaagaccatcaaggctaggaagaaactacatcaactaacgagcaaaataaccagctaacatcataatgacaggaccaaattcacacataacaatattaactttaaatgtaaatgggctaaatgctccaattaaaagacacagactggcaaattcgataaagagtcaagacccatcagtgtgctgtattcaggagaaccatctcatgtgcagagacacacataggctcaaaataaagggatggaggaagatctaccaagcaaatggaaaacaaaaaaaaagcaagggtcgcaatcctagtctctgataaaacagactttaaaccagcaaagatcaaaagagacaatgaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgttaacattagacaagtcaacgagacagaaatttaacaaggatatccaggaattgaactcagctctgcaccaagcggacctaatagacatctacagaactctccaccccaaatcaacagaatgtacattcttctcagcaccacatcacacttattccaaaattgaccacatagttggaagtaaagcactcctcagcaaatgtaaaagaacagaaattacaacaaactgtctctcagaccacagtgcaatcaaactagaactcaggattaaaaaactcactcaaaaccactcaactacatggaaattgaacaacgtgctcttgaatgaccactgggtacataacgaaatgaaggcagaaataaagatgttctctgaaaccaacgagaacaaagacacaacataccagaatctctgggacacattcaaagcagtgtgtagagggaaatttatagtactaaatgcccacaagagaaagcaagaaagatctaaaattgacaccctaacatcacaattaaagaactagagaagcaagagcaaacacattcaaaagctagcagaaggcaagaaataactaagatcagaacagaactgaaggagatcgagacacaaaaaaaaaactcttcaaaaaatcaatgaatctgggagctggtttcttgaaaagatcaacaaaattcattgaccactagcaagactaataaagaagaaaagagatgcaataaaaagtgataaaggcgatatcatcaccaatcccacagaaatacaaactaccatcagagaatattataaacacctctacgcaaataaactagaaaatctagaagaaatggataaattcctggacacatacaccgacccaagactaaaccaggaagaagttgagtccctgaatagaccaataacaggctctgaaattgaggcaataattaatagcctaccaaccaaaaaaagtccaggaccagatggattcacagccgaattctaccagaggtacaaagaggagctcgtatcattccttctgaaactattccaatgaatagaaaaagagggaatcctccctaactcattttatgaggccagcatcatagtgataccaaagcctggcagagacacaacaaaaaaagagaattttagaccaatatccctgatgaacatcgatgcaaaaatcctcaataaaatactggcaaaccaaatccagcagcacatcaaaactcttatccatcatgatcaagttggcttcatccctaggatgcaaggctggttcaatatatgcaaatcaataaacataatccatcatataaacagaaccaatgacaaaaaccacatgattatctcaatagatgcagaaaaggcctttgacaaaattaaacagcccttcatgctaaaaactctcaataaactaggtattgatgggctgtatctcaaaataataaaagctatttgtgacacacccacagccaatatcatactgaatgggcaaaaactggaagcattccctttgaaaactggcacaagacagggatgacctctctcaccactcctagtcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataaccaacttcagcagtctcaggatacaaaatcaatgtacaaaaatcacaagcagtcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgttacctgacttcaaactatactacaaggctacagtaaccaaaacagcatggtactggtaccaaaacagagatacagaacaatggaacagaacagagccctcagaaatagtgccacatatctacaaccatctgatctttaacaaacctgacaaaaacaagaaatggggaaaggattccctatttaataaatgctgctgggaaaactggctagccatatgtagaaagctgaaactggatcccttccttacaccttacacaaaaattaattcaagacggattaaagacttaaatgctacacctaaaaccataaaaaccctagaagaaaacctaggcaataccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaagcaacctacaaaatgggagaaaatttttgcaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcataccagttagaatggcgatcattaaaaagtgaggaaacaacaggtgctggagaggatgtggagaaataggaacacttttgcactgttggtgagactgtaaactagttcaaccattgtggaagtcagtgtggcgattcctcagggatctagaactaggaataccgtttgacctagccatcccattactgggtatatacccaaaggattataaatcatgctgctataaagacacatgcacatgtatgtttattgtggcactattcacaatagcaaagacttggaaccaacccaaatgtccaacaacgatagactggattaagaaaatgtggcacatatacaccatggaatactatgtagccataaaaaatgatgagttcatgtcctttgtagggacatggatgaagctggaaaccatcattctcagcaaactattgcaagagcaaaaaaccaaacaccacatgttgtcactcataggtaggaattgaacaatgagaacacatggacacaggaaggggaacatcacactccggggactgttgtggggtggggggagggatagcattaggagatatacctaatgctaaatgatgagttaatgggtgcagcaacaccaacatggcacatgtatacatatgtaacaaacctgcacattgtgcacatgtaccctaaaacttaaagtataataacaataaaataaaaataaataaataaaaaataaaaataaaataaaaattcatccattctaaaagaaatgtttatacttttgtatatttttctcattttctacattgtaatatactgtattccttttaaattcagggaaaaaagaaatacacattatgtggtattaataaagcaaaacctggaccctctttggtctttcagtgtcttaaaatcataaagccagacccatttgtgatatatggaggctgatagttgaaaagaatgtacaaatctcaactgtatttcattttgctgttctattaaagctatcttatcattataatagaaaaaagaaaaacacagtctttaaattaaaggaacagaacacatacaaacacaactgctttcactcaaaaaactgacaagacactgaaactggtcccagtggtcaggtgaacattgaccatgtggcattaaagagccagtgcccagcaagagtgactttcttcttgaacctgacagccgatcgcagctctgcatcagacaaaaccagatccttcattctctaagctcttctgaatttttcaggatttcactttccttgtaaagggcaggtaatcatcgtggttggaggttgtcaggggtcccctgcaccaagctaagtaatgaggactgcggggtgagaaagacggactctccctgaagggtcccagtgatcacagctgggctccaggctgtgggctgctgccccagcaggctcaggtgcagtgtgtgggcaccgtggtgggatgctcggaccacaggaatcaggaataattttccataaaaggtgggacttgagcctggactgcagatgggagcagaaaggtgtccctggcagagaaaggagaacaggaagcatccaggcagtgggctgagttgtgtcctctggaccaatagtcaaggataagggaatggcttctagatgctgtggggacccacttggaaccccaggcactataaagattattttaatctgaagacatttgagactcaacagatacagaaagaagccttctcagagcttttcttatctgaccagcaacttctcagagcttttcttatctgatggaaaacagcaactttcaagaaatgaggactgctattaattccctcctcggggagacttctattcctagcggggagactaaaagtaagcctacgataaatccccactctgagggagttgtagagccctgaaaaagacaaaaagaccactcatgtccatatggacaaacattatcacaaactttcttatctctcatatggccccctaaaaatctggcttgtcggctgggtgcgatggctcacacctgtaatcccagcactttgggaggccgaggcgggcggatcacgaggtcaagagatagagaccatcctggccaacatgataaaaccctgtctctattaaaaacacaaaaattagctgggtgtggtggcacgcacctgtaatcccagctatttgggaggctgaggcaggagaatggcttgaacctgggaggtggaggttgcagtgagcagcgatggtgccactgcactccagtctggcaacagagactctgtcttaaaaagaaaaacaacaacaacaacaaactcatttgtctttcctgaagaaatctattgctcttcccattggagcctctctcctctccctttccctgctaagttggttctacagacccatattcaaaccactcctttcagttgctcaaaactacgcagtcctgagtgcgactgcacagtcctgagtgcacgcacgtggcacactcacacgagtcactcacaactgcacagtcctgagtgcacgcacgtggcacagtcacacgagtcactcgcaactgcacagtcctgagtgcacccatgtggcacacttacacaactcttttctcccgctaatctggcttttgtccatttaacttggaggctcccaggtaccgaacctgagaaggcaaagcttttcctctctacactgcgtttcattctccagggcatttgagagcagttcatgaagagtggctctcacgcccgagcaaagcagtcacagcactggcttgtcggtctgagcacagctgaggatgatgtggagacaatccctgggttggaaaaactccgtttctccaatcccaggctctgctgccgcatctctgtgtctccttcatcaggcactctgcgtcccagggagggaggcaccccacatccgtgctggggacattgtgcaggatggcaggggcaaggcacacctcacaaaagagatggatgccactgaaggagatgaaattatttccagaaatgttttttttttttagaatcagtggcatgacatatagttgatccttgaacagtgcaagagttagggacacccagctccctgcagagtcaaaaatccatgtctatctctggacccccaaagcttaactactaacagcctactgtggactggaagccttactgataacataaacagcctattcacacatatgtcatatgtatcatatactgtattctcacaatagggtaactagagaaaagaaaatgatattaagaaagttataaggaagagaagatgtatgtaccatccattaagtggaaatggatcctcatacaggtcttcatccttgttgtccaggcagggggtgctgacgagagggaggaggaaggctttgtgttgctgtctcggggtggcagaggtgggagaaaatctgcatataatcggacacgtgcagttcaaacctgtgttgttcaaggttcaatggcaattagtttttattagaaaaaatatatcaatgtggagaagcccttgaaggaatttaagcacagaggtgattgataggtgtaaccgccgggtccagacaggccagaacttgaactcaagttgtgctggtcaagggaggtaaaagaatcaaaccttgatgaccagaagacactggagtaaaaggcaagagtgaaaaaaaccttgatttgttacacggtgaaaagcagcagaagaaaaatggcacccgaatcatcgatgtcactaccgttggttggtcaggtaggccatgagaaccaaccagagatcaaacagagcaaaatcgaatatgcgataatttgttcatttccattccaccattcgccctcagtgtttatcccatggtaattaaaaccaactgtagctattgaacaatggaatttgctggtcaagctcttcagagcccaatgtcatcagccttggggtggcccctgcaagtccttgctgtgtccattctgttctcactgaatgcagaaggtgcagcccagctcagggatgagttacagctggcctcaaaagtgccaatgccacggcctaagcatctgggacagacactgaggaatgtttgatgagcccttaactaccaaaggtggacaactctgctattgatattaatatttagcacccaaaaggagcatcctggtgctgaaagagggcattagggagcttccccagggagccccaaacagcgtctctgcagatctgagcgctccctgttccggctgcaggaggctgtgttcagcctgctgggtgctggccctgcagctggggagcggccctctccaccacagtggtcttcagactggggtcagtgtacatgcaaagaccatctatggggcacatggcataagtatttttaaagtaattacttatcatttccagctcgtcagctctttcccaaaagtgatctgtctaggaacttctctggccaatccctttcccagacccctttacaatctcctgcccccttctccacagacaggtgcatcttggacctcgcacccatcccaaacccctctccagggtgtgttcctggtggtggcgccctccctagagcacagcaccagagagagcgcccctgtgaatatcagcagccaattgtacccagtgactaaggaaaccagccttcagcaaatgcggcagtttcctattctttgctttccacaaaattgaaagagagcccctattcaagttgtcagctgagagagctttaaaaacaatcttgtataacaagcacaacgtgctttttggcatacaacttgaaaggagctcaaaaaccagtgacatagcaaatctttttccatttccatctttcattcccatttatgtgaacaagtttgctttagctcataaaaatgaaactagagaaaatctcagtgccgagcctgttttaggagcaccccaagggtctgtgaacccgggcaggggcccatccccagcatcgctgatattgaatttctgagattttaattttataagagtcaattttttaaaaactatttaaattttaatcaattgtatactactaataattataaggataattcaaagaaacaacatttagagtctgtggttacagaaaattacatttaaaaaatacattcaatttatatacagattttttactgtaagaatgtaaaggtgatgaataaagacttttaagccaaaaagtatacctatcacactggcataatatcctaaaggagtagttagaatggaaatttgagcttatagagaaaaaggagtcacaaaaaaaattgcatgctcagaaggaaagcattttcatgttttttttttttttaaaaggatgagagtggtgtgaaatcactacggtaattggattccagcggaaacacttaagagttgtgcgagagttttattttggaatatcaatgttttgaaaggccagaagatatacctttttcaactaataaaccttacttttagctgagtatttttttttattttaatagttttgggggaacaggcggtgtttggttccatggataagttcttcagtggtgatttctgcgatctgggtgcccctgtctccggagtagtgtacacagcagctgatgtgtagtccttcatccctcaccctctcccacccttctgccaagtccccagtaacaggtcatggctgcgatctctcaggagatgcgctaagcacaggccccaggcctgcctggtggggatttgctcagaagcttttcgtggagaccgtgggttccttttaaacaccaggtattttttttgtttctggcagtctccagcctaatacactcatttgaatcctggaaaatagatcactctgtttcaattaggccaactcctcaggagttctagaaaaatattttaagccagtgactcattgaagtcccagatgacagtaccctctggggcaattaggccaacgtaccaggaggccggcaaagaggcttccagtggctctgacacgttgccactgtgtctgccctcagcccctagagcacggggaggacatgggggagcagcccagctcccggacagttctgcggcacagtctagggctctgcattctggcctcctgccacatccagggcgctgaatgccatggtgtgtgtccttccacagcgcatacactggaacacaaacgtcagcatgacagcattaagaagtgactaagtcatgagggccccatccttatgaatgggactagtggaccttacaaaaggcccttccacctcctgtcatgtgaggacacagcacttagcccctctggaggacgcagcaacagggttctgtcttggaagcagaaatgggtcctcaccagacaccgaacctacagtgcctcgatcttggacttccggcctccagaactgtgagaaagaaatttctgttatttgtaagtcacctggtctagggtattttgttacagcaacctgaacaaagacagttggccttcctttacctgagatcattttaaacaccattatcctcaactcaatcgtttccttaactcaaggaagatacctgatttcatggcaggcactggaaatatatgcctttggttttccctgtaattgcaaagaaaatttatatgtaaaataactgaaacaggactcctcatttcagcatttaaagcaaaaatctttaaagttaataaaacttctactctacaataagaattgtataaatgccaaagttttggatgtaacagaaatgagagtgatactgagaaattctctaggcggtcatggaaataagaagacaaagaaaaaaatttaaaccatggtatgtgcacttttgtaaatggttttgctgcaagtgcagtgaggagttttgtggtgatttaattgtgtctacttttataaaaatttaaagcattcaaaagaatctgatatgctaaactcgtgaaaagtttaattgataaagcttgcaatcaaaacataaaacataaagatagtatccagggagaaaagaaacacagctaagtaaaagcggaggaggtggggagaggaaaagaatctaaaggaaagggaggtttattttattttattttattttatttattttgagatgaggactcgatctggtacccaggctggaatggagcagtgcaatcatagctcactgcagcctccaactcataggctaaagtgatcatcctgcttcagcttcccaaatagctgggactacaggtgcatgccaccatgcccagctaattaaaaaaataatgtttcgtgaagataaagccttgctgtgttgcccaggctggtctccaactcctggccccaaatgttcctcctgcctcagcctcccaaagtgcagggattacaggcataagccaccacacacctggcttgatgtttaatgagtctaattttattcattttgctatattcaagttttaaaagttaaaaatattttacctttatttaaaatgttctgcataaatatattcatgcacataattttcaaacaatgagtatatttgactgcaaaacttcatattttgagaaatcaaatgagttaaatttgtaagttctttgccttttagttgtgtgaatggtttataattgactagagaaaaacaattgagaaggaaagtctttaacagtgtttaagataatgtaaattcaaaaatctgagaggaaaattaaaaaaaaaaaatttttaaatccctccctaggccgggcgtggtggctcacacctgtaatcccagcactttgggaggctgaggcaggcggatcatgaggtcaggagatcgagaccatcctggctaacacggtgaaaccccatctctactaaaaatacacacacacacacaaacaaattagccaggcgtggtggtgggcgcctgtagtcccagctactcaggaggctgaggcaggagaatggcatgaacctgggaggtggagattgcagtgagctgacatcacgccactgcactccagcctgggcaacagagtgagactccgtctcaaaataaaaaaaaaaaaaatcaatccctccctagacattaggaaagagtaaagaaggaaattacttttagttcatcgtagtggccctttatttttacttattcattcaaggaaaaaaactctagaaaaatagactacacaaaacataagatttaaaaataagaccagatctcggattttggaaggtcttatgtgctcagaatgagttaaaattcagacaaaaagagatagaagctctcacataacagtgaggctgcctttgctgcacgaccgtctgccagacactaacgggaatgttttctgggctgactcatttggtctttagaggggaagactctctgaagagcatccctctgaggggactgtgatgggctcccccagtttgcagctggagaaactgagacatgaaaaccagttgatctgtccaggtgcactcaggtggccatgactcagccaattcctcggacgaaactacatcagaataaagtttagccagtggttgaacgcttgtcactcattaagaaatagagaaaattagacaagccatcttactaataaagacaaaagaatttacttgaatgtaaccataatgttaaattaaatgtttaaatgataatcttcatgaacaagtgataaaccatagattatatataatgtatgtatatgtgtgtgtgtgtatatatatatatatatataaaatgattaaatgagaccaattagactaatttttaaagtttacattgtattcttttaaccaataatccttaaatgttgggtactaaatctatttattttgaagcaagttggccctgaaactttgtgcaaactaattggaatctaagaaaaaaggacattccaaaacagagacttagaaattattctgcactttgaccaaatacccttcaaatagaaaatcaaaagtatttgacaattaaaacttccactggtaaagtgtgcaagaagcgatctttttagaagtttgctctttgttacctgaacaggtttgtaattgcatcaaatgtatgcaaaaattgacgactgtaagtttcattgttacccatagttcctaaacctttcaccaaaacaggttgctgagctgatacgctaataactatttcagaagtagttttgttttggtaaacaaaagcccagcacaggctggaatacagttgttggccctcatgcccggctcacaaggtaaagtcagcaacccacatgttatgaggcccaaaccaagagttaatctaaaagctttagagccccggaaatcccgtgtcaggagtctaaacggcaggcagcgagagttaaactactggcctctgccaggactggccaggatgccaaatgcttagctgactaattcggatttcagcaaaaccatattccacacgtgagactctcagtggatctgtcaagcaggaaaccccacagagactgattttgtgcctgtgttattcacacagtcgccatggagcgaaagactgggaagcacgagatgttttaatttacatacaatttagaaaattgcctcttagatattccatagctatgtttctaagccatttttttcattctaaaatggaaatccccttggggataagcaaaactggctgaaaattgcttttaaaatgttagaaaatgtaatgttgttatgaaatgcaactgaaatgtgctaatgtctttttcagtctgttctagtgtaaccctaataatattgcaaaaatacgagcctgtaaaacattcttcacctgaaatttctgtgaggtttctgaagtctgatgattctggttattgatttgattgtatttgctaatttccttaattcataattctataattttaaaagtcaagcaatacagtgtgagataataattataactggaataatatatgtaaattagtaaaaaaaaaatacttaactagtaaagccagagttaacattaaagctttctgtcacagataaataacagcccacaggcccataaaaataaagttcaatgagaggtgtaggcattatatagagcattatatatttatctgtatatgttaggtatcatatatttatgtgttttatatctcctattgttttgtccattaattttttaatacaatcaaagatattaaatactcagtggattcacattctctggtatctcactgcggggaaattaaaatttattctctttttgaacaaacgatctgtgcaactagactaacaagacatatgatctggattgacaaaatttttaaaaagcattccaaattaaagctttctgttatagataaataacagcccacaaacccataaaaataaagttcaatgagaggtctaggcattacatagagtattatatatttatctatatacgttaggtatcatatatttatgtgttttatatctcttattgttttgtccattaataattttttaatacaatcaaatatattaaatactcagtgcattcacattctctggcatctcactgtggggaaattaaaatttattctctttttgaacacaaatgatctgtgtaaatagactaacaagacatatgatctggattgacaaaatcttttaaaagcattccaaaatacttagatttgaattaaagaaaaaggaattaatagaggcatctcaaaagaaaatatactgacagattaagtagtcaaggcagcaggattacactttttctctctttcctcttgagacattattattaaaaagaaatacaggaaagcttctggaaatgaaagagcaaatgcatatgaatccatctctacttagacaacaattgcaatagagtaattattttggaactctggggtctattgaaggcttgcatctcacaggggatgtctcgaatgataaattatggttacatttggtcaattttacctcttggcgtagtaacagttgcctgctctccacccccagccctctatcaggcagctgggcagttgttcctttcgcaacctgcaggtagcttaatgggcaaagagaataccgtcctccaatgacaagggatctgtgctctgatcacagagttgcagacagagaggcttgctatcattgttgtcgcacctcccctcattgttgcaaggccctgtccttcctgctgaagtgacttccaggagatttaaagaatcggcacattttttccactttatttttcttaccccctcccccaacttgggggccagatgttgaagaccagcatattaagaagcaactgcatatgcagggaaaattacacagcaaccatgcatgcccagggaaaggcacagactcagaaaacacctgcaaatacctaaagtctacatctcagtctgatccttgacacagagacagcctacaacaattttttaaatgttagcaaatcctgaggaaggagaatctgaccttcagagctaccacattattagattccaatgtccagtttcaacaaaaaatcataagacataccaaaaaacaggaaaataaggctcattcaaaggaaaaaaataaaccaaaaactgtccctgaaaaagacctgatggtagatctactagacagactttaaaacaacagtcttaaagatgcttgaagaactaaaggaagacatggaagagcttctgtgtgaacaaaatgaaaatattaataaagagatagaaaatccaaaagaagccaaaaataaaacctggacctgaaaagtacaatacgttaaattttaaaaatcactaaaggggttcaaaggcagatttaagcaggcagaaaaaagaatccacatatttaaggatcggaaaatggaaattagtcattctgaggaacagaaagaaaaaggattgaagaaaaattgaacagagtctaaggtacctgtggaacacccttaagtgaatcaacatatgcattataggagtcacagaatggggaaagagagaaagggatagagagagaatatttaaagaaataatggctgaaaatttccaaaatttgacttaaaagacatgaatattagcatccaagaaattcaacaaactacaagtatgatgaactcagagactcacactaagacacattataatcaaactgttgaacaacaaaggcaaagagaattttgaaagcagcaaaagagaagtgactcatcacatacagagggatcctcaaaaaatattagcagatttctcatcaaaaactttggtggccagaaggcagcgagttaatatattcaaagtgctaaaaaattaaattaaaaacccatcaaccaagaattctatattcagcaaaactgtactttaaaactgaagaagaaattaagacattcccagataaacaaatgcagggggagtttgttatcatgagacctgaccttcaagaaatgttaaagggagtcctgaagattgaaatgaaagaacactagacaataactaaaagcaacatcaaggaataaagatctcagtgatggtaattatatgacaattataaaaattagcataattccaacaatgacatgtaactccactgtttgttttctacaagagattactgcattaaaaaaaaaattagtttatgtttttggacacaaaatacataaagatgtgattttgtgagttcaacaactgaaagaggtggtaaaggggctgctgaagaagcaaaattgttgtatgctattaatgtcatgatggtacaaattcaaatcacaatgttacaattttataatgttaaatttagtctctgtgttaaccacaaagaaaattgctaaataatatacacatataaatttaaatgttttactataaaaatcaactaaacacaaaagaaaacagcaatgcagaaaatgagagacaaaacgctataatatagaaaacaaatagcaaaatgacagaagtaagtccctccataccaataatcactttaaatgtaaatggattaaactctccaatcaaaaggcaaatattgggagaatggataaaaaagacatttagacatgtggctaaatttaatcatccatcctcagttctcatctttcctgacactcgtgatcatttcctccgttttgaatcctcttcttacctagcctttggtatcaatccctcagaaaatcctgttgactctgccttccaaatatacccacacatgtgttcttttttccacttccctagtgacctacctctggtccaagcagccaccacctctggcgtggagggttgcaggtctccccgcttctgccctgctccctctccatctcttcctaacgcacagccagggcaatccagtgagggcagaggacggctcccactcagaccccaggggctctccatcttagtctgagtagcagccccattcctacagaggccaggaggtgctacaccacctggcctggtgacctctgcggcctctcccctgctgttctcccccaacttgctctgcaggtcacgctggcctcccacagtctcccaccgtctgcacacagcccagtgtgctcccgtctctgcctggagtgtcctgagctcaggtggctgcagggctcacttcctgggcttcctcagtcttcattcgtaaggccttccctcaacacctgtttaaaatgacagctgctccacccccagcttcccagtcccccttatcctgccgcactgatttctgccatggcactcatctccttctaaggttccatataatttaactaatgaggcagccctgggagtgcagagctcccaccgctgcaggggagcacgatggacccatggctccactgatgcacctcgggatgcatgaggcagccctgggagtgcagagctcccacccctgcagggcagcacgatggacccatggctccactgatgcacctcgggatgcaacaccatgttcacaacaaggccaagctccccgtggtgctccctggaccgggctgggacaggtccatcacagggacacacaccactcctcagggagcaacttttcacccaggacgccctgttggcctggacagacctttcttgaagctgagactctcctacccctaccttttcttgccttttctccttctcacagatgttggacctgcagcgtggtctgaagtctctctttactccctctccaagaaatctccagcatgtccaactctacctggtttctactcctcagtgagtgtgagctgtacaattgattattattactgttattgctttgttcatggtctgtctcaccccactagagcatgaacccgccagggcagagggctttggttttttcctgtgctttcctggtgcctggagcagggcctggctcatagcagagatgcagtaaatctgtgctgaataaatgtcttacgtattgaatcagatgatgcattttaaaagcatgccacctagtcttgcacaaaagaaccacgtgttcagtattgaccatatttacactaaaaaaaagtcagtttccattaaagaaagttaaagtatttaagtaaataaaaacatagactgtgttcttggggtaggagcacactttagcagtatcaagtatagtcatataaaatgtaaatgtcagtatccccaaattgtctacaaattaaatgcaattccaatcaaaattctagctggatgttgagacattcataaattcatgctaaaatttgcttggatgaataaaggtccagaagtagcctaattaactgtgaaaaaacagggtacagaggcgagacttgacctagtaaatatagactgcaagacactaatagtgatggtaatagtaatctttacaagtatggtactggtgcaaaaacagacaatagatcaattagccagagtagaaagctcagagagagaccacatatacacagaagctcagcatcacaagtcaatgggggaaaggatgaattttatatcggtggtttcaggaaaactggattactacatgaagaagatgagggcacattctttgtagcactatgtgtagcaggggagtcctggaaggctaaaggcctgcaagtagaaatttaaactctaaagctcagagaagataatggaggagtatacttctgtgacttgagaatagagaaagatgtttaaacgaaaatatctccctacaaaataatggatttgacaatatcaaaatctaggggttttattcactgaaaaacaaaatggacaaagttaacacatggcagataggttgggaggtgatatttacaattttgaaaaccatcaagggactgatattaagaaaaacagggaaagtctgtgaatccaaagaaaagacagaaagaaatcaaacagaaaagttgcatagggtgtggacaggtgagtctcagaagagaaaacccaatggctaacatgtatgtaaagagatggttaaagtcatgtcagataaatgcaaattagaacatcagtgagacaccacttcacacaagtgtcagactgacaaattaggatgctgggtggtaccagggactaaggcaggcacaggagcacaggattccatgagctgcaggtgggtgcaggtggcacagccatggtggaaggcatcctggcgatgtttattcagattaagaacaggcagccaatgactcagaacttcattcctgagaacgtgttcaacgcaggcccatggatgcatgtgaggacgctcatgcagccttactcgtggccatgtgatgctgggggaatgaacaggcatgatgtattagtctgttctcacactgctatgaagaaatacctgagactgggtaatttataaaggaaagaagcttaagtgactcacagttacgcataactggagaggactcaggaaacttacaatcatggcagaagacaaaggagaagcaggcacctgaagacaaggtggcaggatggagcgagtgcacgcaggggagatgccagatgcttctgaaaaccatcggatctcgtgataactcactcactgtcacagcatgagggaaagcactcctgtgatccaatcacctccacctagtcccgccctcaacatgtggggattatggggattacaattcaagatgagattttgggtggggacacaaccagaccatatcagatgatgtgtgggtgcgtggaatgctctggaatgtgtcacagcccctggctataagcaacagactcgggagtgcaaagtaacatggaaagatctgagcccacgaggatatttgcctctttgtgacgggaaagtgagggcaaaaaggaggcaaacagatacatagagagatgcattaaagacgagatgtgccttgaactgagattgtgactaactcaatcctatgcacttgaggctaaaaaaaaagtatcttaaatagctgagaatcaccggtaatcaatggcatcacctcctatgatcaggctttgtaagttgcctttgtgggtcgaggctgtcttcttgtccaccccacgcaggcctgttaccggggttaacccgagtctaggtccggataaaagcctatatatggaaaacttcatgggatctccttggaatccattcttagcaactcacaaggtcacaaagtaccatggatgagaagtttggacacatgtcaatttcctgcctaagcccaggctcagggaataagctgcctctttctgatcctcaaaacataacaaggaccaaatgcagtgtaccaacacagagcaccaagtgtctccacacaagatcacaaccacatgagacagtgacaacttcatacaactccaggagggtccatcttccctcgagaagccaggactggacagagaaagtacccggaggcccgcacagctggcaaatagttgatgtattttcagacagcacagtttcttaaggaccaagaatacgatgacatcacactaagaagagaaaataaaatcttgaaaaatgacttaaagtataggtcaaatatacatgccatgcgggtgctccaagagatggacaaattgatcttattgatcatatttttatacctttaattacatttgcttatctcagcacccactcgctctagagcccctcaggtgccctcagccaagtgggactggactgaccgccaacagccctggttccctgttggcctcagacagagcttgcccagaatgttattttcttggctgtgttttcaaattgttgtcatgtttatcctaaggtcataattttattctgcctcataattttccacctgaaggggctgcccaaaacctaactacatgcctgggcaacatagcaagactccatctctacaaaaaactataaatatgagccaggtgtggttgtgtgcctgtagtcctagctgctccagaggctgaggtgggaggatcacttgagcccaggagttcaaggccacagtgaactataatcatgctactgcactccagcctgggccacagggcaagacctagcctcagaaaaaacaaaataaaaataaaagtgttttatatgtacaaaaattcttcttaatcttttgatccaaggaaagcatcccctaaccttttaaaataagttcaaaacagtatttttgcaaatctgagtgcagtccgatttctactagagttccaaagtcttggtgaaccacccattcttcttaatcaagttatcatatacataattactagaataacagctctcaaaaattaaaattcacttaacaagaaaattatattgaacacaatacattctttctccagtgactccagagccatccgaggatatttcagtgcctcgtcaagatgttaattacgaagctgaacaatagttgctgagtgcactgtagattttaaatgagtccggggaacttcttgtgaaacctggctgtcatcatctcatcctggaaaacgagtggatgaaagcaagcgggtcggttgtggtggctcaagcctgtaatcccagaactttgggaggccaagacgggaggatcaacctgaggtcaggagttcgagaccagcctggccaacatggtgaaaccctgtctctactaaaaataaaaaaattagccgggaatggtggtgggcacctgtaataccagctactcaggaggctgaggcagaagaattgcttgaacttgggagacagaggctgcagtgagccaagatcgtgctgctgcaccctggcctgggcgacagagtgagactccatctcaaaaaaaagaaataaagcgtctgggctcccagatgttggcagctccctcccagccctgccctcctcccacagcccccttgcctctctctcaactctcagcttaaatgtcacctcccaagagaggccttcccaggggctgagtgtggggagatgtcccttttaggctttctctcaaagccctgcagggccctgtacttatttagtgcaatggaaatcctccacatggggtctgtgttgggcgcgtggcctcccatacccgtggccacgtggcctcaagctcccgctctcgtgtggaacctgaccctcttccctgcaacttcacatctcactccaggaataattttatgccaaaaacttaaaatatttttaagaacctacttatttgcatgttttctagtgacctcatgagaagatcaatttagcagcttctcacatttttcatctttgagattcacagccacatcactgagaaatatgttaaggaatatttaacaggttataaactacagcaatcccactcaagactaaatagcaccaagacagttttctatagaaatcgggaaactctccagctctcactgaaaataatgctaagacaattcagagtcaaaaaggcctcatggggttttttctccagataactcaattaacccaaactaaatcctgagacactcacgcacctccatgtctcttgattttgtttgtggcttgaggggttgagaggcactgcttctcaccgtgacccagaccaccgctccctggagaacggatccagactttccccacatcttttatagtacctccatatcacacatgggggaggtaggtccacaggcctgcatttaacaagcggaagccagcacacgtgcaggtgtggagcagaaggtcccacagcagcagccagggctccgattccctggaagagccgcccactgcttctgaccaaacctcacattgttgcttccatgtggagctccctggaagcagccaaacctataaaggattggttacaactgtagatttgattatgtctaactttaatgagattaaaaggaattcattctacattttatgatttgttttccgagttcattggtaatacattgcattagtttccaagggctgccctaaccaaatacacaaactgggtggcttaagacaacagaagtggattgtcttgcattctggatgctagaaccctaaaatcaatgtgtctgcagggctgtgctccctctgaaacctgcaggagaaccctttcttgtcctttccagcatctggtgttgctgggaatccccagggacccttggtgtatagatgcgtcactccagtctctgtgtccaccgtcacgaggctttctccctgtgagtccgtatctgtgtctcttctaaggatgccagtcatgtcattgagttttcatgactgaaaactcttggaacattattcttttttcaaaaggaaataggtcaaaattgtaactggatataaaatacataatggggtgatgatattggagatagactagatttttgctctacctttcttcagcacatttatgtttgatatttaagtagaactgtcttgcacttcaatgtttaatgatggccggtgtctggtattctatctggcacatggcaaacactaaataaatacttatcaattgttgattattattgatcaaccccatattgttggtacgcatacattttgcaattataaacatgaaatatacataatgtttttcaaagatacgtatggttttatgcctaaatttttattgcattaggatgatctcattaggataccacatggatgatagtatgtttcaaaaaaattgtctgttaaaacaaattataattaaaaccattttctaagtgttggctatattaaccagtaaataacaaagacaaaatattttaaaaatctaatttaaaaatcatatgagttctttggttttaaggcatagtaaagcaatgattcacatctttcctttaaattggtcattcttattcactgaagttaaaggaaaacatcttggtaatatgtgcaaatactttcttacgaattatttaaagcaagagttcccaacccctgggccataaaccagtaccagcccgtggcctgttaggaaccgggccacacagcaggaggtgagtggccagtgagcaaagcttcatctgtatttacagcccctctcaatcgctcacattactgcctgggctccgccacctgtcaggtcagtggcagcattagatttcatctgtatttacagcccctctcaatcgctcacattactgcctgagcttcgccacctgtcaggtcagtggcagcattagattctcataggaacatgaaccctgttgtgaattgtgtataggagggttctaggttgcccactccttatgagaattaaatgcctggtgatctgtcactgtctcccatcacccccagatgggaccgtctagttgcaggaaaacaagctcagggctcacattgattctacgtgatgatgagttgtatcattatttcattatattttacagtgtaataataatggaaataaagtgcatataaatgtaatgcacttgaatcatcctgaaaccacccctcttccaccacacctggtcagtggaaaaactgtcatccacaaaatttgtccctggtgccaaaaaggttggggaccactgctttcaaggtagcaaagttttaccctagcacttgaaaaatggtattctgtggtacaacaaagaaaacgagagatactctaagggaagttctgtgtcttctaaatgaccgattaaagaaactaatgaaaagtcactttttgtggccatgaaacatgaatttaagaactattctgaagttggcatccacatagtctagaaaatttttcatctctttcatttcccacattctttacaaagttgtataacagcaaggccttcgagggtcactgaggcacagggcactactagacctctgatccctgtgcggatgctgcctgccacatgcttcactggatgtgaggtgaggaaagaatgaatatttttttcatcaaactgctgagctttttagcccactgtgatttatagtcactaaaataaaacaattcctttatcattcaaatactactgacatctaaattcagactaatacactctaccaaaatcatatcatctggcctgtaacttaagacctacagacatcagttaatttaggaaataatctgatgtgcaaaggaaaaattccatggagagatgacatcctcctctcttctccccagtatgcagggccattcagctaatggggtaagcatttcaggaaataatgtggccctgatatatgtcagtggcaatggaattaaagaggaagagacaataaaaggaaaaatttcaaaagaattgccggttgaagatggatagaatgaacacaaaagttttgagccctggagaggagagtttcagtaccgcggacagaggtttttgccgttgcctacttttccttaggcctccatctatgataattcattctacaaaaataaaaggagtgaattgaaactaaagtgtagctcataaagagtagtagctgtgctacttatttctacagagcatcaaacctaatgctgttgatgttgatacctcttctgaagatgacaaaaataagtaagtccaaaaaatacaccctagtttttaaaacatgaatgtggctgacagatgattaaaacactttcatcaagattctaaaaagcaggtaagattaggttttgcttttacagcattatataagcaaaatcctgcttcgttctccacaacagtgccttcctaaccatgtacatcatatgccaaggtcttcaaagggcccatgctttcttagcatgcccagcatatttaattaaagaattattgaactatggtcaggtgtggcggcttacacctgtaatcctagcactttgggaggccaaggagggtggatcacctgatgtcaggaattcaagaccagcctggtcaacatggtgaaaccccgtctctactaaaaatacaaaaaaaaaaaaaaatagctgggtgtggtggcacacacctgtgatcccagctacttgggaggctgaggcaaaagaatcacttgaacccaggaggtggaggttgtggtgagccgagatcacgccactgcactccagcctgggtgacagagcaagactccatctcaaaaaaaaaaaaaaaagaattattgaatgaaactgaattggaagatgttagtaacgccttccccaattaatggatctttgaaaaaacatataagtagatacagaatgactcagttgttacaggacattttaaacagtgcttcttatatgtgttactccacaggaagtattcaaaaattagagtcaaactcactctcaggaggttgttgtcaactggtcaggttggaaacaagcaaatgtttacatttcctacacactcatatgcttccctcctaagacaggggaattgttcaaaagaacaacaggtagtgctccacagagcaccactgactgctccacagagcaccaacccaaatgcttgggttgaaacatggaaaaaatcaccaaggcctctcactccgagtccacgccccaaacacaaacacacatttctggaggctttctcagatgatgctgtggtcacctcaaaccatgattcaaataaggcagattttgagtttgtgcataaatgagattaaatgtgtgtgcctttcagagtaaatggtgaaaaggaatagagaaaatatatatttctttgtaatgttctctaatacaagtcagaaatcagacctgaaggccaaaaagtgacattatttcttcccctgctgctccccccttagcaccatgattaaagctctaaatttgaaaatgttaccaggggacagtgatattccccagcctcaaaactcaagactcatcatggtggcttagtctggcaattatgtgtattatgcatagatcaccactgtaaggttagatggggaacacagatccatataactcaacaaagaaacacacacacgcatgtaaacacacacacacacacaccctaaaccataaaacagtagagcagaaacacacagagatatctccatgtaaattttaaaacctgtctgctagatactatgactcctttaatatctgctgagattctacatgcaagtcaccttttcctccagtgttttattttaaacaggtaaaaatccacagaaaggttgaaagaatcgcacaaggagcacccacatgatcttcactctggttccccagttgttacaattgtgcattattttttatctttctgtatgcaattcaataccacctttttggccaaaccatcttttttctttttttcttttttttttttgtttgagatggagtctcgctctgtcacccaggctggagtgcagtggtgcgatcttggctcactgcaacctctgcctcccgggttcaagtgattcttccgtttcagcctcccgagtagctgggattacaggcacacaccaccacacccagctagttttttgtattttagtagagatgggttttcaccatgttgcccaagctggtcttgaactcctgagctcaggcaatccacccacctcggcctcccaaagtgataacattataggtgtgagccactgcgcccggcccggccaaaccttttgaaagtaacttgcagatatattgacatttcatctatcactatttcagtgtgtttctctttagaaatgggatattctccatgacaataatattgttgtgctcaaaaatattaaaattaatataatgatattattaaatgtacagtttatattgaaattatctccaaaaatgtctttgtagtttttttaaaatccaggatcaaatcatagattgatcacgctgcatttcgttgtgatgtctctgtagtccctgatgtaggacttccttcctcccttttatctctgaagagtccaggctaattgcattgtaaattttccacaacctgaattttttctgtctcctcatgttagaatcagattaaagccttttgacaagaaagctgcatcgctgttgccaagcagtcttctttgcagcacgttagctggcaggtccatccctcatgaagctgtgtttcatcaactgattaaggtggtgtctgccagacctttccattgcaaaggtccctttctatttctcaggaataagtgatttgggatgtgatgctttcgggctgcacagtcaccccttccccagttttgtcgtccattcagagaccgttgcctgtgcttgttattaaagtggaggttgaaaacagtgattttataattccgtcgtgcctttgtcacaataaatccatcaattattttttagtcgagatgttataatccaatgccatcattattcttccgagtatgccgtttttaaaaatttggtcataggagcctctttgaaccaacgactgtgtcctctctacgtgttcccgctgataactggacatgcccttatttcctggaccaacaaaataccccaggctcatcttgtatgtcgcctgctccagacctggagccagctactgctccaaggatgctccctggctcccttcatcggggagtgtggcttacacaccaagctcaggatgcatgttttcttatgactatgggggtgtcagcctttgaaaccctttcagtggacagagctgggaatttctggggtttagcacatggacacgccactcagaagcccacaacatcatttgaaggtgccttctgaggagtcttcatgccaaccttagctttcgcaccccattgctactcattcttcttccctataagaggggtttctgttctcttccgaggaattccatctatgtgttggttttttgtttgtttattttgttttgtttttacaaggtaagcaaatatataaatatttatttttacttgccctcacttcttacatgaaaggtagcattacacataaatatatccacatgtatacagttgtacctcagggtctgttggggattggttccaagacatgtccctctgcaaccccatatacccatatctgcaactactcaagtcccaagccccacagtcgctcctgtaggacctgtgaatgcagaaagtcagccctataggtgggttttgcatcccgcaagtaccgtgttttccatctgcattgataagtggactcacacagttcaaatgtatgctgtttaaggtcaactgtgtgtagatagggcacagtatgagtatactatacttcatttatagtcttttggtaaaaatctttaaagtaaatcctggaaattacctgaatttcatggagattgtgctcattctttctagggctctgcagtgccccatgcatagatatcctgtagtttattcaactggtctcctatgggtagcacttaggttgttttcaataactggctgtatgaataatgctgcaaggaataatcttgtatttactgtatttatgaaggtaggtcttcagggtaaattactagaaaggggagctctgggttaaagggtaaatgcatctataattttcctataaggccaattttcctcctcaagagtttttccacttttctaccccaagggcactatatgagagtgtgtgttttgtcaacaaagcctggaatcaagctttggaactcctgcaaatctgaggtgaagggaagtagctggagcagttttcagtgcatttttctgtccatgactgtttaaggtgcttgccatgggctatctgtatgtatctttgtccttttatccaggggacatgtacatatagttggacaaagccccttcttcaacttttcccttaagctctgagcccactactagatgtcttcatatgctgttacctgtgcaggtaaaactgccccacccaccgaccagcctcccatgtctgtccaactcctaaccatccacagaaccccacttgaatgcccttttctcattaaaggtttccagatttccttcctctatctcaatctcagattaagtgcctctcacctgggtctcaaattatctgattcaatcttggttaaaattatgtttagatgagtgggctgtctcactgggatttaatgagaagccttgtgtgaaggtagttgtcttgggaatataaaggctttggtgggtggaaaaaatagaagaataggttagaaaacatttacattcctgataccatgcaatttaaagcaaatgttctattctgttaccacaaagttgagttactgtgcagatctttccactgtaaagaacaaagagctttcttataatattgaaaggtttattcccataattccaataaaagctgacttgtaattttgatttatatatatatgaatataacacacatttttccatacttattatagagaattgtgctcattacattttaaactgcatttgttataagacagtaaattgcctccttaacaaaaagtaattaacccacttataatgacctcaattattttgttcaattataattaaccaattactacgttcacacacacactagtttaggaacattatgtaaaagcactcctccttgcctaagttcgctgcaagtaaaaattaacaagtatctctcacagatgaatttttaaacatagcacaaaatagcattttatcacagggagccaagggcagggacaagcaggtgtcttggaatgatgggtccagggctatagggatttggatattgaattaggttaccatattttgtatcacacgctaggcacagagtgagcacataggaattataagtattaattaggataaaattgtataaatgtaaaacacatctagcaaatttgaagtgttatttcgaattgcttagtggctttatttttaaaatatagaggtgatcgggtaacaccgagacaaggatttctctttctttccagcaggcgcaccccaggagtgacaaatcagccttcaattccctctggggaggggcctggttgtcctctttgggtggcttagcagctcaggccctgtgggtgcgcttcacatgcgtggggctgtaggatggaggggtggagaggcaggcaggcagaaacacaggaggcctcactatgtcttcttccagaaatcccggcttctcctgtaaacgctgcagtcagtctccatccttagcctggcacgggtctgccctgtccatgtgcatcctccgtgtgggtgcggtgggccatccctcctcccaccgtaaccacctacgctcccctgggtttcctccccctcacttattccctttcactattgctgtgccccagatttccactcggagccctcatcccttcataatctgtagcctcttccaagacaaacttcccttcactttaaaaaccatgtttgctgaggatgcccagtagtaaggccctgacccttctgtgacctccctcctaaggccgcctacttgccctctccacctgtctattcacaggcatactgaagttaacgttgttgtgttggattccccactcagacacgctcttctctccttcttccccttctcagttaacggcacactcagatgttcaggttcaacactgggcaccatcctgaatccctctccctcagcctcccatcaaatgcgttggcaagtctgacagccccaagcccagcacgcacccagatcctggccctccacctctgtcaccatggacgctgctcgcgccaccaccatccctcctggagctggcctcctgctcctcccccctgccctgtcagtcttgtccttgcagaacagctgcagtggattttaaagaaaatctgactctagcaattccatgcttgacattggtaagggctttacgggctggatatgtccctgcaaacttcctgcattgaagtcccgactcccagcgcctcagaatgtgcctgtgtctgaagacaaggccttctaagaggtaaatcagctaagatgaggccacaaggggaaccctaagccaatctgactggtatcctcatgaaaagagattagggcacagggagacaccctggctttgcttgcgcagagagacaaccaggtgaggacgcagcaagagggtgccccggcaagccaaagagaggtggggtgggaacccaccctgtggacaccttgacttttgatttccagcctccggagctacaaggaagtaactttctgttgtgaaagctgccgagtctgtggtccctgtcagggcagccctagacacagacacaaacgatttccagctacactgagagtccatcccattccctgcctgccccaccacctcccaccaccccatccagctcatggattatttatgtgtctgtctccatccagcagaaaatcaggacaaagatgtggatttgtctgccctgttcaggcaaaggtctatcccctaaagcagtgcctcacacataggggctcagcacgtgttttccaatgaatgaatgaatgaatgaatgaatgcaatcccatgttgccagatctaaggactttccataaggagccatgtaagtggatttttagacagaatgttgtggttcctcagtcataactttttcttggtagaatgacaagtttcttttaaggaagtattccagttcatcaatgaagaagtgctagaatgagggtatcactctttgatcactcctagtgagttattggatcttggcaatcaccaaaactgaagaaaaagacaaccagacatccaaagggcagacgaccccacctgaatattggtgagactctagacccaactgacaaaagacaggagctacatgagacaggggaccatgttcaaggatgcaatgaagaagcaggcagaaagatccagaatgcccagaacactgcaggacagtggtccagtttctttaacaaggcaagaaatatgcaagatgtagaaggagaccacatattaaatgagacttaagaggtgtgtcaaccaaccacggtatatgagcctctcttagagcctgactcacacaaactattacagatcagataactggtgaaagtcaaagacctgacatttgatgatactaaaaaattattattaaattgttatgcactgtattggttttgcagtgtgtgtgtgtgtgtgtgtgtgtgtgtgtgtgtgtgtgtaaagggtgaccttatctttagagacacttcttgaaatacttgtagctgaaataatgtgataataaacttcttcaaaaatagtctggtggatgtgggcttaggggaagagatggagtttaaagtggaacaaaattttctgtgagtgatatttgttgcacagtgggagcaagaaagttcctagtgttattccctcaacttctgcaattgctcaaaattttccaaaataaaagcagaaactatgcagtacaatgaacacggacaggcatttcacaggagaggaatcggacatggccactaaaaatgtagagagaagtgaaccttatttgatcagcgaagttcaatttatccccattcaactggcaaaaagttaaaaggtcttacgataccacatgttagggaagacatagagcttctctgatacgtgggatagtatgctcacgttctgctgttgggagtataaactggcacaaccaatttggaaaaaagcttggcatgctctcctcaaaagtttatgctctccatgtgaattccattcaataattccatacaacgattctataattctatctctggttggttgtgtatgtgtgtgtgtgatgtgtatgtgcttgtttatatgtgtatacacatgtgaatatacatgcttgtgtgtatgcatgtgtatacatgtacacacatctctttgcacccacgagaaactcctgcacatgtacccgaggtgtcatgtataaggacgtcatagcaaatgaatgaatgaagggaggcagcgagggagggctgcccatggagcagagatagagatgtggtatggaccaaccagtactggacctggtgcaccagtgtacagagaagccgccgtgtggggcgactctccagatagcagcctgtccccctggtgcccggcactgcctcagcaggtggcacctgctggggttctcactctgcaagatgcctgggggacatacttcccaacttctctgtggcagttttcacttaaaaggaaacttgaatatttaatccgaccctaagtcaaatccttctgtgctagcatgagggcatgtgtgtgtgagtgtgtctatatgtgtgtgtctatgtgtgtctgtgtctgtgtgtgtgtgtctgcatgtctaatatgtgtgtgtctgtgtgtctatgtgggtgtctgtatgtctgtgtgtgtgtgtgtgtctatgtgtgtgtctgtgtgtctacatgtgtgtctgtgtctgtgtgtgtgtgtctgtgtgtatgtctgtgtctgtgtgtatgtctgtatgtctgtgtgtgtgtctgtgtgtctacgtgtgtgtctgtgtgtgtgtctgtgtgtctatgtgtgtctgtgtgtgtctgtgtgtgtgtgtatgcttgtgtgtgtatctatgtgtgtctgtgtgtgtatgtctgtatgtatgtctgtgtgtatgtgtgtctgaactttgtgaaaagaggcaatcacatcaggacagttgcaggccacagcgttctgtgcttcaccctgtccggggtgctaacttgaagccatgagcggagcaccccagggagctgccttcccgtccgtcttctgcctccacccacacagcagtgctgcagagcgctgttcttccacgagggaatagcagggcctctaaaaacccttttacaaatgtcgctttcatgatcaggaatccatttcaaagccagagcagagcgggctccccacaaatgggggctctgagttgaggggtgctggatgctgaggggagggggcaaaggggagtgatcccatgagtcccgagaataaaaggcagggctgatggtgccgtgactgctgggaatccagggtacccgtggctgtgaggggaaggcgactattctgaagagaataactttaacctctcattcccaggtaacgcctggagttgaggaagaactcgggcttaggggaagaaatggagtttaggtggaatacagcagagagggacccctgggcaggcctgcttcccctgacatgacccagatcctggcaaatcattatagtcccttcagggtgctacttagctacttaccctagactgggtagcttagctacttaccctagactgggtggcttttaaacaacagaaatgtagtggtcccaggtctggaggctggaagtccaaggtcaaggcaccagcagattcagtgttggatgagaacccacttcctagtacatagacagcaacttctccctgtgtccccggtggtggaagtggtgagggagctttctggggtctcctttataagggcactaatcccatgaatgaggctccaccctcatgaacccatcatctcccgaggccccacctcccaataccatcaccttgagggttaggatttcaacacgaattctgggagagacacaagcattcagaccacagcacagatgaaatgtccacagcaggaaggaacagattcctccactgggctgtcatctgagctcctgcctttcacgtcaacatttgtgagtagaaagtaaagaaaattggatcaaattaacctgaaagaatgaaccaaggcaagcacaacaatgagtcattagaaaacacttcgggcataaatagatgttctcttttggcaaatttcctaggttggtggatattttaagttttactaagaaaaacaaatgtaaatgttattaagcggctgggaaaaacaaagcatgtgatatatttttcacacatttttctttgtcctcccattaaactctatgttcatatgtagtttatattttacatctaaaacttgataggatgtttttcatttgttctgagaaagtggaaaagtagaaagatacgtttcccattgccacaccttagctgtttttaaaatgttctcttctctcacacacaatcaattgaaagagccctttcctttttcctaggacgtcctgagcactttgctcacactgtaggactcaaaaagtctgggccatgtcctgggatgacctaaatcagattcaagtcatccacagcgctgcttggtatgtgtgcaattcaagggagaatctcccacacacctccttgcagacaactctgagatttggctcttacaaaagattagttgggtaaatcactgttacaaaagattgccagaaagatgcgcttttctacggattataaaattgtcccctgaattaagctaggcttaccatagctagggtaccacgttgcctcacatcccataaaactgtcttcattgacctcgattttgccattatactctctgtttacatttatggaccctataagagggacatatatgaaattcagtactagatttagtatagggcttggtctactggattattgagggtactcttcatgggaagatacaggaataattaacctcagaccatagttctcagaaaggctatatttcttgtgttttaatgtgcagatgctatgaattatataactgattatgtttctcattttactgaagcctctagaaaggtcagggttgaattccaagcctacctttaacatagaagcagagagtagaattgtggttagtaagggtagggaggtgggggtatggggagaccttggtcaaagagcacaaagtgttagttatgtaggatgataagttgtaaaggttgttaaagttgtcagaataaaaatggagtcactaaagttaagaaaaccttgacaaatagagctggggaaggccaagaagaaaaggttctcaggcttgtacacctgataatgaaaaagactttacaaaaaccacaaccttgcacaaaggccatcacaaccttatacaaaaaaaaaaaaaaaaaaaaaaaaaaaaaaatgcttctggaaggacacctgccccgaaactgcctgtccaacctcggactgtaggaacaaaacgtgatgtgtatatatctacaatggaacaccgttcagccttgttattgatcttgtggccaagaataattattgcaaaacaattatgtaatcctcctcatttttttctttaaacacctctgtctttatctcctgaatatatacatagtttactatggcacatgtattcccattgcaatgctctactcgcaaataaacattttcttttagagagccactgtctgttattaaggttggcaacatctaacacacagcatggagaacacggttattaacattctgttgcgtactgaaaatttgctgagagtccatctcaagtgttcccaccaccaaaaacaaggtaactgtgtgaagagatgggaagtgaattagactgtctgttgtaatcagaatacgatgtgtatggacatcaaaacctcacactgcgtatcttaaatataacaatttcaacacaaaatgtgaaagcaaactgtaaggataggctggtgcactttgatctcttgttttatgctctgccttcattgttctgtacccttaatcgggtttttagtttcagtctattgtgtgagaagcattttaaattaataaggtgcctcaacttcctcttggaatgtagattgggtgtaaacatacatctgtaaatacacatatattctgttagaagagatggcaatcagctgcaggtacctgacagaatttgctacatcaaaccacagaaacatgctggaggaaaaagtaagtacaaacccatggatgagatctcatgatggagacaattacacctcagggtcagcatggggcatgggcatcccacctgttccctcccagcttcagcacagtgctgtggcctcagggagtcctctgatggccacaaagtgagcacagaatcagagcccagtggtcagaatggcccggaaggtgaacctgtcacctgcagagcctcttctgaaagacctgccctcctttccccttcctccccaactccacacccgccaccttcctgtggggacagaattcaggcaagactgccacgccagtccccagtgctaaatgacaaaccacgttgggctcatgccgtatctgccctttccttcacccttccttccagaattcttttgctcttaatatttctagggtagaagtagagcaagtactttatctatgggaataaatttatcacataaaaatctaacagagcttgagatataaatgtattcagtgtgccttaaaagtggtatcactgactcatcaaattgtcttgtgaaaactggatatcaagatgcaaaagaatacagttggacatactctatatcatacacaaaaattgactaaagatagatgaaagacctaaatgtaagacctacaactataacactcttagaagaaaagatgagaaaagctttatcacatcagatcgggtaatgatttcttggatatgacgtcaaaggcacaggcaacaacaacaaaaaatagataaatcagacgtcatcaaaatgtaaaacttttgtacatcaaaagacacaattaacaagatgaaacaacaacccacagaatgggagaaaatatttgcaaatcatatatcagataaggggttaatatctggaatgtataaaaacctcctacaacttaataacctcaataacaataaaaaaccaaataacccaattaaaaaatagcaaacgacttgaacaaacatttctccacagaagactacaggtgaccaataagcacacggagaaacgctcaacatcacgaatcatgagagaaatgcaaattaaagccacagtaaggcaccacttcactcccattggtatagctgctatcaacgaagcagaaaatagcaaatggcaaggatgtggagaaactgaaacctttgtggcactactggtggaaatgtaaaatagtatagctgctgtggaaaacaggacggtggttcctcaaaaacatttaaaaatgaattatcggccgggcgcggtggctcacgcctgtaatcccagcactttaggaggctgaggcgggtggatcaggaagtcaggagatggagaccatcctggctaacacagagaaaccccgtctctactaaatatacaaaaaattagccgggtatggtggcgggcgcccgtagtcccagctactccagaggctaaggaaggagaatggcgtgaacctggaggcggagcttgcagtgagccaagatcgcgccactgcactccagcctgggcaacagagcgagactctgtctcaaaaaaaaaaaaaaaaaaaaaaaaaaaaattattatatggtccatcaattcccctgctagattgaaaagcagagacttaaacaggtatttgtctacccatgttcacagcagcttgactcacagtactctgaagatggaagcaacccaatggtccatcagcagacgagtggaagaacaaaatgtgatgtgtatatacctacaatggaacaccgttcagccttaagaagaaaaggaatttgtctgggtgcagtggctcatgcctgtaatcccagaactttgggaggcagaagcaggtggatcacctgaggtccagagttcaagactagcctggctaacatggtgaaacctcatctctacttttagtatttttaatttttaatacaaaaactatctgggcgtagtggtgggcgcctgtaatcccagctactccagaggtcaagggaggagaatcgcttgaacctgggaggcggagattgcatgagccgagatcgcaccattgcactccagcctgggcaacaaaagcaaaactccatttcaaaaaaaaaaaaaaaagaaagaaagaaagaaagaaagaaaagaaaaggaattttcacacatgctacaacatggagcccataaccttgaggacattacgctaagtgaatataccagttgcaaaaagacaaatgctgtgtgattctgcttacatgaggtgcctagagtgtcaaaattatagagacagaaagtagaacagttgctgtctcattggggaagtggctgagggaagtggagaacagagagttggttagtttttaacaggcagagagtttcagtgttgcaaaatgagaagtattctggaggtggatggtggtgatggttgtacaatgatgtgaaagccctgaatacctctgacatacttagaaaccgttaagatggtacattttatatttttataatttctttttaaaaaaagctcatcgctgatacaaagtataaaacatctctcccaatacatgcacaagaaatgacacatgcagagttcatggacaatttcctacgaggcaagggaagtaaggcctgccctctaaatctgccttagcgtgtgagcccacagctttctgctgtgggttctgacatttctcatcacaccaagcgtcagtcctctcagacccagatctgaaagcgggggctgaaacctgtgttactgccttagctgtcatctccatggctgtgtgggatcccagagccacagccttccgtcctggcactgtgttgatttttaaggccttttctttgagatttgggacattattgtttcctctttcccagctcccccctatcaagctagagccctgaccattaggcactctggccagacccaggctctcccttgggctgggtcacacgctgtggttggggagtttcttctgcaacgaaggcctccctggacccctgactcaccacgcatgtggccaaccacacctctgagggcctggagcccagaccctccagtggcagggggtattgggtccatccacggagagaacccctgatggaagaggcgcctccctcctgggccatccacactgacaatgcagctgctccctgcccccacctcctcctccactctccgcaggtgttggtcctgcgcacctcactaaacttgctcagaggcaggttcctcagaggctgctccacgcatccaggaccggaggcctcaccagggatcccttctcagatccttaccctccctgccatctctcttctgctcaggtccacagtgggtccgtggccatgatgactatggagcttctctacttcaacttgaatttgcccttccttcaaccactctgtgtatttctacaccagcatgacaccttcccccctgcccctgccagacagaaagcttcagctgtaagggcagtgaggaccaagacactcttgccttgtccgcacctcttcacaggctccttcttcccacagaggaaggcttggcccccactgagagacgctcccttagggaacaggtgctgttctatttccatgccgcatttgccctcaccttccctgggcctgggctcggtagcaaaagaccacagagagaaattccaaaactgagaataaaaactataacaggaaatatttttaaacaaattgtattttaccacatctacatacatacacacaataacagaattacatactagatagatgatagatacatagatagatgatagatagatagatgatagatagtagacacatacataggtaatagatatatagatacatatatacatagatgatagacagatgatagatggatagatagatgatggatggatagatagacagatgatagataatagatggatggatagatagctacatagatacatacgtagataatagatacacagatatatggatgatagatacatatatacatacatgtatagatgatacatgatagatagatagatagatagatagatagatagatagatagatagatatagataatctacagtagtgagttggttgcatgttatgaccgaggaagaatataagatgcgtaccagatttctgatttggccttgaaagtgacctgggagtatttttaatgaagtaaacaggaagaaagtggctgatggtgttggaatttgcctggcctgggaggaagagctgagttaggataagaggagtgggatttggacacattggctgtgctgaggaagttgggggggaagctccaggctctcagcacatgtttggatttactcacagatgcacagatagcagaggctgagctggattttgaatccagtttgaatctacttctgacagaccccagagcccaggcttggaaccccaggcaatactgcccctggctacaccaagatattactctagagacaaaaatgcaatacacttttaagtataatagccaaaaatggaaattctgttggtgttttctctatggtaagtccgctcatgtcaagagaaactaactccatcttgaaaataaactttctgaatccctctcttaagaagcatgctgggaggtcgcagtgccccacagtttaaatgttaggaaatgcaggagatccagaaaattgacagatttattactaaatgtttacttttgatgttcaatgtcattaatttgatctaactggggaaattgtcagaattagcgaagatcatgaatcactgaagtatatttaaatgtcattttattacttccaagcactcataattaaagaaactaaatgttagaaaagaattgagccaagactttaatcacgataccttaaagagcaaattttaattataatgttcacattaaaatgtctcattgcaaatagatcttgccaatatgtttgaaagcagcttgctctcttatgtaaatgcagtttaatttgcttaattaagatgtttagcaactttttctttcataatacaaataatcataatagcagacatttattgagtgcttactgtgtgcccacagttagccaagcacttgcatggtactaccacatttcatcctcacaaccatgaagaaaatacaaatattatcctacacgtgatgaaacaagcttagaaaaggccaaagtggtgaaatagactcacagccaggtgatctgatggaagaaaccattcttagccaacaaaggaaggcatcaggaacaacaaagatgaaactgtctacatctacattaatagaatccaaagcaagtcagtctataactgaatatggacttttcctttatgatgtaatatttgaaactgtaactccctagagtttatgtttttctaagtcagatttattgaagtttaatttacctacaggcgaattcacttcctttaagtgtagagatcaatgaatttttacaaatttgtacagtcatgtaaccatgatgacaaccaaggcatggcacatctccctgccctaaacgcttccctcatgtccctttgtcagtttcctccggcagcccacacatcctggacaccactggtctacaggtagaagtggagtatgcaatacatagtatttgggcctggctgctttccttcagactaattcttgtgagatgtacttgtgttgctgcagtcacccctggtttgttcctttcattgcagagaagtgtcccaagtttagacgcagaacacaatctgtttatctattcacgagtttatcatttgagcaggttccagctttttgtgattatgagtaaactgctgtaaatgtccacattcaggcattttcatggatgtatgtttttattccttttgcataaattccttttcttctttctttctttctttttttttctttttttacagggttggggtttcactatgttgaccaggctggtctcaaactcctggcctcaagtgatcctcccatcttggcctcccaaaatgctgggattacagatgtgagtcaccatgcctgtccccttttgcataaatatctaagggtgaaagcattgggttatatggcaagggtatgtttaactataaaagatgttgcccaactattttccaaagtagctgcgtcattttgcattcccaccaacaacggaagagagttccagttatttcacacctttgtcagcacttgatgctgtcagacttttcagttttagctactctagtaggcttgtatcagtatctcacggtggttttaatctgcatatcctaaatgactcatgatgttgagcatcttttcacacactcatttgccgttctcatgtctttgttaaaatgtctgttcagcaggaacagaaaactgaataccacatgttctctcttataaatgggagctaaatgatgagaagacatggacacaaagaaaagaaggaacaacagacgttggggtgtatcagagggtagagggtgggaggagagagagaatcagaaaaaaatattgggtactatgcttagtacctgggtgatgaaataatgtgtaccacaaacccccatgacacaggttacttatataacaaacctgcacgtgcagccctgaacctaaagtaaaagttaaaacaaaaatgtctgtttaaatcttttgcccatttttattgggtggttgtcttcttattttctagttgtaagagttcctgatgtaatccggatataaatcttttatgaggtatgtgttttaaaaatattttctcccactctggccagtatttggatttttctgacagtgtcttttcaaggacaggagtctttagtttgtatggcgtcctattatttatttatttatttatttatttatttatttagcagttcatgccttttgtgccatatctagaaaacttttgcctaaaccagcgatgatttattctatcagtgttattgttttaggtcttaaatttaggtcaatggcccatttttagttacttttataaacaatgcaaacaccaaggcttatctttttgtttataaatatctacttgttcaaacaccatttgttaaaaagataatctttcccctcattgaattacaccgacatctgtgtcaaaaatcaattgaccacagtgtgacagtctgtttctattcattccattgactatgtctacttttatgccaatactgtactgtcttgatgaccacatcactgtagtatagctttaaaagacagtgtgagttctccaactttattcttctttcgcaaagttctttgggttattctacatcctctgaacttctgattaagtttaggaatctgtttgccaaattctgtggagattttgattggtgttgcattggattctcaaaatcagtttggaaaatcagcaccctaacaacactaagtcttctgatcatgaccttagcctgcattattcatttagaacctccctttaagctctcagccatgttttgtaattttcagtacacaaaccttgcccatgttttgtaatattgggatcctactgtatgtcattttaatttcaatttctcatttttgtttcctttataaagaaataaaaaattgactttggcatatttaccttacgtcctgcaaccatcctaaacacgtgagtcttaatagctgcttttgcagataatttggaatcttctaggtaaatagtaatgttgtatgaaaataaatgcagcttgctttcttcctttccaatttgtataacttacatttcttttttaccttcttgcactaccaataattttcagtataatgttgaatgggagtggtgcaatgtcctcatctgaaggcaaaagccttccatctttcacattaggtgtgatgctggctgtcagctttttgtagaagcactgtatcatattgaggatgtttcttttttatccataatttttagaattttaggagaaatagatttcgagttttctcaagtgatttttatgcatctattaagatgatcatgtggtttttctctttagtctgttaatatggtaaattccatgcatttattttcaaatattaaaccaaatttgcacttgctggaataagttctacttttttatgatgcattattctttttgtatgttgctggattcaatttgctaatattttcctaaggaaaatatatattattttttaagtgtatatttaggagagacatggtcctatagttttctgtttttgtttttgtttttcttgtaatgtctttgcacgggttttagtatcggggtaattttggcttcataaaatacttcctcctcttttattttctggacatatttgtgtagaattggtaatatttcttccttaaatgttcgatagaattcactagtgaattcaattagtctgaaaacttccttgtgggggtttttaacaacaaattaaaaacctttaataaatataagactatacagtgagtaaatatacatgttaattattttctatttttctacctccaagttttctgatttttttccacttctgtgcccaatgtattaatcagctcattacagaatacttcacctctggtatcacttctgaaggtttctaaacacagccatgtgacttatcttcatcgctttcccctctgtgctaaaactcagtgtctcctcacacacactgtccactctttctggtagatctctcatcatatttattatagttactttcaagtctcgtctgttggttctagcgtctgggccagtctcgaggacaggttggcttttgtttgtttgttttggtatgtgtcttcgaattgttaatcaaatactgggtatggtgagtagaggaacagcaaaggccgagatgactttaaattacacctgcacccaagctggcccacctcggtccctgagccgggatttgtcttgtcaggagctgaccaggcctcgctgcttggtctttgccttcagtgtgccccgtcttcagtcccgctcgggcacctgcagctgagcttctcttgggacctgggacctggcccagcacagcgggatttccagtacccgctgcaccctcagcgctgagcaggtgccgctcacctggccacagccggctcttcactgcgtgccccgcccgaggaagaccgacgctgtccattcttgctgggaggtgcgtggtgaggccagggggctccgaggcctcctgtccagcctgtctcagaggcagcccaaggacccaggcctcaagggtctggggtgggagggcgccctgcccacccccacggagcagccttctctaggctctcccagcccttccccggggtggaaggctcggccgctccctgacccctggcctcagcagcccttccctgggccagaggccacactgcagttttctcagctcaggctcactgtggagcaggggtcactccggaccctctcagagctcccacctcttccccgaagcagggccttccccctcccactggctaagggctctgtaccacaagagggaaaaggcgaccgcagggtggacctctgtgtctgtccacctgagggctccccgctcctgcctagcccccagtcccctccccctgcgagaaggctgcagaggacactggagtgaggatggccccgtggctggggctctggggtcctaggctggtgctgggcccacacccagctgtgtcctcatcacctctgtgggggtggctgtgtcttccacccgccctctgcccctcccgggctccccacccttcaggctgccacctggccgccctgctcccgataagttcagggaaggtggggttcccagatgacctggctgggcttcattgcaaaccaggttgtcactgcgttctaagtcctaggcataactggaagctttttgttttacttggttggttgtttgctttttaccaataatctatccaaatatcttctacggaatgaaaataaagcttgcacatggaaatggaaattaagaaacagaagtttttctggttcaaaatgagcttgacagttggtttgacttctgtgtctgagacacataaacgcaacgcaggctctgcatgagcacaggctccttggcaaaagccccagatcacaaagtcaaagcccttactggctcacagggagcacctgagtcatgggctgaggacctcaggcttgaaagccctgtaccagccggtcagcggctaacattatttgctaaaattaacagttggaaatcaatgccttgtccaacagaggtacaattgagctataattgattcaaggaagtaaaataacactgaagaagggtggtcagcctctaacttacaaggtgaagtgcttccgaccttcctaacgcaatggttctggggaaggcaaggatgagagtgtcagcgtgtcaatgataatagcattgtgcttatggaggaaaatgtatttatttttcagagagccatactgaaaaatttaggaatgaaatgttatggtttatatacatcaccaaaaaaatacttgagcaaaaaatattcacaaaaaaatacaaatataaaacaaaatcaaaaaaagtttatctagtccacgttcaaagtcccccaattgtccaaagaaatatactttactgctggtttcttcaaatcagaatggaaccaacaagtaaatgttacattgtattatcatgtccctacgtgtcattaatacacagcagtccttcccagtcttttgtgtcagtcttgttttcttgcaggtagaccaggtatcctcaaggcctcaccactggaggactcggaatcttggccgcaaagatactaacagatgtccacgtgataagccccaggacctgtgagaatggtatgcggcaaaggggctttgcagctttggacaaacaaggaggaccaccctggattttctatgtgagtttaatctcaccagggccctcataagaggaaggcagcaggtcagagtcagaggacgagatgtggccatggaggtcgggatggatgggagtgaggccgctgcaggaaagggccgtgagcaaaggagtactggcacctctggaggctggcacaggcaggaagtgggttctggaaatgaaacacagcctctgccaactcctcgatcttaggatctgtgccctccagaaccgttagacaaccagtgtgtgttgttttacaccacaacgtttgtggtgattagttccagcagccagaaggaactcacagccacccgctgggggacccgcgcgtaagtcatggtgttccccccttgtgtctttattgcttttttcctgtaattagctggttatgttcaaagtagcttcctgcattgttccgtgaattcatggctatatattttatactgtgatgatcacgtctcctgcacatcaaacacccaaaaaccagaggacttgtcattcatcactgcagtgtctacgtggccttttccaggatacgttatgaagaaatgtttgttagataaataagtgagtaaatgtgtactattgatgtagcaacttttaagggaagacattagaataagggggaattgagccttaccatatctgaggggttagttactgtatatttatcattattttctaaatgtaaaatgaaatggactcgcttcttgtttataatgggggctttggaatagtatggttcaccaatgtaaaaatagatgccatcccaatgtagtcacaagggtgcttataagagggaggtggaaatcagagcaggagaggagaggggaggagaggagaggagaggagaggcggcactggaggctctggaggcgcagcacagggcctccagccagggtatgtggacaaaggcccagaaatgggttctcccttgggcttccacaaggaaggcagtctgctgatgcctggatttcagcccagtgagactgattttggacttctgctctcaaaagtggtaagatgataaatttgtggacttttaaaattaactaaaatagaaaaggacaaaaatcgacctctccaataggtaatgagttcaactattgaatgaaattagtattattccatatatatatatgtaagcaataagcttagtgttaacataaaaaatagatgccataatgccacttgtttgcaggaagtaaaaatttgaaagtgaacactggaaactgttctgcaaagctgcccccaaatgactcctttgctcctaaaacagacctccagctgctgtgtgcctgtggtcttgctccttgatctgcagtgtcctgcaccatccacactcaagcatgctctggcacctgggcaccaagttcctgcaaagcctgtgagaaatccactggaccagaacctgaagttttatcaaagtcttggtggtttccatgcacagcaaaaagaaacagacttccaggctttcatgtgagagtgcgacggccttcctctctctacctccccacgagtagagctgcccggggaccctctgtggctgaaaaacagagaaagtttgcctggcacagacacattccaggactgggcaaatggtttggggagctggttttcaaatgctcctttacaaccctctaggaaaacaaggtgtggtgctttcctttcctcgccatttctccagcagcactctgaggatatgcaatgctagacagcacgtccttactgtaacaaaatgccagtgagttgtgtcctgagcccaggaggcttaactaatcactaaccttgaaatgtaccatctcacattgtttaaaaagaaagctgggccgggcgtggtggctcacgcctgtaatcccaggcttaggcgggcagatcacctgaggtcgggagttcgagaccagcctgaccaacatggagaaacactgtcactactaaaaatacaaaaaattagccaggtgtggtggtgcatgcctgtagtcccagctactcaggagactgaggcaggagagtcacttgaacccaggaggcagaggttgcggtgagctgagatcgtgccattacactccagcctgggcaacaagagcgaaactttgtctaaagaaaaaaaaagaaaaaagaaaaaaagaaagctgaggctgggtgtggtagctcacatctgtaatcccagcactttgggaggccaaagtggtaggatcacttgaggttgggagttcaagaccagcctgggcaacaaagcaaaccctgtctctacaaaaaataaaaaaaaaaaaattagccaggcagctactcaggaggctgaggcaggaggatcagcagagcccaggaagttgagggtgagattacaccgctgcactccagcctgagtgacagagtgagatcgtgtatcaaaaaaataaaaaatgaaaaataaaaacctgaatatccctggtgcgttaaaaggaagatactgcattctagtaagagtcaaggccatgtctgcagcttcagcgctgacgcgtgcttcttgccatgctgagccaggcaaagtgcgtgctgcacctgctctttcaaagacagtggtcccagagctgacgatgagctttttccaaagcctgaagatgaaagtgtcagaagaatactgtatgttttttcaaagttataggagggtaaggtgagaacacaagaacaaaaacttaattgcagaggaaaaatagaaaaactcagcaggtctgagatggcagctctgatctagacacagcaggtgctgcacccagcctccagaggcccacagccgaaggcctgcagaggctgagtcagaaaggacctagtgattgcacttcactgctaaggaaaaggtgagagggggctgacagcaagtaatgggacctgtgtttcattcctcccttttgacatggtatgacggtaacaccccgtgaccactctctaaagagatgaggaagaggccaggagtgaggcttgtttggtagaggacagagggtctgatacaaaatcaccctaaaatattctctaatcaccaattggtccccgctatgaccaggagtttgtggtggcctcaggtcttccctaagggtcaccgtgattctggtgcccttggacaagcctcaagcaggatctggcatctctcgagcgaacaaaagccagtgcccaggcagcagggaggcctctacacacctccagcggtagtagaagcaaaaatcatgataaaaaatcaggtcagcgtgcaactcatcgattttggctcatgccccaaaaagcaggttctctcgcaaagactctgagaccctgacccacaacgccaaccgaacgggggttcccaagcacagtatctgctaggggtcgaattatgctccccaaaagatacgtgagtctccaacccccagtccctcgaaatgtggccttgtttggaaatagggtcattgcaggtgtaataagatgaaagtcgccagggtggccctgatccaatataactgcgttcttagaacaccatgtgaagatggaggtggagactggagagagaatcccaccagccaaggaacaccagaggtcaccagcaaagcacagaggacagggagaggttgggacaaattctcccaaagagtccccagcagcagccagccctgtggatgctgtgatcacagacttccagctccagaacggtgagggagtgaatttctgctatttaagctgcccggtgcatggaactttgttgcaaggctccaggagactaatccagcactgaagccagaggggctgtatccataacggacccgaagggctttcaaatctcttctgtgagcatcacgtcccacaacttgtgtctccggccagctccgtgcttcttagcccaatacccagagttacttatcttaaaaatacagacagggaaaatggagattaagatggtggataggaggcaggactggcttgcagctcctgctggaacagacaaagcagcatgtggagagacccacatcgtgaacttttgttccaagaactaccacagcaacataccaggaaagcctagagaatccacggaccctttgaaggaactttatcgctgctgcaggctccatgagacgctgaaaaaccgtgagtctgcctgccttctcagtggggagggcaagttctcagcccaggtcaccggctgcctagaaatagactcggtgctgttgggggcacagtgggagtgagaccagcctttaggactgtgggctgcatgggagcagggtgaggcctgtgaccgccgcctttaccccactttcctggtgatctgtgtgatgcagcagaggccccctgcgaacatagctccattggcctgggaatcacacccccatcccccacagcagccacaccaaaccctgctcaaggagaatctgagatcagaaacacctaaccctgtcccacctgggggtctttctctacctgccttggtagccaaagacgaaggacataatcccttgggagctctacagccctgaccacctctggagaaacctgaatacttcaaaggtgacccaagggcaagcttgtcttctccctgtacaacctcagctgatgcactcctgaaagcaccacctcctggctggaggacaaccaacacaaaaccagtgcactgaacaaaaacacaaccaaggaccctcatagagtccacttcactccctgctacctccactggagcaggtgctggtatccacagctgaaagacgtgaagacggatcacatcacaggactctttgcagacgttcctcagtaccagcccagagccagtagctctgctgggtggctagatccagaagagcaaaaacaatcactacagttcagctctcaggaagccccatccctaggggaagggggagaacaccacatcaagggagtaccccatggaacaaaagaatctgaaaagcaggtcttgagtcccagatcttccctcagacatagtctacccaaatgagaaggaaccagaaaacaattctggtaatatgacaaaacaaggttctttaacacctccaaaagatcacaccagcacaccagcaatggatccaaaccaaaaggaaatctctgaattgccagaaaaagaattcagaaggtcaattattaagctacttaaggaggcaccagagaaaggtgaactccaacttaaagaaataaaaaaaaacatgttatacaaaatgaaaggaaaattcttcagtgaaatagcataaataaaaaaataatcacaacttctggaaatcaaagacacacttagagaaatacaaaatgtgctggaaagtctcagcaatagactcaaacaagcagaagaaagaacttcagagctcaaagacaaggctttcgaattaacccaatgcatcaaagacaaagaaaaaagaattttaaaacatgaacaaaagctccaagaagcttgggattgtgttaagcatccaaacctaagaataattggtgttcccgagaaagaagagaaatctaaaagtctggaaaacatttgagggaaaaatcaaggacagcttgcccagccttgctagagatctagacattcaaatacaagaagctcaaagaacatctgggaagttcatcacaaaaagatcattgcctagacacatagtcatcaagttatctacagtcaagatgaaggaaagaatcttaagagctatgaggcaaaagcatcaggtaacctataaaggaaaacctataagattaacagcagatttctcggcagaaaccctaccagctagaagggatcggggtcctatgtttagcctccttaaagaaaacaattatcagccaagaattttgtatccagtgaaactaaacttcataaatgaaggaaagatacaatcttttccagacaaacaaatgttaagagaatttgccactaccaagccagcactacgagaactgctagaaggagccctaaatcttgaaacaaatcctctaaatacaccaaaatagaaacttcttaaaacataaatctcacagaacctatataacaataacacaacaacaacaaaaaaaacaaaccaaggtattcaggcaacaaatagcacaatgaaaagaatagtacctcacatctcaacactaacattgaatgtaaatggcctaaatgccccacttaaaagatacagagtagcataaacttaagataaagaggtggaaaagatattccatgaaaatgcataccaaaagcaagcaggagtaactattcttatatcaaacaaaacagactttaaagcaacagcagttaaaaagacaaagaaggacattacataattataaaagcagtagttcaacaggaaaatatcacaatcctaaatatatatgcacctaacattggagctcccaagtttacaaaacaattatgactagacctaagaaataaagagacagcaacacagtaatagtgggggacttcaatactccatggacagcactagacaggtcatcaagacggaaagtcaacaaagaaataatggacttaaactataccctacaacaaatggacttaacagatatttacagaacatcctgcccaacaactgcagaatatacactctactcatcagcacatgtaacattctccaagatagaccatatgataggccacaaaacaaggctaggtaaatttaagaaaatcaaagttatatcaagtactctctcagaccacagtggaataaaataggaaattaactccaaaaggcaggctcaaaaccaggcaaatacatggaaatcaaatagcctgctcctgaacgactgttgggtcaacaacaaaatcaagatggaaattaaaaaattatttgagctgaacaataatagtgacacaacttgtcaaaacctctgggatacagcaaatgcagtgctaagggggaagttcatagcattaaatatctacatcaaaaagtctaaaagagcacaaatagacaatctaaggtcacacctcaaggaactggagaaacaagaacaatcaaaacccaaacccagcagaagaaaagaaataaagatcagagcagacctaaatgaaatagaaacaaaaagaaaatacaaaaattaaatgaaacaaaaagctggttctttgaaatgataaataaaatcaatagatcattagcgagattaaccaagaaaaaaagagaaaatccaaataaactcaattagaaacaaaatgggagatattacaactggataccatagaaatgcaaaagatttttcaaggctactatgaacacatttatgagcataaactagaaaatctagaggagatggataaattcctcaaaatatacaaccctcctagattaaaccaggaagatatagaaactctgaacagaccaataacaagcagcaagattgaagtggtaatttttaaattgccaacaaaaaaaaagtccagaaccagatgtattcacagttgaattctatcagacattcaaagaagaattggaaccaagcctattgacactattccacaggatagagaaggagggaatccttcttaaatcattctatgaagccattatcacccccataccaaaatcagggaaggacataaaaaaaaagaaaactatagaccaatatccctgatgaacatagatgcaaaaatccccaacaaaatactagctaactgaatccaacagcatatcaaaaagataatccaccatgatcaagtgggtttcataccaggaatgcagggatggtttaacatccacaagtcaataaatgtgatatagcacataaacagaattaaaaacaaaaatcacgtgatcatcccaatagatgcagaaaaagcatttgacaatatccagcattgctttattattaaaaccctcaggaatattggcatagaaggggcattcctgaaggtaataaaagccatctgtgccaaacacacagccaacattatactgaacgaggaaaagttgaaagcatttcccctgagaactggaacaagacaaggatgcccactttcaccacttctattcaacatagtactggaagtcctagccagaacaatcacacaagagaaagaaatcaagggcatccaaattggtaaagaggaagtcaaactgtcactgtttgctgataatataatcgtatacctagaaaaccctagtaaagaggaagtcaaactgtcactgtttgctgacaatacctaaaaaaacctaaagactcatccaaaaagctcctttaactggtaattgaatttagcaaagtttccagatacaaaattaatgtacacaaatcaatagctctgctacacaccaacagtgaccaagctgagaatcaaatcaagaactcaaccccttttacaagagctgaaaaaaaaaaccttaggcatatacctaaccaaggaggtgaaagacctctacaaggagaactgtaaaaacactgctgaaagaaataatagatgacacaaacaaatggaaacacattccatgttcatggataggtagaattaatattgtgaaaatgaccatactgccaaaagcaatctacaaattcaatgcaattcccataaaaataccaccatcatttttcacagaactagaaaaaacaattctaaaattcatatggaaccaaaaaagagcccacatagccaaagcaagactaagcaagaagaacaaatttggaggcattatattacctgactccaaactatactgtaatgtcatagtaaccaaaacagcatggtacttgaataaaaataggcacatagacaaatggaagagaatagagaatcaagaaataaagccaaatatttacagccaactgatcttcaacaaagcaaacaaaaacataaagtagggaaaggacaccctattcaacatatgatactgggataactgcctacccacatgtagaagaatgaaattcattcttcatctctcaccttatataaaaatttactcaagatggatcaaagacttaaatctaagaacgtgaaacaacaaaaattctagaagataacattggaaaaacccttctagacattggcttagataaagagttcatgaccaagaacctaaaaggaaatacaacaaaaacaaagataaatagatgggacttaattaaattaaaaagcttctgcacagcaaaagaaatgatcagcagagttaacagacaacccacagggtggaagaaaatcttcacaacctatacatccaacaaaggactaatattcaggatctgcaaggaactcaaacaaatcagaaataaaaaataaacaatccatcaaagtgggctaagaacatggatagacaattctcaaaagaagatatacaaatggccaacaaacatggaaaaatgcttcaacatcacttattatcagggaaatgcatatcaaaaccacaatgcaatatcatctcactcctgcaataatgcccataatttaaaaaatcaaaaaataatagatgttagcatggatgcagtgaaaagggaacacttttacactgttggtggaaatgtataactagtacaaccactatggaaaacagtgtggagattcctttaagaactaaaagtagatctaccatttgatccagcagtcccactactgggtacctacccagaggaaaagtcattataccaaaaaatacccgcacatgcatgtttatagtagcataatttgcaaatgcaaaaatgtggaaccaccccaaatgcccatcagtcaattagtggataaagcaactgtggtatatataccatggaatactactcagccataaaaagaatgaagtaatggcattcactgcaacctggatggaactggagaccattattcttagtgaagtaactcaagaatggaaaaccaaacatcgtatgttctcactcataattgggagctaagttatgagaacacgaaggcataagaaggattcaacggactttgggaactcacgggaaggggtgggagggggatgaaggatgaaaggctacacactgggtacagtgtacactgcttgggtgatgggtgcaccaaagtctcagaaatcaccactaaagaacttattcatgcaaccaaataccacccgttccccaaaatcctattgaaataaaaaattaatttttaaaaaattaattttaaaaatatatatatatatgtgggtcccatcactctcctgcttagaagtcccaaaaggcttccaggaaaaaaggatataatccaagaccttgccatggcctcgaatcctgacatcacactcttctctccacatgcatctcaggccagcctgggcagccccaggcctgcacatggttcctgaagccaagcccagctgaggcttccttggtccggccatgccagggtctgtctgtctgtctgtctgggacaatccacccctggtcttgctggttggtttcttctcatcagtcaggtcgtggcctaaacatggcgtgggtagagaagtctacggtaaccatgccccatgcctctgctggtatggcccacgcagagcactccctgtcaccctatttctgcacagtacttacccccgtgtgaaaccatcttgttgagctagttgtttatttgcgaggatgctaaaatataagattcgtgctgtcttctttttcatagaatcctggtgcccagcacagggccagacacacagttatcactccccagactttgcccgaagaataaaagaagaagggagggtgaggtgggggcggatcagcttgagtcaccacgcgtgtagctgacagtggaggaccccaggccacccccgcccgtggaaatccatgagaccgttcatcgtttcaagaaggacattgcaatgtttaccctattaacttggagataggcatttattgggctaaatcctcacgtagaatgagctttcccaacacaggagctgcgtcctatgcatactcagtcccatgtgcctggcgcagtgtgtggcctgagactgacaccagcatgtgttcacagccgtttcctcaagctgactgaattctcgccttcgctttctttggaaatggttttatagggtttgctccatctgttctacataagacagaagtgagacaccgggttcagggaccaggggcactcatgcctggctccgctgtgcccacggggcctccaccagagaagtgtgagactccgggttcaggaacgaggggcactcacgcatggctctgctatgcccacggggcctccgccagggacgtggagcggaggcgtttccttcttggtggccactcaacgtgcatttggcaagtgggatgtttgggttctacatcctggaaaaatatgtcttcatgattccctggagaattttatgactcacataaattgcaaagtctgtctccacacccagctctcagctgcatgtacattacaagggtacaaggattttttttccccattttattacttcaaaatacctgaaggataacaaactatacaattttctaactgacaccttgcatcttacccaaacacacacagcattatctatgggagaaaatccactcaattaaaaaaaaaacctatatatgtatataaatcttaccaaaattatttaaattgtccatctaggattaataaaatataaggagcttttgtaattcttgtaaatcaataatacatcccacctatgacaagatagcagtgaatagggaggtataatttttaaaagcagctccatctaaaagcccccggatttttgtgcactcataaagaaataatgcttgtctttctccagtgtgaagagaggagagagattttggaaagagaggagaaagggtctcagtgtggcaacgcaggtcccgtgagttccacgcagcctcggccagagtcacagatctgagcccctgcgtcctcctcaggaaagctctgctcgggatggcggctcagcgggaagccaggctgcttctgaggtctcacgggggatgaacctatgggaggtgggctcccccacatgtgggtgaggagggagatgacagggacatggagggacagacaacgtggccagcaccctctgtgtgaccagagatgcctgtagcaccgagataaggcctgaacagaaggaagggactgagccaccaggtttgacccatgacctgactgcattagccaaaaataaaaaatctgcccccattgttgagtacactgtgggaaatcaagggttctaggaggagaaaataagtctgtagaaaaagcctttgtttgaaattccctcactcattagttctctgctatacttagcaaattacatcacctttggtgcctcgatttcaccacctgaaaaatgggggaaaactaacagacctcctgcccacttcccagggctgagggagggtgcaaggcgtggaaaacaggcgcacatcaagagttgggttgttatttcacagccagtcctctgcaggcaggaggagagccacgccaccagtcctcaggggctcagacctgggaggccttacagacacccaaactggatctcatcgccttctccaacctgctgctccgcacactagacacagagaaaacggagctttctttgggtcttttgcttcatgatttagcaacgacctcaacgcagaaggtgattcttggctgtgatcggatgagcacaatttttttctggagaaccggcgttttctttatgagacacccccataaaatcaccaggcagcagagatagttactgctctgccccagaggctacaaggaagcccccacaggccatttgctggtgcacactccctggagccatgcgtgaggagccagcggtgagtgctccgctccaggctcccgatttggtgctctcagaccacgggacacagtctccagccggtgcccacgattttagagactgttcccattcgcactgagtaatcctctgtttctcggaaagaaagcactctgggaaatgtgcaaaggctgactttgttacagaagcagaaaaatgaggatcccagaaactgaaaagagctatacactgtcttcatctgcccaggaatgacaaatgacaaacactcagtgagaaaggaataaccagaaggagggatgtctgcagatgacaagagccagacttcttgtcttttgtggattcttgcaaataattaccacttacacatcaaatgatatgctgtcccaatcttctttacaaaatcatacgtttttcttcttttctgcctcaataaatgctaatgttccatgaagccaatgttattctcacccgctccacagtgcgtctaaacacagatgggcctgcagtggcttagccgcatcacccgctttccaggaggcatgatgcttaccctacccttttctagcatttctgcaaggactaaagtgattcttgtctgctggacagagaaacagtaagaaatacaaatgcaaatagactgccatcatggtgacttatgtaacaccagctttcagagacgccacagagacagattcacaggaggtaataagcagggcctggaagattgttttatcaatcttctttcaaatctactagtgatttcttgtaaacagtaattgcattgctcttaattgcttcattagtgcctgggcttcattattcaccttgtctcacttctattcagaccagtttagattgtttttctttctgtttttttatgaggaacaatggaattctgtctggattgcagagacatgagaggcaacgtggccgcacaggcggtttagcctgtcccgggccatatcctgctggagctttggcccagagctcctgaacacacccggcctggctctctctttcaccctttctgcctgttgccacgagtctcttcctgacccttttcctcaccaggggactcgtcgaggggtccaagcagcaacggctcggcaactccgggagctgggcattggaggaggccacgctgacacgctcaggagctcatccctgagcgcccacaggcccctggatgtccctgtaaggaggcttcctgcccaggcctgagggtccctctgtgacctctcagctggtgctgtgtcttcagcaccctccttggctcaaagagactgtcatctggcagccgaaaccctgtgatccccgtgtggctgtgtcctgccaactgatggtgacagcaggaaatgcacctgccctgccccctcgcccggatactttctattctgctatgaaaaacagagtaaaatttgagaggaaagggaaagtacccccgtagccacaaggaaatgaagtggaatcacgctgacattttcaataacacctggatctggttttataaagttgacctaacaagaaaatggtcctattgttatcaataaacataaccctgaaatctaagcgctttaaaaatccatgcaacagggcaggtgtggtggcttatgcctgtagtcacagcactttgggaggccaaggcgagaggatcgtttgagttcaggggctcgagaccagcctaggcaatatagtgagaccctgtgtctacaaaacaaaaactaattaaattcatgcaacaaattctaatatttttcaaaggctgttctgtgaaataaaaactcacctaaaaatcatctatgtatctaagaacatgtagggaacaaagacgataaaacagcacagagacccgggagcctggggctgcctggccctgcacagacttcgcctctgtgccgtggaagtggacaggtggggcctctcctggcccaaagccattgaagctggctctcctcctccatcaggacagcctcagccctcccaaccgcccagcacagcagctcagaggaggctggccgagcgcagccgccgccacgtcctatcccaccaaagatccatgctcagcatcgtggccacctaagtctcacgagtgtggctgtgaggttcgtttgagtacacttggcccaacatccagatcaggttcccaggcaacaagacagcaggttgcctctagaccctcaacaagtccgcccagttaggcctgcagggcagtccccaggggagccacgagcttgtttcctgcacggagctgtcgcctcatggaggcgctctcagccccggtgctcctttgcctcagtacacatggcctgcaggagagaggcaggatggggagaggccagagcctcagggagccagggcctcgcctgctcacaggagtcattttgcttctagatttttcttccacgactgtgatgtcgctatactgagccccttcaagtaatctcttaaagacgtattgcctgacagaatctgctgggttttgtggttgttgttcagaatatgaaggatgcctgcctctgatgcgtcagatgaaattagaccaagaatccacccatcccgtgaatttatgacacaaactcccccacatcactactgccttcttgagggaggaggccgttccctcagcaatggtgaataaaggtgtattgcagtaacacccaagctcaagaacagacatcttgtcttacacccaagcttcacacgggaccttcaccagaactcaccttcttggaagctgcacagaaccgtaacgtgaggaatcacatgcctagatatcctatgtgagctatcccaaatgccttctacacttcaaaaactatgtgagaagtctactccacgaaactcatatcagtgaaagtactcacaagttggagtgatcacagcacctcctgcgctcctccagggcaagcctcgctcacctttttattcttttccatgaaccataatgcctggcctacagattatcaataaatattcttggctgaataaatgaatgggaaaactgctgctgacttgaatgatttttttcctaaataagatgactttttatcatatatgttcagactggcaagaggcatgaaacgtttatcagtttagttgccacaaaatttctttctttttcaaaataacaacagatgttggcaaggatgcagagaaagggaacgcttatacactgttggtgggaatgtaaatcagcacaacctctacaaaagacatatgaaaacttttcagaaaactaaaaacagaactaccatttgatccataatcccactactaggtatctaccctaagaaaaagaaattattatataaaaaagacaccttcacttatctgtttatcacagtacaattcacaatagcatagccatggaatcaacataagtgtccaacatcgaagaattcaatcaagaaaatgtgatacagatacatcatggaatactattcagccataaaaaagaatgaaatcatgcctttagcagcaacgtggttggaaccggaggccattatcctaagtgaagtaactcagaaatgccgcatgttctcacttataagtgggactaaagaatgagcacacgtgaacatagagggggaagagtaaacactgggctacaaaaggtgggagcgtgggagtgggggcgaggatgaaaaatcacatgttgggttctgtggtcactgttctggtaatggctatgctagaagtccagaattcatgactacacaatatatccacataacgaaactgcatttatactccctaaatctattaaaagacgaagaagacgaagaagacaaagatgaagatgaagaagaaggaaaagaagaaaaaggagaaggaggaggaggaagaggaggaggaagaagaagaggaagaagaggaagaagaagaggaagaagaagaggaagaggaagaggaagaagaagaagaggaagaagaagaggaagaagaagaagaataagaagggttttgtgattgtggttcagaatatggctcttttatttgagccataaatccctaacctagagaagaccttgcaaataacccctctggaggccaagaaggatgtcgaaagcctgtctctaacaaaagttacacaacatcatagagtattcaaatgacattcatctgcagctagactaaaaaactccatgttgggttttcagcatcatctatcagaaacatcaagtaaacaagtaattttctccagtattttctcattcttcccacaaatactgcaaatgtacctaaatatcaagattatagttctgcaaaatactcctaaaatctgtttggaactctattccttcatttattaagatgcaaagatatactggttttctattatccagatacagtaagcatcaggaaacagtaataatttcctccatctgatattccgttatcaaaaacaacttttaaagaggttggttactttcattacattctatgatagattcacatctagatttccaccaaaaatgtagagaacacgacaacttgagactaggagctcttaaaaaataaacactgttgatgaattaaaggattttctgttagttgtatacatgcactttggggcataacatgtgctatggtctaaatgtttgtatttctccaaaactcatatgttaaaatcctagcaataaaggtgatggtgttaggaggtgagaactgtgggaggtgattaggtcttgagggtggacttctcatgaatgggattagtgtccttatcaaacagaccccagagagctcccttgccccttccaccacgtgaggacaagggtaaagacggctggccatgaaccagaaagtgtgccttcaccagccatcaaacctgccatgccttaattgtggacttcccagcctccagaactgcgagcaatatctttctgttgtgtagaagcctcccagtgtggcattctgctatggcagcctgaatgcagcaggacatggtgttatggaatcttgttgcttcaactgaacctagcagaatgaagagtctgctccacccatcctggctcagggccttgtcgtcagcctcctgaagccaactactaagtcatcacataagtctgtctgcagtaaacacactgaaagttccctggaaatcacagttcctacaaaagcctaggcaagtattctgaaaaatgacagccagtcatttctctgagacctttggccttatgaatttgctgggaaggtacatcttcctttcctacccctaccactttgcaagtatcagattgagcatcatattttcaggagagtcactgcctcatgcctgcctaccttttgatcatcatggaactggcaaaagcagcgctatctacttttccaggggatgcaaaggtacaaggccaggccaagcatagtgttcaagaacgcagctggatcgctgcgcagctagaagagagctggactctagactcccagattagtgaaaatgcacagaaccgaaaggcagctggataaacgtaaggcagctgaatgccatttttctttatttaaccagtgggctatgtcatcggatcataagatccagcgacacttggcttaaatgttgcattggtgtgcataggtttagatggtagtgaaacgtagcgttcagcatctgagcagaccattttctaaaaccagtaatgttcatcgatccagcccttccagtctgcaatatctgccagctattttaaaagtcaacagagttgcaaattttctaactgttctggctccaggtggcatgtggctgagcgactcagtcttcttaatggccaagtcaatggcccacggctccggctgcctctgagagcgtttgctttaccagtggtggaagtgtggctgcgtaactacaatgccttgactacagcctcaactcagccttccaatttacctctttgctggccagtgtctccctgatggatacacttatcgttaccaaaatctcccctgagaacaccagtgttgccgagatactctcactttattaaagtctaagtctgttttctgctgcctggatcaggcccatgctcctgcacagcatgaaaatgaagaaatgcacagcctgcagcagcaagagctctttcttctcttccgtttgatgaccacctcgggctgataccctgtctctctttccttctttcccagtcaacccctacaggccctgggactcctctccgtccactggaaaggcaactccccacggatggaatccgctcttctccccagctctgctgagcacctcatcagacattttaagcagctgtgtcacatgacttccagtacagggagccccacaccaggcttccatgccagctggttactcccaggcctccttgactggtactaatgcaccatgaccctcacaagtgcccatgccaggagaccatgaactttacctcgatggacagccttccgtcctatgctccagctattctttttgagggagattaccgaatataataagcacatgatatgtacatatgcatatatacacgtttgtgcatgtgtatgtatagagacacatatgtcactaaaataactgctcacagatatttaatttcaaacttccatttcccccttcaccaccttctgggcccaatctccccaaacaaagcagagtgtaataaaacgtgtatagttacttcttctgcagtgtcttctgtggtgggctccacatccaggttgagatcctcctctgtggtctgataacaaagatagatgttaaagatggttagcattgccatgtgtttgtaggtggcctcatacaggttaccaatatgaaaaagtactaactaaatatcccgcatgatttctgtaggacatggaaaccatatcaccgtcccttcccacctgaatttatgtttaactgtgtgatgcttcatgtccgagatggatcctttatacaacaggtggtaagtaaggcaaggagtgttcacactaaaccctaactcaaacgactaaatcaatgaagcgagtgtgacttacggtacaatctaaaggacgacaaggtgattcttgccagtggagaaagcgtggattttcatgaagctaaaatacgaacggagctgatgtggaagcacagagcagcggtgaaggcatgtgtgaccactcccatgagaacggaaccaaatcacagtcccaagtgagtgctgggagaatggattctagcagagaaatgaggcccagcccataaaacgtaaagcaagtgtttctgtggttggcacaaggtttaagtggaaccatctgggtctgagtctttggtttctacttaacaacttggagccacctgcttaacctgggcctcggagacatggcagtgcttctgcctagagatgtggggagagctccacggaagaacaccagccagccatcagcaccggctgccatgcagcagacacgggagagctccacggaagaacaccagccagccatcagcaccggctgccatgcagcagacacgggagagctccacggaagaacaccagccagccatcagcaccagctgccatgcagcagacacgcaaagtgaactgctgtcattattactatttctagtttcatcttctcacctagtagccaggagataatcatctctatccaagcttgactatgaatcttcagggaatcatgtttgatctgcattgtttaaaaacggagctttctctttctctatctaatgtattatgacatcccagagagaaaaatcatgcttattcctccaagagaacacaaataaaatgggtcagccagaccttgtgggctggcttatggacttgccttactcatcatttctcccattttcttatcttgcccccaaagcacgcccttggctgctgtaaccccgctgaaagcaatgattgaaaagtcctgtgtttgagatgtgccttcaacttgccagaacataattcatgaaatactacatgtttctttttcatgctagattctgccggggttttctggaggttctggctcttaatgagcacgttgccttgtcaacacacccatttatgggttaattatatatctgaaatatctcagaacaacacagagaaccacaaagactttccctggacagtcagatgaatctcccctggtctacaatttttataaactgtatttagtgttctctagtacaatggacctcagacccagttcagttcggttctctcagactacagatgagaaaacaggccagaaaggatagcagcttgaaaaggtggttagagcaaaacatgaatccaggaatgctgattctagtccctggaaatccaatcatcagtcctgtcacatttgcataacagcaaggaactaaagcaataaaatctaaactaaatcactaaaaaataagcactaaaatctcttagcagattttccgatgagaaaagcatgcaggctcctcctgcaagggttttagggcatttaacttggagttcagaggccagatatgctccatatagctctgccacatttcttgatatgtgagttattttaataccatgcaacataaaacatggacaaaactagagaggaaattcagactgtgaattccaaaacacagaggattttgtggatttggaaatttcctcagaaacttgaagtacctcatggttaatatttaagctttcatttttctatagaaagaactctggttttctgggttccaagtaaataggaatttaacactgtccatactccaccagctgtgctctcctgaaaaaattcagctaagaagcctgaaaaaaatttattttgcttcaagagctatttaatgtatccaattttcctcaaaacctttaccatctgccctctcctggggctggcaaggcagggcagaccatcagtcaactcggctccaaattcttgccacttgcaagtgctttctaggctcatggcatggttttcaaatcatgggaatctattcattgctgatccatttatgagcgatttgagaaatatgtgaaacacaagctgctcctcatggctttggtcactggaaataatgtaaagaccagggtcccacctggaattgtaaagcccctggccccctctctcccatcctttctgagcccagggcggaatcctccctctggacaagcccttcattcgtgagggctgagcaccttacagcttcagcacaagccaatgtgctgacgatgaccagctgggctataggaagcactagtaaatgagaaaagaacttctagctgatcacttgctcgttcactaattcaatatttagaaaaattgaatctctctctctctcaaaaaaagtagacttgaaatggcaaccgcagtaagggaatggatctttccaaggcaccatcctcaacaccaagaacaaccccatgtacaaacagaagaatcagtaacagtagggagccctggtgtcatccttctcccaccccaggtactttccatgagcagcagtatctgggctgttccatctaaaacaaatggacttcaatgtccgtgctatgcccaacagtctctgctaaacatcaatacatatgtcgagcattatttagcttggctttccaagaaaactattcaatatgaagcattcagtaaattctcttctaaaacagaatctctcattcagttcaaaggtatgttatgtgactatctcaagacgtacatataagaataaataaaatttaaaatagcattgaatttataagtacagtgctgggagtaggagataggcaaaaattaaattggactttgaggaggtttggtgagtgattacaaatgagccatgtttaaatgccatttgagttgctataaacacagaacaggtatatctaataatttagtagacgttaataaatttggggaactttctcttctaggaaaatgtatgttgaccatctccaattcaaatggagcaaatcagattccgtggagcagaggtttgcgtgtccccagggaagcatggagtgaaaaactctcagcagtgattcctgcacacccaccagccctgggacgggcaaggaacactttgatttcattatcttttctgtttatctttaatcacacctctttatctgaccattcatccttttaaggttgcattatcttttttcgtttaagatcacattatctttatgctctctgttccttgattcatcattgatttttgccttctggtttcatctttcactgtagcaaatggaaggcttctaatttaaagccacttgttgaaggaaaatcaaactgatgcagattagtttggaaacgggaatactttaagacttacatagactttaagaagcatcctgaagtttccttaagggcaacaatttgtttcttgtactcattatcatttatgtatttacaccacacacaatgccgtgcgtgtatacacacgcaatgtttatccatgtgcatacacaacgcaacatatacatccacacacactggatagccaactctctgacccatcatagtcacctaatggacatgaactgattatagtaaatgagcaatgcattggctgcagagttcggattcttgaggatgctgtgaaaagtgcgttctctcctgcactcacctctatttccataggctccacctcgatctttttccatagttccagcaactgtgcgattggcatttttaaactttccttttctgctggtcgagtattgatagtaggaaaggaaataaacagaggctcggaccggcacagggggacggccagacgggatgtcggaagccaagggacgc

SEQ ID NO: 1387 - DNA, 217873 bp, Homo sapiens
attgttaggctagaaaaagattacacttcataaaaccatgtttattcaaaaaaatctattcagaaagtctggaaagcgtaataaatatctgtacagtggccacccatctcaaacatgaattacaaagcaggaacataaaaatgatgtgtaaacataactgctgagccagtgaacaaagtgctgagtcaggagcgaggcagagaagcgtgctcagtagaacgacacagatgctgcagcctccgtcctcagcccctcaagctgcgctggagtccaccttccgccctctccacaccgctcagggaccggcagcgtccttctccattctcgaatttgcatgacgcttagaaaggtaggaggcagcaaaacgtgtcagaaatgaacggagtgcaaatcaaactttgccatgtgcttgagagaatcagtaaagcgttaggtaaaaatcccaagtgcagctttaggataacaccatttaatgaacaatactggataacattaagtactattatcactttaaaattcaaacaatcttccaaacatcaatacatacacagttagtttaaaatcacagacaaatcggacttgagggtaaaagtgaaatcctcacctcttgcccatgtttgactttgggatggaattcagcaaagctctcccactgcagattgggagaatcaggtatttctcccacatggggggctgccagggaaggaggaccctatagggtggccagcaaggggccactggcggtaggtcaggaagcctgagatctagggttcaatgtgtttataagttctgtgattttcatgacccgggggtggggggttgggttatgatgaactgtgtgaggaaggagagccagttaacttttggggaggtctatgtcatttgtgcaaatcatacggagcatttcattcgttgtggaggtgcgctgagctggcaaaatgcgaattctaagaacaccttcatttacatgtcgactgctgcttgaaagcagtcacttgctatttcactaaggtttttgaaagcttagtttaacatatgataccataacttctttaggctgacttttgtggaaggatgtcaagtatcattttgttctggatatgggagggaaagtagaggtatttcacagacactcagcggagcagggccaagccagtgttctcctccgctgatgcacatcaaatacatgtaaggacagagctcgctgtgatggggagtctcgtcggtccctttggcattcttagagttcagaagctaagtctgtacaaactgggatgactgaaaaagaccatgagctggtgccccatgggcacacaaggagggaaaaccgtggccgctttctcacggatgctttccctttcacttcccccacttctcactccctgcaccagaacccactgactttaagcaaacagacaggcctgcacaccaagccaggccaaagggtccgggcagctgatgggggaatcgttgcctgtgtagcaagcagaaaaggtgatgacttttgttcatttctgggaggacagattgtgtgacctcaggattatccacttcttcctaagtttctaaaaagaagtgaaataattaagacctaaaaagcaaattcatcatggtggaagtcgttctagccttgggaaaaagcatcttctatggagaaaatgtgaggaataccctgtgggcactatggaaacaggtattcagtccgacttgctccttttatgttttgtggttctctaagaaaaaaaaaatccacatggattaaagcttgtgaaacaagtttatattttaaggtctgaaaacaatcagaccaagctaaggagttatttttcagaacgcagcacattttttctttatttttttttttttagttgggtacgagaatcgagatggagggggaacaaaacccaacaaaataacatcttcttagggaaaacctggctgtggccagcgggcacctcctgaagccctgcttgctgcagaggcgccgctcttcagtgatgcagggtgaggggctgagcggcgcctcctcccatctagtctgcttgggggccgccagggagcatcttcaacacccttacaggacaatgaaggacccgtgtgttccctctgccggctggactgggcgtcgatcctgctgcccggaacctctcactcgattttactcaatgaagtagagcacagcatggcctaaatgccccacacccgccctgtgtgcacacccaggggaatacggatcagtgtgaaaaaacagatctgtgcaacagagacacaaaacgcaacacaaagccacagcatctacaaagtgcatcgctcctgtccacgctgatctccgctgccctcccacctgtgcctctgcccctcagtctgctgggtggggcctgtgtctccctccagcctccagctggactgagaaggtttgggtgggaagccacagagctccatttctccaattcacagtttctccacagaccagaaaaatcgaagtgaacacagcaaaaccacagctttaggtgagcacacaggaagccgacacagggctgagcaggtgcgagaacccacgactccctgcaaagcctccagatagctgtgtggccacgggagctggggacagacggcagcccagtgcgcttggccccccggggaaagccgagactggaggtggacacaggctcctccgagaggcacccccttccatcctggtgacacggagctctcaaggcaaagatccagcctgccttcctctcgtctgggctcttactcctcatttgaatctgggacagaggaaaggatgggctacccagcacctcaggcaaaaactgaagggcgaggaggaaacggctctttggattattttgggcagaaccaggcatctcctcctggacgccacagtgccaaccccgtcatccagcccgtggggagccccgggatgccaggtcaccccagccctctggggccctgcaaccaccaatggctgcgccctcgcactgccactttcccaccgggtacctgggacgtgggtgtcgggagtctgaccaaaccgaccggcttcataattggaaaacagatctctcggcagaaacagaagccatgtatgagaggacccgcgggctctgaaagaagcccccggcctcgcacgggcacgcgaggtgaaggggcgcatttggtttcgcttgggagaaaagagagcgggcggggaggctggcgcagtgaggcttggagaagcccccaggtcaggaccctctccggggctgaaaaagaaaacacggacacggcgagggcgggcgccgcctccctgctggacttgtggtcactctgggtgccagacgggctccgaggccggggtctgtgagcccacgaggatgctggcaggggacgctggggccagggtcccacccgctacagccgcgtggacgtgagtctcttcatgcctctgcgctgagccaggttggatgacagcacgggctccagccgcggggcctgaggtgttctgtttagagcaaagtaggtggcggccatcgcgccctgcaaaacagaagacaagggtgagagccgcggcgcctcactccaggggttgagccggagcccggggcctccatgggcctcagctgcccccaggcaacgtgggagaaaccagagcttccccagggtccctggagcatggagtgctgttagcctgccgccaggggccagcacacgtgggccccaggagacaggggccctgtctcctgcacctgccccccccaccccatgccaccctggcactgtgcttgtgccttgggggaaaatgttttggacgcttgtggagcccccaggctgaggtcacgtgatcccctgcattctgacagtgaggccaggtctgttttggggctcgctgggtcctaggggacacagcgaatgccagggccagtcaccctggactttggccactgttgaggagtctggactcatttggaggaacaggcatatcctggagtgaatccaaattctcagaatggatctggagggggcggctcttaactggatcatgcctattcctgctggggtgggacagtctacacttttcagaaaaggagtcccacccagaggatggggtgcctgagaggctactgctgcctgaatgtaagtcacttatgaaggggactttttttgcatgtgtggcctagaatagaggctttgaacttgagtggaacagccacaccagctgccaccacgtcagcagaggctgccacctactcaggtaggagccctgtgcaatactgcacgtgtctggtgaagtgcacgaaggtaggtgggccggcggtgcagtttggggctgctatgggctctttctctgcactctgtggtttcttcggagtgattgcaaggtatcaggctcttttctgggtttcccattcccaccactctgtcctcactgtcgcctgccggtaccttcaccaggtgcacgtcctgtcggctgagctggtttggggacaggtactctctgttgaccacccacgggtgtttgagcacttgcatcgccgtcaggcgctgatgagggtccacgtggagcatcttggacacgacgtcctgccagggaaggtcatgagagtcggggggatggttggatcatttgtgctgggtcagagagcctccccagcagaactcctctccctctatggcaacacccaaccactatgctgagtgtgggtctttgcattttggggtcatgttcactttcaggtttagaagtatgtcaatggtttttagctttaaatattaccaaacttggaagttcactgaaggtttatcttttattaaatatttcatgtctaaaaagttaaatgtggaaatattagatgatgcatgtaaatcgatgaaacactgtttcttgtaacaattatatctttccaaagggaaaagctgaaataattaatattccacaggtagaaatcaattcataatgatgcacatacttacattttttatcaggactacccataaatatttactacaaataatcagaaaccgcaaaatctacaatctggagccatcagatatgtccagtgggttcatgtgcaataatggtatttttccatttcattgtaaagtcgtagcagtaaaaacctctaaaacaagattctacatgtgtgtacacatgcacatacaatacagtgcacattctattacagtgaattacatttgcagagtacttggttacagtgtgaattacatttgcggacaaacctgatgcttctgctctaatcaccataatcatccttgaggtaaatggggcaaatattacttttcctaatttgcagatgaagacattactgcctgaggaagatccaagatgagaatccatattctctccactagcctaccctccttccttagtgttcccaccacatttgaagaggtaataaaatgaattagaatgcggctgggcgcgttggctcatgcctgtaatcctagcactctgggaggctgaggcaggtggatcacttgaggttaggagtttgagaccagcctggccaacatggtgaaaccccgtctcttctaaaaatacaaaaatgagctgggtgtggtggcatgcgcctataatcccagctacctggggggctgaggcaggagaatcacttgagcccaggaggcagaggttggagtgagctgagattgcaccattgcactccagagtgggttacatggcaagagtccatctcaaacaaacaaacaaacaaaaaagaatgcatatagaatgtgaagttgaattactcattagaattttgggtcatgaaacaactaagaaatactatgcacaataacaatatcttttttatacagaaaaatctaatgccttttgatatttgataacattgaccttggtaatttcttgaaacaagtatctcctagaaaaatgagtgttgtcattttcaggtgtaaaaacaaaagcctttagggctttaataactcttttcacgatcttatagtcatgacactgagagaagcagtatttttacttcatacctgtaggatgtggagaaagacatactaatttgtagctttgctggtgtttggaggactggaggttctgttgtgtgctaagtaagagaaaggaagaggcacaggggaaagacgggggatgtggtggtggtagggactggtggtgaagggcaggaagggttggtgaggccctgtgaggcggcagagacctctgcctgcagcagcgatcttgacaatgtgcccttgtccttgactttgctccttttccaacaccttctccctgctcccatgccagcttccaagatggccttccagacacaccaccagcacccacgtcctagtctgaggctctattttgggaaccagaactaagacatctacactcatttaagacaaagtgagggtgtggacaggagcatttggactgtcagggtctgacatctgggatatgctcactaaatgccagctgccatcacctctgccaccacctccaccatcacccttaccatcattcctccatcacccccaccataatcttcaccatcacctccacaatcatcctcaccgtccttcctccatcacccccaccattaccctcaccacaatcaccttcaccatcatcttcaccatctccaccatcatcctcaccatcctcctccatcacccccaccattacgctcaccatcatcttcaccacctccaccatcatcctcaccatctccaccatcaccctcaccatccttcctccatcacctccaccatccaccctcaccatccttcatcacccccaccatcaccctcaccatcatcttcaccaccacctccaccatcaccctcgccatcctttctccatcaaccctaccatcaccctcgccatcatcttcaccaccacctccaccatcaccctcaccattttttctctgtcacctctgccgtcacccttgccatccctcctccatcacctctaccatcaccctccaccatcatctctgccattaccttccattatcttcaccatcacctccactatcatctctgccattaccctcattagcctcaccatcatccccatcacctccaccattacctccacaatcactaccatcatctctcactatcatctcccaccactcccaccgtcacctccatgatcactgccaccacctctgccacttttgccatcccttcatcacctccatcatttcctaccatcacctccaaaatgatcacctccacgatcactcccgccacctctgccaccacttctgtcatccctccaccatcagctccatccctgctcccaccattacctccaccatcagctccatccctgctcccaccattacctccaccatcatctccacaatcgtcacctccaccatccctccacaatcacctccatcatcactcctgccattatctccaccatcatttccacaatcattccctccaccatgccttcaccatcacctccatcatcgctgtcgccacctctgccaccacttctgccatccctacaccatcacctccatcatcattcccgccattacctccaccatcatctctacaatcatcacctccacgctcactgcatgaagttgcactgagatgtcaacagcagaattggaatcagagcccctgactccttctctttcagcccttttacatgaacacgggaacagctgttggtgctgcttaccagtggctggattatgatttactattggattagagaggaatttgatgatgccaagtaaaaaagcgtctgatgggcaaacgaaataaggccggtcataaactgtgtggactgcagacaaggccaaattcaaagtattttacaagaacagaagtatacctctggacaagagctctacttgtttgtttggtttatgaacatgcagggcaatcattctgcaatatcactaaaagcatggtggttaattttatatgtcatcatggctgggttatgttacccagtctagaggttgctgtgaaggtgtttttcaggatgtggttaacacttaagtcagtcgacttgagtaaagcagttaccctgcacaatgtgggtcagcctcatccaatcagtggaaggcctccttaggaaaaagactgctcccctgaggaagagggaattctgtggcagatagcctgtggtgggcaactgccccatccatttctccttggggctccagcctgccggctgccctgcagtcacagacttccccgtccccacaatcacgtgagccaatttcttacaaataaatctctctctctatacacacacacacacacacacacacacacacacgcacgcatgttctgtttgtttctttggagaaccctgcataagataccaagatagtggaaaatgtgaaaatgctaaaaatgtttttgaaaataatgtttttagatgaaaggcttaaaagatgccgaggataaggccaggtgtggtggctcatacctgtaatcccagcaatttgggaggctgaggtgggtggatcacttgaggtcaggagttcaagaccagcctggccaacatggtgaaacaaaaaagttttagtacaaaacttttttgtactaaaaatacaaaagagttagtcgggtgtggtcgcacacgcctgtagtcccagctacttgggaggctgagacaggagaattacttgaacccaggaggcagaggctgcagtgagccaagattgtgccactgcactccagcctgggtgagacagagcgagactccatttcaagaaaaaaaaaaaaatatgctgaggataaaatacctatactacttacataaaacctatcccctggcttcctcagaaatcatatggctatttcagaatctgaatatttaaaagcaacgctgggacatgtactcactttagctgcgtcagatatcgagtcccagtttcccccagaaagggcatacttcccactgccgatccgcgccagaatctcctcaggggtatcgtctggcccatttgcaaaaggggtaaatctgtataattagacaaatttgtggtaatgagcttgtattttacaacctaaaataaagtttgcaagttgatatcaccccttggctgttcaaaggaatagcactttgcttctccctcctctgctctgaagccaggattcatgggaaagcggaacttacctctaacactatgcccgttttccttccttagcaattgggtggctagaggttgatgggcaagtgggagagccctgtgagacctgtgctgtatcccctccggacccaggtaaactgggatggggtggcctagtgagttgcctggtgccgtggtttccacggtgatggtgtggcatcatgcgagagagcctgagacgtggagtctgagagacccacggtggatgtattcccaactctgtgttctttgacaagttaactttttgagcctccactgcaaatgcagagtgtatgcacaaatacacatacatgcttggtgcagctctggccatattccaagcgcgtgggaggtgttcatggtgtcccaccttaaaacacacccacacactcctaggaaaggaaggacacgtgtgctgccagcgcttcctctagtgggaaagtgtgtgatctagttttccgtataggcaaagtgagtattagaagcgtcacaaagtaacctgactgtggtattggtaagaaactgaggttccttcctttgctactgcagtcctcagggtgcggcttcagggcctgatttactctccttctgctgtggacactacctgttgacttatgatgaaataagtgaaaagcaggccaagctcattcattctcatgagggcattcaagccattttgctacagcaaacaggattcgatggtctagggttcttttctttttgcctccattcaagtatttaataaacgtaataggaaccagcggatcttgtaagatcctagaccttcctgcctagaagcaaccatggtgtgtcctcttctcactcaggggagagggaagggaggctggtacaggttaaagtgtttagcccagagtcacggctagtggcgagtggggctcagatggaagtcagctgtctggatggcaggcccaggccactttctgtaacaccacgtgtcttaccacaatgaaccggcccgtgcatgactcatgaccacgaaacccaggtacagatgctgtttgaccctgaagctgctatggggctttcggtttaagaggatgtctggaaggcacatctgttgctaccttttaaaacagtggcaggtgcagcagagagaatggggactatgctggcaaaagacttgatgttttgttcatgagctgagtttaaagaaaatgggtggctacatttcttgtccttgttgttcagttgtcctgaggggctaagaaagtctgcgagtgttcactcaaggcctgggagtgtttgcatacacgttgggtttgcccacatgcgcacactaggacagggctggccctggtcccctgacagatcagccactgaggctgctgccctgtgtctcctcctgacacctgtttgaggtgactgcttaccctgccagcatggtgtacaacaggatccccaaactccagatgtcacacgccgcatcatagccttgacgcttcaggacctaggagggaacgacaggacaccggcacgcccttcactaaggacattcagattgacagcacgtttctccagcggcatcctacgccggcaagctggggaccaggaggagggcggtgccatgtcttcggtgtgaccactgtttcttaaggcaaagccaaccctaaggtactgcagtgggactcctcccaggccagccacatggtaaactagtactctttccagacacatgacagacaggctgaaaaggagggccttaatttttaaggcagaaggatttttctgttacggtaaaatatgtatgacataaaattgaccatcaaagccctttttaagtgcacagtttagcagcattaagcccatttacattgtggtgccaacatcaccaccatccatccacagagcatttcaccttcccaaactgaaactctgtccccattaaacaacaactccctgtcccccagcccccaacacctacccttctactgtccgtctgtgtgaatctgactcctccagggacctcataggagtggaattatgcaatgtttgtctttctgtgactggcccatttcacttagtataacaccctaagcttcctccaggggtcagaagttccttccttctgcaggctggacaatgttccgctgtgtgtgcatgccacgttttgcttacccattcatccaccgagggacactctcgtggcttccaccttttggctgttgtgaatagtgctgctatgaacatgggtggacacatgtctctttgcgtccctgccttcaattcttttgggtatatacccagaagttccattctgggctacgtgataacatttaatttttttgaagaactgttaaagcagcaaaacttgtatgcatcctaggattacatacttcagtagagggcaatcctctgatatagttacagttgaataacaacaaaggaagccacaatggtgctcatggattactgcagatgactggatttagcattaaatatcgagtcgggagagctcggctcaatttccttagagatgagagcaaggagcctgtccttttctctgtatcgctgctaccatgtgtgagcctgcaccatggaggggaccagccagcgcatgctgaatgaatgtggtgctcatggtgcaagcctcacttcctaatccatcagcggggtgaccttcagaagtcacttacacacatggagcttgtgctttctgactctgtgaaacatggttaatagattttaccctgcctactttgtatggtggatgagagtgaaagtaaaaaaagttggtaaaagtgctttgtaaatggcaaaggaatatcacaacctagggcattctacaatcaataaaatcaatattgtgggagaccagaatatgccaccccaaaatatgctgcataggcgtgaggggcgctgagctgaagatacataagaagcagcagatgcaggagagctctgtgtcctccatttgtctaaaatcaggacatggattaagacaaaaggtacctacccccaaccagagaggacaaaggcttcccctagggacagctttggatgcatgtggtcccacctgggaccagcctccataggccagccctgcacctccccaagctgcagcccctggagaccctaaccctcttcctttgtcttgccaggtctctaaaaattctctgttctttgttgcagataccatgtaggctggattcaaagccacctctgtgaggatgactccttctctgggcatctcgcatgcataaatgagaagatgtgtgttaataaacttctttttctcttgttaatctgtcttttgttacaggggtctggtccagctaagaacttatgagggatgaggaaaacgtcattttcctcccccataatattatcaatattaatattgattaagtaaggcatgaacagaggcttataacctggttactttcattttttttagtttttattttttgagacggagtcctgctctttcaaccaggctggagtgcagtggcgtgatctcggctcactgcaacctccacttcccgggttcaagcgattctcctgcctcagcctcctgagtagctgggactgtgggcacacaccaccacacctggctaatttttgtatttttagtagagacggggtttcaccatgttggccaggctggtctccaactcctgacctcaggtgatccacctgcctcggcctcccaaagtgctgggattacaggcgtgagccaccgcacccagccaaacttggttatttttaaaggggccacaggttgctcaagtgtctggatgacccctgcataacctaaaacagcctctcagtccagcccctggctgcacatccgttcacgtctcagcacgcagaagcatctttgcaatggaccagtggccctgggtgacctcttaaacaactccaagacccacagtgagatgccaggcgcctcagacctggctgctcgcttgactcccctcccatcggagcagctctggtccagttccatcaagaacccacgggatccacacagactctgaagtccgccttccttcccagttccctcctcccctgtcccattggcaacatcagccacagcccttcccttcctctctttaccactggcttttctcaaaggcaagaaattgggcttagatttataaacacatccttgaattcagaacctaatggaacttgttcccgggaaatgtgaaaagagagaagttcaccaggtgcctgctagctgctccgagcggggctgggagcagacacagacactgaacaacgtaagctttcagtggcaaatcaccccggagccctgcggttctcaatctgacagctgctgacttgctgctgtcggggaaccaatctggagtgagaattggggtgcagagaaaatccgtaaacttagttgctccctgcgctatgacggatccatttcccatcccaggtgaaccgcagctctgcgtcctggttgtataaggagactactgcatcatctctctaacttggaataaatatgcagatttcatccaaattgtctacagaagacaattttacataaaaatgttactgttgaaaagttttttcaaatgggaaaatgagaatgataagaacaactacgtttaagcaagattggcccctggctcaagagactgaaggttctcgtttctgtttcccaacaccactgctgacgcagctcaagccgcctctgacatccccgctgtccggtggctctgcagtgggagggggcagagcctgtctttgcggatagagaggcctgggtctgcagtcggggaatgctcacctccggggccacgaaattggccgtgtagcagggtgtcatgagcagcccgttccccgcgcgcagctgcttggcaaagccgaagtcgcagactcggatggattctgggctccccgactcatccctgtacaggatgttactcggcttcaggtctcgatgaacaacctgcaagacagaaggcacagtgcctacttgggggctgaggactgagcaggagagggagggcaggtgcatttggaggggagggtgcatttgggaactgtcttcctagcaggtcctgcaagcaggcaacaggccaacagtgtcaacagctgctgtcttctccagagggccccccaccttctcccattctcctgtggtggtcactcacttctgagctcctggtgtcacctgcttttacagtgaatgaatatttgagtaaataagtgagcacctctccaagttgaggccgcagcttactggagctgtcacataaaaggaaatgtggtgagctctggagataggaatgaaaagcattttaaagatgatattcattcaataactactccctgtgtgcccacccccatgcactgtgaggtgttggagcagcaccagtgagcagcacagatcaggcacctgctgtcctgggtgcagcaactcgttggggagacggaccagggccacgcgatcatgcagtcactctgcaatcatgctctgaggcctcccatggaggactgcgctggctgcaatgatggtggggccagcacacctcaaagcaaagcagctatttagggcacaaagcaatgtgttctgaggggacagagggccattgtgaggacgtgtggcgtgcctttgtacagcttggatcctgaacatctcaattgtcctaatgaaatccagtgggaggatgtagaagggaattaaagggacacactccagcagtcaggcctggtttacagaggtcctgatggcaaggcaatcaaagactgtggctttacttccattacctcccctcattaaatacaagcagatctgcagaaaacatcatccaaagggcttcccctgagtttgactgtactgggaaaacctggaagtaagtgcttaatgctcaagactgggtgaccacacagaaaagaccccagtgtgtggtcctggaagaatattcccgtttggagatgactgcattctgaaaactcaggactacgcacacagctggctaagacagtatttcctgcttcaggagaaacactgggaagagatggcgcacagaggaaacatgtgatacggtgcagctgcctccctgtgaggccagggctgggaccaagagcactgcctggaaccagagagtgggagtccaaccccactggccacctactcatgtgtgaccttggccaagatactcaaactcctgtgcccctcgcctgcacagtgggtgtgatctagggttagggagtcagtgaatgaagagcttgaagtgcagcctggatcacggtgaggcccacgtgaacctcaggcatcaccgtcatccctgcctcagcgtccctgcgctccggttaatgaattctttacccgttgcaagtaacgaaaattcttaatttcttttgattaaggccaaagtatttttttggctaaagttggtaaaaatgattttagaccctcaaagggtagcagagtcagccaccccaaaatatgctgctttggcataaggattatttggagctgaaaacaactgaaaagatgcagatataagcaaagctctctgccctccccttctttacctaaaaggaggatataaatgggtaaaggtgtccctcctgtcctctctgcctggaaggatggaagggaaactcctctagatgcttacagcctggagaagcttccagaataatctctataacaaatgttcctaactagccctcatcttctgttagtttcccatagacttagcttcccacagtctgctgccttagaaacacagtcctttttctttgtcttctttaaaaattattattctttttaaaatttaaaaaattttaaaatttgagctcttttagggctcctgaaggaagcactaaacatggaaaggaacaacaggtaccagccactgcaaaataatgccaaaatgtaaagaccatcgagactaggaagaaaccgcatcaactaatgagcaaaataaccagctaacatcgtaatgacaggatcaaattcacacataacaatattacctttaaatgtaaatggactaaatgctccaattaaaagacacagactggcaaattggatagagtgtcaagacccatcagtgtgctgtattcaggaaacgcatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgaatcacctacaaagagacttagactcccacacaataataatgggagactttaacaccccactgtcaacattagacagatcaacgagacagaaagttaacagggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaagagaaattataacaaactatctctcagaccacagtgcaatcaaactagaactcaggattaagaaactcactcaaaacctctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaaggaggaaagatccaaaattgacactctaacatcacaattaaaagaactagaaaagcaagagcaaacacattcaaaagctagcagaaggcaagaaataactaaaatcagagcagaactgaaggaatagagacacaaaaagcccttcaaaaaattaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaacagcttaccaaccaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcatatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatcgatgacaaacccacagccaatatcatactgaatgagcaaaaactggaagcattccctttgaaaactggcacaagacagggatgccctctctcatcactcctattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctctttaagctgataagcaacttcagcaaagtctcaggatacaaaatcaatgtacaaaaatcacaagcattcttatacaccaataacagacaaccagagagccaaatcatgagtgaactcccattcacaattgcttcaaagagaataaaatacctaggaatccaacttacaagggacgtgaaggacctcttcaaggagaactacaaaccactgctcaatgaaataaaaggatacaaacaaatggaagaacattccatgctcatgggtaggaagaatcaatatcgtgaaaatggccatactgcccaagctaatttatagattcaatgccatcccgatcaagctaccaatgactttcttcacagaattggaaaaaactactttaaagttcatatggaaccaaaaaagagccgcccgcatcgccaagtcaatcctaagccaaaagaacaaagcttgaggcatcacactacctgacttcaaactatactacaaggctacagtaaccaaaacagcatggtactggtaccaaaacagagatatagatcaatggaacagaacagagccctcagaaataacgccgcttatctacaactatctgatctttgacaaacctgagaaaaacaagcaatggggaaagggttccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaaatcaaaaccacttttcattaaaaagttaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgttcaacaatgatagactggattaagaaaatgtggcacatgtacaccatggaatactatgcagccataaaaaatgatgagttcatgtcctttgtagggacatggatgaaattggagatcatcattctcagtaaaccgtcgcaaggacaaaaaaccaaacactgcatgttctcactcatacgtgggaattgaacaatgagaacacatggacacaggaagggaaacatcatactctggggactgttgtggggtggggggagggggggagggatagcattaggagatatacctaatgctaaatgacgagttaatgggtgcagcacaccagcatggcacatgtatacatatgtaactaacctgcacattgtgcacatgtacctaaaacttaaagtataataataataaaattaaaaaaaaatttttaaatttgagacagagttttgctctgtcgcccacgctgaagtgcagtggcgtgatcttggctcattgcaacctctgcctcccaggttgaagcgattctcatgcctctgtctcctgagtagctgggattacaggtgtgtgccaccaagcctggctaatttttgtattttcagtagagatggggttttgccatgttggccaggctggtctcaaattcttgacctcaggtgatccacctgcatcagcctcccaaagtgctgggattacacgtatgagccactgcatccagcaaaattattgttcttttgttaaaatgctatataagctcaagttctaacaactccttggagttattcatggctgggtgctcccgtgtgtatgtgagatgcacatgttaataaacttctgtttttctcttgttaacctgtctttggccagtcttgtttatagggcctccaccgaagaactaagatgggcagagggaaaaaagaatttttcttttctttttttttttttgagatggagtctcgtcctgtcacgcaggctggagtgcaatggtgctatctcagctcactgcaacctccgcctcctgggttgaaataattctcctgcctcagcctcccgagtagctaggattgcaggtgtgtgccatcatgcccagctaattttttttttgttgttgttatttttagtagagacagggtttcaccatgttggctaggctggtcgcgaactcctgacctcgtgatctgcccgccttggcctctcaaagtgctgggattacaggtgtgagccactgcacccggctgggaagagaatttttcttcccttgcaccgtcactgagcctccagacacaagagagacgatggtggcacggaaggaattccaggacaatccgcgttctcagctcttgaacccataaacccttgtggttttggttcctgccctgaagctccctcctccccgaaggctgccccaggcatggctcctaccccctgggaatggaggtagtccatggtcttggtgatggtgcacaggacgtcactggcttcgcgctccgagaagtatctctgccggaggatgcggtccaggagctccccaccacgcatcagctccattaccaggtacacaaacttgccatcatcatagacctgcggagtggagaaggggcgcacacgtcaccacggctggttgctgtgaaagagcaactactccagaggggacaggagagggaagtcagaggggagaggctgggaccacagggtcctatgggagtgcaaacaaggcttctgcagggtagaagcaaatggccattcctgtcataccatatgtgctctttttaggaagaaaacggctttaataatctgctgctaagcagggactgagtaaggacatacaagatgggcgtgtccttagctgagatgaatggcttcatgactctgccaggagatatttgttatttatttattattattattttttgagatggagtctcgctctgtcacccaggctgaagtgcagtggcgccatctcagctcactgcaacctccagctcctcctgggttcaagcgattctcctgccttagcctcccgagtagctgggattataggtgcacgtcaccatgcccagctaatttttgtatttttagtagagacagggtttcaccatgttggccaagctggactcaaactcctggcctcaagtgatccgcctgcctcagcctcccaaagtgctgggattacaggcgtgagccatagtgcctggcctgccaggagatatttagacgttaagaaatgcaaatgttggcaaaccaccttgcaagagcagggcctcaaggcagtgcttttcaaactgtaacgtgcatccaatccaatcttggggatcttgctaaaatgcatgttctggtcctgcagactgaggtggggcctggccctccgcatttctaaccagtttcccatgatgtctgtgctgctaccgcatggacagcactgagtggccaggcgctgggagcacagagaggctaggcagagtccagggcgaagttacatatcagagccgtgctgttgcttcagagaagcaatagaaaaagatagttttctccatactggcttttatctcataaactaaataaaaacaatatgctctgattattctttttatgtttcgattttttgagatggagtctctctcagttgcccaggctggagtgcaatggtgtaatctcggttcagtgcaacctccacctcccaggttcaagcaattctcctgcctcagcctccggagtagctgggattacaggtgtgcgccaccacacccggctaattttgtatttttagtagagatggggtttcaccatgttgaccaggctggtctcaaagtgatctgccttcaggagacctcaagtgatctgcctgcctacgcctcccaaagtgctgggattacaggtgtgagccaccgcacccggcctgttcgggctattcttatgccaagcttgcatgttaagaccgtttgcacgcagcagtcactatgcatgagggaaactgaggtaggcccaatatcctgtgactctaggttcataatgctagaatcagtttggagttggagcgtgaggaggaaaattgtctcctgtctgtgctcccggatcccaaaccctgcacccccatgggcctctatgagagactccgcctgtggactgtaattcacacaagctctctcttcctctgttttacttgctccctccatgactggggcggtggctgtcaaaaagacttgagtacacagtccagcaagtcagctccaagtgactgagatatgtgggtggtggaaaccagctgagacaggcatgagatgtgagaaagcttgctctgagtgaatgggagttttgtgtcagttgaagaaacagaaggaagtggagatgctgttgcacggggaccactcacatccttgagggtgatgatgttcgggtgctggccgtaccgcaggaggatctcaatctcttccgaggggtctctcttgctcttatcaatgatctggaacaaacacagcacatggcagtgaggggtctactttaggctttcgggtggtatctgctggtggaccattgagtttggataaagtctggccccaggtggcccaatcactacaatctcacacccgaccaagagataacctgagattgtctggagattcatggcaagtcctttctttgacaactagtgtaagatttacatctacaaagaggagtacaggctgggcaaggtggctcatgcctgtaatcccagcactttgggaggccggggtgggcaggtggcttgaggtcaggagtttaagaccagccagcttggctaacatgacaaaacctggtctctactaaaaatacaaatattagccagacatggtggtgtgtgcctgtaatcccagctactcaggaggctgaggcatgagaatcacttgaacctgggaggcagaggttgcagggagctgagataatgccactgcactccagcctgggtgacagagcgagactctgtctcaaaaaaaaaaaaaaaaaaggagtacaagacttcagacatgaattttaaggtgttataaggttgggtggagacacgtgtagggagctcatgcaagtgccaccaaataacagactgtgtcccaccctcgcagtgggcaccatccacaacaagcctccagccactgtgcaccttctgccttgttccgggaattacaaaccagccacaaaatgaggtgaggcgcatggctctcaccaagagatgctggggatggtgcgcaggccagacctgccttgctgtttagacatatgcaagctcccctcccccgcccagcatctgtatccgatgtcttaggataacagataaagttgcttcaaccccatggagacatatggtttctgaggacagggtgttgggatttaagcctaccttggaaacaggaagtcgctgttggtccctggtggctaatccctctggaggtgcctaagtcccgcccttgccgcccctgctgtggggacgggaccagtgggaggagggcaccacactcatgggaaattggcaacatgcaacatgtattttgcaaacaacactcagagcagaagaaaagcgattggaaacaccttcctaaccatgatttgtactattctcacattagttcaacctaattttaaaatagtctctatttggagaccgtgcagtcattttactactagaatatgagggtgacttgcttttaacttctatcatgtcaaagtctctaggcagagctttgcataaaactctatttcgttaattttttttggagacagggtctcactctgttgcctaggttggaatacagtggtacaagcatagttcactgcaacatcaaacccctgggctcaagtgatcctcctgcctcagcctccagaataactaggactacagaggtgtgtgccaccctactcagctaatttttaaattctttgtagagatgatggggtcttgctgtgttgcccaggctggtctctaactcctggcttcaagtgatcctcctgcctcagcctcccaaagtgctgagattacaggcatgagcaactacacctggctatttctttactttagagaaccaaacgcttgggtagcatttgactcactgctcataatctgtcccctggtcacccttcgtccactccccgtcaccgttataaaaactcaccatagtgccagttctcaccccattatagtttcaaaggatgctctgccacggccaccattcagctgtgactgcatcagtggcccatgatctgtgagtcctaatagcctgcgttgtaaacaggcagaagagttagggtccctttctggacatagaatttctctccttctgctgcatttaattctactgaagttttagctaggacactaggactaattctattgccaacataaatgcatcattctcaagtagagacttttaaaacgatcattcaaggaggggtgggggactttccctaacatgccacagcctaagcaggtcctgggaggctggtcctgcactgcttgtagggaagctggctgtcaggtacccaaactcctctgctcctgtctgcctgtgggcatcccgtctatcggggccgggatcctgtctttgcaattagagaaggttaaaatacatttataaatttataaaagaattcagtagaagattttttcgcaaatatgatttcatgataaagggatgtgttcttagcatgaatctgttttatcactctcacagtggaacaagatgcagagtaaacaagaaagtgggagctttttctccaccgccacggaccatcttcaagatacaaggagtaaaaaaggccgacgcgagcaggtgcatcctacgccatcccttgttttaaaaatggagagaagaatgcagatagacgcatccatttccttgtgggtgcataaaataaccctggaaggaaggaggaaacatttaattgccttgccttcctgtgaggaggggaacagggtgcctgggggcccatgggtgggagggaaactttgctgtatccacatgaatttttaaaaattttgaaccacaagaatatattgtctattcaaaatatgaaataaagaattccaaaatttcagcttactattttgtaagctgaaattgcaggacaacgtgactattattttaaagaatctgggactacagatggctgccctctcaaccctagtatctattttatttctatgtgttcttttgttgtgagtcttcagaaaaattctgacttacaatgataagtatttgtaaacagttttcaaagacagattaccttaaactcttgcttactttaaaaactatcttaaattgtaataaaagctagcatgtatgtgcacatgtgaggcacactggatttcaacccatcggagccagtgtcctggtcatttgctagaatctgatacacatttaagcatgcatgttgactttcattacattttcaacatattagttacgcctttcaaaatcatgtaattgcttggtggaacccccaaagcacctctgtcaacaaccaaacaccacacaccagctgttcgctgaggtggcatttggggaaatggaggaaaatgaaagaagctcccaggctgaggtcctgtggggacaggagctcatctggaggagactccaaggggcccacgagtgctgctgtttctcaccacagggtagagccagcggtctttcagcaaacatctggtttgctcctgaggggaagtcacgtttgctgtctcaggcgacaacactgctgtgggtgtgggtggcttggcctgtggccatgtcacttgctggtacttgaatgtgggtgtctgcaggctcagctcccgtggagggctggaaaggtggaggaaggcgttgctcctggggaggccacgtgctgcgtggttggcggcccagccgctgagccagtctgagccccagctgagacctggcctccctgtccactccctgtggggttgcaggagctccctgggcctctctacacctagctttcttcatctgtaaaactagaaaacaccaggcactcctctggctcactgttaagattcaacaaattaatatgaatcgatcccttcatactctccctggtacacagaaagcacttggtacaagtgagttattcctattacagagataaaatagaattaccctgacaccgccaggcaagggactaagcagctgtgacctgccacgtttacagccctgaaatgctgctttcggtcctgtctgaatcctcactgcgagtccgtgccatgaagcagtgtgatgtttaaaactaatgtcagcagtagagcgtgtttcagttaaagccccagaaaaaaaaaaaaaaaaaaacctcagatgtcacaccaactgggtcaacccagaggccttaattaaaggatcgtttgcaaaggagtagagtggctggagggtcactggccggccagcaaggcacagtgtaatgccttgggggcagtcctggctctcaatgccaaagagctgcgcagggtcagtcacaggaccagaaggggctgcatggggtggggaggtgcgccctgacaggggctgtgggcagaaaggcctcggcccgacacttctcttcccactcttgtcctgtggtgtctgtctcgcactagcagaactgcccaggagccagaggcatggaagtggtccctaacagtcagcctcctggcttccttgcctcctggcctcccagcctctgaggcacagggcagcgaggagggtgggtttgcatgggaaatggcgctccccgtcctggaagggaagtcccacagactggggtctctcctgcctcagcctcccgagtagctgggattatagggcacatcctggaagggagtcgtggcgggaataggttctcacacgaccctcctgggctcccgccttcccctgacccgggagaattaatccaaatcaagccaaggctctgagatgaagtggcaaggcagttctgacccagcgtttccgtcccggatgctgtcaggaagtgctggctgcttttccctgtaactttttctgaaaaaaaaattttttttttttgcttttgtttttatttttgcatggagggtgagctatttgagcaaggtaaggctggagagtgctaacgcaggagtgggcagtgaggtgtggctacagtcctggagtacatgacctggatctgctgcgggcagccggggtttggacacactgtttaggagcaccagggagtgggccccaagtgcctgccagcgcacttcttctctatggggtcggtttcttggggttgaccgtgttggtcttactcttattagagcaagctctggtggacggcgttcctcattctgagaataatattgttttataatctttattatgcaacaaaacagggaggccttctcagcaagcgtggtgatgaacaaggcctcccctccaggctgacgctcaaataatgctgacgcgccacggagtaggagtggtgtcgtggggcgggggacaagctcgctcagctttctttttctcatctggcaacagctggttagaaaggactcctacaacctccagagaagggcattctccaggggttggccacccaccacagccggtaaataaactttccatggtgttgccaccgagcaggctgaatatttccaccttccttagagatgctgagtctaggggtctgaatatccacgaagcaattctgggttcaacatggatggcacaccaccatgatcttcctgagcacggacacatgcagccatgtgccaaacaaacactgccattcctgctggccgaaggcgacaacaggagacttcgctgctcttgataacacctttcctcctgctggccgaaggcggcaacaggagacttcaccgctctcgatacacctttctggtctttgcgtttctctaccttccctgtctttcttgtctctctccatcagtggagacaccgtctcccgggacactcagcaacctgagcagatggctttgaggcagtaactacgcgggcagtggcatgagctcacaggcttgcagaacactcccactaggcaggccatttcccttgagttgccgaaaggatcagtatcgtatttgacacaaaggtaggagagcatgtaatcatttgtaaaatttaacagacaccttctcctgtaaaattaatttaaactaatgacagagagaaagaactcctgttttatcctggtagaaaaagttaaaatttccaagctcatcagttctccttctaaaaataagctctattcatgccgaacatctgtcttaattccgtttctttttttggttggcaaattacacacacagtgtgaagatgggcacagaaacaccacgttcttttcaacggtctcacgtgagtacagactggagcctcctcaggaaggctggcccgcgctccaggcctgcgtggtcacgccgcgtcactacagttaacagctgggtgacacatattcttgcacagttctaaggatctcactttatttcttatcagattctgttgctaaagcaaactaaggtactttcaataccataacaacaaaaatttgctaccgaaaagggagagtagctgcatcttaactcatgtgcttctttctaggaaaacccagccccactgagcttgtgcggtcttcttctcctgcacgagctttcagacaattgaagggaaatttacaagtgcaacagtcagtgaacaggcacgtatattggtaccatgtgtttgaagatacaacaggccaagagaaagagccaaaccaactgtaaagctcatttaatttcagattccggagatgcactccactttttggtatagtttctggttctgtcattgacacaattcctaaatggctaagctgtgagctccctggagcaggtttgtgttctcaccttgccctgcgtctgttgcagtaaaagcgtccaattaaaaaaaaaaaattctcaatgaatgaaaaaagtaaccagcttcctgaacaaggggattgctgcagaaagaaatggattccaaaggcacgaagtgctctgttgaagaattatattataaaccccgattttaaaaatttgaatttgaaggaaagctcctgattcatattttttcttgtctttatttttaattaattaattaattaattatttgagatggagtctctctctgtcgcccaggctggagtgcatggcacaatctcggctcactgcaacttctgcctcccaggttcagatgattctcctgcctcagcctcctgagtagttcggattacaggcacgcgccaccatgcctggctaatttttgtatttttagtagagacggggcttcgccatgttggccaggctggtctcgaactcctgacctcaggtgatccaactgccttggcctttcaatgtgctgggattacaggcatgagccaccgtgcccggccatatatttttcttttaatcaacacttagcctttcactaccaaatatttatgctaaatgaagataaggagccccttcattgtgtgctgaaattgagtgagctcctgccatgtgcccgactttgttgaggtgctggaactatagcaaaagcaaagcctttgttgccctggagtggctgccctcacagggccgtgcacacagacagtgaacaacccatgcagggggaacgtgccatagggaagatgatgtgggtgaggggggctgctggctgcaaaagatggaggcggggaactaaaatcagggcatcctgtgggctttgggtgcatatttgtgttctctggttggtcctgacttggaagcagggacagaacttaggaagctgtcagtcattcatcaagtcctggccatgtggggctgactgtcacagaatttatagttcagcttcctgggctgtcactagagatagcaatctggcttcctgcaagcctgacacagctgctggcctcccgagctatgtattgtagataaaggggctggctgcaggtgtgggtcagacttctgtcgggcacccagcctggccaccatctgctgtgtatccactctcagcccccagagcccgcggaaggaaccagccttggggacactggactttagcccagtgagacagatttcagaattctgacatccagagctggaagacaataagctcaggttgttttaagccactagatgtggggtaatgtgttgcattcctaaacaataggaaactagcctgtgttgaaagaccggggagaggtttgcagtgggagagttgagagccaagttttggctggtgggtgggagcctgtgagatgggctcggggacccggtagtgggcagaaggcacatgctacatcttattgctgatgaccgtcctccgccgcatgcctgctgggaggggctgagcatacgagaaacaaaaccataagccaatcacattaagcctttctcgtttcgaaaaagcaaaagtgcagctcgctgccagcgctcatttgattttacataaacatgttcattaaggctgaaacaaatctgattttccatgtgaaaataaaatttaaaaactgttactggagttatttctaaacagaactaatatcagaatcatctgaatcatcagaattgtctattttggaaaaattggattcatcaaatgaatctttggccaacaactgtttgagaacgaagttaacatcccatgtaggaatgctacgttttctaggatttgacattatcagcaatcgattatgactatattttgtaaatggaaatgccactactaaaaacagaatgctatcgatagaatgatgtcctttgtttccaaagttggtatactagagcggtgcaaaaataataataaaagtgagatatttcgcggcaaagttatctcggggcaaacgctgcagccgcaagtgccgccggtgagtattcttggggaaaacgggcaaagggttaaatcatccagaaaggcagcttcccagtgtgtgtttcgaggagatacaaatgcccaaccaattccactgaggagcttctttgattagagaatgcctgtgcagagacacaggctggacagagcatctattctggcaggcgatacagtcattttcccgtcttcgagtctctctcttctggtggaagagaaatttatgccaccgttttcctcagtcatgcaatctgttaccaaagctgccccgtctccttccttgtccatctaaatgttgctttctttcttttctattttctattttatttaactgctcctagtcccggcctctgtgcctgtgaacgctcctttctctgtttccactgtggctgtgaaggcatctacagcctctgcctgtctctgcaccactgctgttcttgagatggttcatgttgctccttcacatagctcaactctcaactgctgtttctctttgcttcaaattttcacatgatttctatgaaaaatgcattttgatccctaaagacaggactggcctggacctctctcttcccaggtttggccacagtggtttgactcagctgcacagccacctctgttccccaagacgggtgcagctaacaccccacgtgatactgggaagccccatggtgaaaccatccactgctttctcaatggcttagaattctttgcaggacctggcactggatcctctggagtgaacttgaacacaagctcccctgagtcctctccttctccggccccgtgcggctcactgcagcgcccagcgttaggccatgggctctttcaagatgtagcttctgcaacaagcccaggtgctgccctgaggacgagcaggctgtgatccacaggagccggggctagtgctgccagtgacctcggagcacagactgaaaacagaggtctacatgaacgcagaccatcctgaatgctgtggggaaggaagctggagcagctgccgggggccgggggccgggaccctggctaggggcctcgcagctgagtgctggaggaaccaggtgcactgtgcctttggaggtgaagttagaggaagcggtccggctgccgctcagcacttacacagctgaaccatggcccacttggtggcagcaggacctttcactggggtacacccagactcataagaccaggagactcaggtgcgattttacatagagctccacttgcacctggcacaccttccccttacagcctagggactttggctatttatcaaacaatggatttttcttgcaggtcccatgacttgagctttccagctattctgaagcccagccttactgcccagccccatctgctctgaatactgcctcattctttcatggtttgggtactctgagatgcatagagcatctggctgaaacagaacactggggctccccgccttatgacgagtgagtctgctggacaggggtcgagagtgtgcactcggggtctgactgcttggacgggaacctgctctctcactgaccggctgcgacttctcgcatatgtgttgaaccgttctgagtttctgttccctcatggggataatgaaaataattacaccgtgggatgctgtgaggattaaatgacttcacacatacagagcgcttatagcagtgcttggcacgtactgagtatgaagtatttactctcgtcatcctcgtaactctcgtcaccatattctatctaacgcctgcagctcctggtctcaggaacttcagttctcgggcagtttcctcttcatatgtgtactgacgttggtgttttgcaaaagagggtcaaggtggcaaaattggcactcgaatgatgtaatgtagttttatgcctattatgacatctataataaataaaaacttcagtcattagtagagatggccaagagctctctcaaggtatgtgtattaagcttatgagaaggggagatactagtgacacaagctaacatttctgtagtgaattagctatgatatgtgtagacagttgacccttgaacaacatgggggttagaggtaccgacccctcaagaagttgaaaatgcacatataacttttgacttcgccaaaacctaactaatgtcccactgttgacttaaagctttaccagtaacataaacggtccattaacacatattttgtatttgtataattatatactgtattaagaataattatacaattatatactgtattaagaatacagtatataattctgtaataatacgatctagaggaaagaaaatgttactaagcaaatcataaggaagagaaaatacatttagtgtatgggactgtatttatggatatagtgagtttatgccatctgttcacaagatggatcgtctgtctgaaaaggggggcactcacagctgcagacctcaacctggggtacgtatcatgcaattcaacttttgttttttttggtcatgtgatgacttttctctgcctcttgggagcactcacagcgtccctagtggcacgggacttcttagtggttctatggtgttattcaaggtttatggaactgcactaaacacggtgaaaaatatgtgagaaccacaagataccattttttactgctattcccaattccctggagagacagactcctcacatggagacgaggagtgtcacaggacgtttaaagcggatccttccaacacctgagcttactacagcagcaatggaaggctgctgtgaaattcttacggtagtgccatattcgccacagttaatttgctgcagctatgatttaatgctgaatctatgtttgtttacatttatctcaactgcaaatggcgccacgtatggtctatgcttgagcacataaattttgatacattttaagtttgtataataaatctgtgtatattttatagtagaaaatgataaaatagactagcatctatgtatattttatgcatcctgacataccattttcttaactttttaaatatttctaggctatgtggtttgtctgtgagtttcttcaaattgtaacaaatctctaaaaaattttccagtatatttactgaaaaaaatctgcatacgtggatcctcacaattcaaccccgtgttgttcaagggccaactgtatatatttacatattcccccaccaatataatgccaggaatccttccatttatacaaatcagcactatctagaatatgtacctaattatgttaagcaacaaagtcctaagaataaaataaaaacaaataattccctctctcaattcttataaagtgaatacagcatctttgatggaataggaatattattttttctttcaaatacacctctccccttccttttaatcctcctggatcacgattacctccaacacttaatagtcacttctattttaatcttattttaaatgaagggtgccctaatgtgcggacagcaatgcagccatccgtcatgctattttgaagccctatacaacttcatcgcccaccactagtctccctgggttggttataaaaacaaaggcggactttagttttccattagattacttagctgttttgtcccaataaaatggcttgtagttattagaaagtagggcacatctgttcacctacaatgtgtctgataaaaggaagaggaagcgctgagggaacataatagcttttctcattcaaccatcagagcactggctgggggcaccggcagaatgcgctgcatcaagtccagcctgaaacagtgccgtgcgcgtgagaaggaagagggtcggtgtcttcccgcccgaggccggactgccccagtgaaggatcttggacgttctagtgttgtttgccgaagtcgagagggagggacaagcctgggaatccaggttgtcattcagcccacgtgaattgagcccctgctctaagctgggcactgtgttggagactgcgatagctagaattggtcttaattttagtcctaattttaggaccgattctagctgtcacttcccacaacctttggcagagtacccagcatatagcagggactcaagttaaaaatgcagctgaaaataaatgcaaagtgaacaatcttgtcgtttgatttactcaggtaaactggtttcagtagaaccttaaatgtagtttacgttattcagggtaattatggtggcaaaattagaaacctgcaaaaatgcagaaataacttaaagcaaaatataatgatattctaagaatgtgagaagtactatgattccatactcactatgaacctccatacctgaccgtcatagaggtgaagagctggccccactctcctcttagaaggacctgcactttaagtcacggcccagtcacagtggggtgggggtggggggctgcccgcagcacgtggggaacactgagctgttggtcggtcatcatcctgttgctaaaggactcaccagaaactcaatgaagaagaaaaactccatccccatctccaaaatatcaacctcctggcctttatctacatgagacctgctctcacccacaaggatgctgaggctgggcttctcaacctttcgttggggcagcaggttgtgggggctgtcctgtgcacacaggatgctaaccagcttccctgacccgtattcaccaatgccaggagcccctgtcccagctggaaaaaccagaaagtctccagacattgccagtgtcccctgggggccacagttaccccaaatgaatatgactgccctgggcagaatccatcgattctggtcactctcctcattgcttactaaagattgctgcatttctctttctgtcattactcggtggggacatttctgggtcatccctgccattgaatgggaggatgccctgtctggctgtgacgggactgcttctgaagcagaccccgtttgtatccatgagccaggggtaggtgggatcgtatacggctcaagcggcaactgggagtggtaaagccggattctagtgacaatctcggctggacatctgctgagctgagatccaactcacacatcagataatcagctgccacatgcttagttctgggtcatgttagaagtcaccgaactttgctgtttcttagtccatcaataggtggggatgctgcttctcatgaacaagtcagcagatacagacaaaggccaaaagtatttcaactacattccacctggaaatgctgaaaacaaaaccgcacagtgctctgcactgggtcaaagcagttttggtaacaagtggacccattctaaataacaagctcgttgcacagaaatgccaattcgtccatcttggaaggaaatccaaacaaccgtgtctacctgcagataattgaacttgttgtcaccgctcccttgaccggctgaaacgtgcttctgaagtggctctggtcacaggagccttctggaccacgagccacatctctctaaaaagtcccgggccgttcatggggctgcaccttcccgtgctcggttaatttatgcatcttccagactacacattattacccactgtagtctcagaagggacaagggaaatccctgccatgtctgctggccaactttgtccagggaacttcagggtttgtgaaagagaaacaggaagaccgggctctttcttctaccatcggccagagccacagtgcctggcttctctccccgagagctgttgctgaaattccacagagtttgacctcaacaagatctttgaggactgacggactgagtttaagctgtgtaacaaagctgaattcagacagtgtccatataagagctggatatgggaatattaggagaaaacacaccatcgcctcgtcactgggggatttacttgcagaggcacaaaatgggggctgatccgcaggctgtttctggaagggcaccgcggctgctgggctgaccaaaccgtaggcttgtttctttgagctcactgggaagcagtgattgtttctgggattgctgtctgtcacctggtaaataatctaaagaaatcctgtgagcaatgactcaggcagaaaaaaattccaaggagcctatgtaggcttacgaagcacatgtgaaatacgtttcaaagtacaagtgaaattctcttgtctaaggcagaatacaggtctgctcttcaccactggaacatctggacacaggaacggcacctgggtatgcagatggtaggcgcccatctaagtgctcctttaaaaaactctcccaatgggatggaggagcaggacaaaccaatctcaacaatccaaatcctagaaacgcatgaagcctacgcgccccaggctgcagaggcaaccacttcataacaaaacttggttttctcctgcccttcacaccacgggtggacattctaccatgacagtaaccctcgctgcagtctccacccaattacagttccaggaactgtaaatcatgatctatttccttccattcacccttcctggatgtgttcaagactctgggcagactaaacacagagatggtatcagagcaaatcacaaattgattatttctccatatttaaactttctttttttgtttgagaaattcaagataaatttgtcaataatccataaattcttgacccaaacaaaatcaagggacctgagattttttttcggctggcgtcttctatgacagcaaagcgttttcccagtgcaagaaacacggtagacgttcccagtgaatatgcttgaggatcccaggccatgcttgaggatctacccttttgaaatacctgttttcacaaaatgtcagtggagctctgggcaaatgaggatggaactgggtcatctcaacattgtcattattttgaacaatctcttcagagtgtaggagaatcacagttgatgaaaattactctttttacacgacttgctggctgggcagatgttctttgaagggcaagcgtagcaccgtgtgctacagacgtgtctgggaataagccgggagggtcctggtcatgatggcaacacaggctgggacctcgctctgcgacagcctggggtttggctccactggaaaggggcagagtttcaagtgtctcttgctgtcttttggagaggatgtacaatgtatctttttttaacataaatttcattctgattttagcaggaagctttacctttaatccacattttactaaccaaaaatctctagaaactggtattctggattcccagatcaaatatttaagcagcaacaattacgaaagctaaagttactatgtagagattgccaaattgggttacaaagaattgtttctctatactgttcttgacggttgggagtaaaaccattagctctctgccaaagtttgttgtaagtaatacaagcttatttatttctttgagtattttcttcctcccttttttctttccttcctttccttgccaaattctatacctgtcccccaactctgttttctcaaaatactgggggcccaaaacttttgctcttggtgtatgtcatacaccaagctacgaaaggtgctcagtccctgcgtggtacatatgactgaaaatattcatgatttgcaaaactaccttttaatgggtgacctcatatcaaagcaaactgaactccatcatatcagagcttggaaaatggcaaatggagagaatgttcactcaggctcaggtgtccctgctggagtcactgcacagctgagcacgtgagcacatatgctgtgctcctatgctccgtgctcccatgtgctgtacatgctcccacacgctgcactcacacagggccctgctatgctcctatgctccgtgctcccacataccacacgtgctcccacgcgctgcactcacacagggccctgctcactcagcaggcctgccttaccttcacggcatactcggtgtctgtggctttatgcacacatcgcttgcacactgagtaggagcccaccccgatgtcctccttgatctcgtagccatcggtgaagtggatgttgttcccgtgtaactgctgcagagggaccaagagaagaagagttgtcggaaccctcacacgaggggacggtgcagctacacgcacacagaatgtggggcgaagagaggcaccgactgtgaactgagtgtgtggaggcctgggagctcatgggtccccctgcccaaggctgcagagctacttagtgatgttcttgacctaaatgccagcttctctgattccttgggctatgactcttaactttgagacaccaggccgttctgtgtccactggctggtatgtttctcgcaaagatctgagagcaggagaatgtgaaagtgaaaaggaagtgctggcagctgctgggtgcgtggctccaatgcctgtgtgcagagcaagactctggatggaaacatctcatcggaaatctgactccatggtgtccaagtcacagcctgctctgacctgcatgcagcagccccacccacccgctcttaactaagacagaaagccaccatggcagcctgcactgtcatgacaacgtctactttacacacctgtatttctccaaaggccagggaaggaaataggatggaaatccaatgccattcaacttacccggatttcattcttaaataagtttaatcataattagaattaagtttaaccccttagaattctctgtattctggttacatttattaggtgggaaactcattatgaaaataccaccttccaaagacctcccaaagattccatttcatcatgggaaaatgatgcccacaaattaaactgctaccctagggtcctggctgggctccacacagtgaagatgctccagtctctggccatagacaccatggtgacattcttcccagggctttaccttccctctttaagacgaatgccaagtagggtaggagcaagggctcagaacaccatggaataccaccacggagaccattacagggaccaccatgggagccaccacggggaccaccatgggaaccaccacagggaccaccacgggacaaccacgaggaccaccatgggaaccaccacgcggaccaccatgggacaaccacgaggaccaccatgggaaccaccatgacagactaccacagggaccaccacaggaaccactacagggaccaccatggagaccaccacagggaccgccatgggaaccaccatggatgtcacctaagggaccaccacaggagccaccatgggaaccaccacagggaccaccgtaggagaccatcatgggtaccaccggggaaccaccatggggaccaacatggagaccaacacagggaccaccatgggaaccaccacagggaccaccagggagaccaccatggggaccaccacaacagggatcaccatgggaggctaccctagggaccaccacaggaaccaccacgggaaccaccacagggaccaccataggagaccatcacgggtaccaccagggaaccaccacggggaccaccatagggaccaccagggggaccaccacagggaccaccatgggaggccaccctaggcaccagcatggggaccacgacagggaccaccacaggagatcaccacagggaccaccacagggaccaccatggggaccaccacaggaaccaccatgaggaccaccatggctaccaccccagggaccaccctgggagaccaccatggggaccaccagagggaccaccccagggaacaccatggggaccaccacaggggaccacccaagggaccaccatgaggaccaacacaggaggccaccatggggaatatccatgggagaccaccacagggaccaccccagggaccaccctgggagaccaccatggggaccaccacagggaccaccacagggaccaccacaagggaccaccccagggaacaccatggggaccaccacaggacaccaccatggggaccaccacagggaccaccacaggaggccaccatgggagtatccatggggaccgtcacagggaccaccactggagaccaccatgggggcccacaatgtgagaccatcacaggaaccacatgaaggagcaccacgtgagatcatcatggggaccgccatgggggataaccacgagggaccaccatggcagacactcagaacaatgggaagtgtgagggaagaattggtgattaaagtccacccatcctaagcacccaacccccgggtgactgaggccacagggaacaccagagtcacccatcatccaagtgccctcttacccccaacccactgcaggcaaacacagttacctgcacgattgggtgaactgggactttgtgcagatcttgctgtgagggctcctggatcaggcttgaggccacaaagctgaatcctctaaacaggtgatgagcgtttgcactcggggggacgccaggagagtctgtaggtgacaggggcagagttcagatgccacgaaagctgggtgaccctggggtgaagtgatagtgtgtgtgtgcatgtggtatgtgtgtgcaagtccgtgtgtgtgtgtgtgtgtgtgtgtgtgcacgtggcgtatgcctgtggtggaggaaaaggtaaaacagacatgtagaaatgctgaaccagatgaaactacattcttttggcttgtgctaatggtttgatttttaaatggcaaaaatacccagaacaaaaacttcaggattatcattgatggcatctgttagtttgccaacttctgaatttactctatattcttgaccacactcctccacccctacccactccagactcagttaagaaggcaccaatgacctcaggatggaattgtcagtgaacatgaatcctgtatccttagcttctggtctctaggttcgacaggtcccacccctgtgcccacagctgcataactgcatgtgtgctgtgcacgtgctctgctctccaaggacatttgggcaacgtttctcctgtccacagcaaggcatagtacgaaaggagtaattcccttccattaagatttttctgatctctgtaagatctgtgttcaaaagcatgactgctgtgagattgatcccatttcaagtttatcattaagaaaaacaaaaggataaatccctcgtggggaaaaaaaatctgcatcatacataacagatgagaggttaaactctctattgcccgaaagctcccagagatcaatgagaaaagagcaaaatactcaaaggaaggaattctgatagctaccataggcatgaaaagatgcccaatctctctaaggagtaagcatacacatatttaaataggacaacacttttgtctaatgaactaacaaaaatgaaagaaatcaatcacatctgggtttggctgggggtggacacttataattgtaggagggagcataactggcataatcttctggaaagtcaactggcaacatttaaagccaactttaaaatttcaaaattaaaaattttgaaagtaattctacagaattactttcaaaagtgcacagtaataacaaattgtagatgacgcaaacaaatggaaaaacatcacatgctcatgaatcagaagaattaatatcatcaaaatgaacatatcacccaaagcaatctacagattcaatgcaatctctatcaaaaaaccaacgtcatttttcacagaattagaaaaaacaatcctaaagttaacatggaaccaacaaagagcctgaatagccaaagcaattttaagcaaaaggaacaaagctagaactagaagcatcacattacctgacttcaattatatcacaaggagatagtaactaaaatagcatggtactggtataaacatagacacacagattaacggaacagaatagaaaacccagaaataaagccacatgcaaagtcaacaaaaactttgtggggaaaagacactcttttcaataaatgataccgggaaaattagttcgtcataagcaaaagaatgaaactggacccctatgtctcaccatatacaaaaatcaactaagagattaaagacttaagtgatgaaagacctgaaacaatgaaaatactagaataaatcctagagaaaactctttaggacatgggtctagcgaaagacttcgaaagtcttttaagggctgggtgcagtggctcacacctgtaatcccagcactttgggaggctgaggcaggtggatcactaggtcaggagttcgagaccagtctggccaacatagtgaaaccctgtctctactaaaaatacaaaaaaaattagccaggtgtggtggtgtacgcctgtaatcccagctgcttgggaggctgaggcaggagaattgcatgaacccgggaggcggaggttgcagtgagccaagatggcgtcactgcactccagcctgggcgacagagtgagactccatcacacacacacacacacacacacacacacacacaaaaaggctttaagaccagcataagaaatcatcaacagaatgaacagacaacctgcagaatgggagaacatatttgcaaactatgcaactgacaggggagtaatatctagaatttacaaggaactcgaacaactcaacaacaacaacaaaacaaataaccccattaaaaattgaccagaggacataagtagacatttttcaaaagaagacatacagatggccaaacagcatataaaaaatgctcaagatcgctaatcatcagataaatacaaatgaaaaccacaatgagatatcaccttacatcagtcagaatggctattactaaaaagtcaaaaaaataacagatgttggtgaggatgtggagaaaggtggtgggaatgtaaattagtacaacctccatgaaaaacagtacggaaatttctcaaagaactaaatggaactatattcgatgcagcaatcccactgctgggcattgcccaaaggaaaagaaatcgttgtctcaaaaagatacccgcacttggaagcttactgcagcactattcacaattgcaaagtcatggaatcaacctaagtgtccatcaacaggtgattgggtaaacaaaatgtggtacatatacgcaatggaatactatttagtcataaaaaagaatgaaatcatgtcttttgcagcaacatggatggaaaagaaggccattattttaagtgaaacaactcacacgtggaaagtcaaacatcgcatgttctcactcataagtgggtgctaaattgctaaataatgtctgcatgtggatgtcgagtgtggtgggatagagaatggagacgtggaagggtgggagaaggtgagggatgagaaattacttaatgggtaaaatgaacactcctcaggtgatggttacactaaaagaccagccctcaccactatgtactctacccatgaacaaaactacatctgtacctctgaaatttacagaaataaaaaataaaacaggctgggcgcggtggatcacacctgtaatctcagcactttgggaggctgaggtgggcagatcacgaggtcaggagttcacgaccagcctaaccaacatggtgaagccctgtctctattaaaaatacaaaaattagccaggcggggtggcgcacgcctgtaatcccagctactcaggaggctgaggcaggagaatcgcttgaacctgggaggtggaggttgcagtgagccaagatcgcaccactgcactctagcctgggtgacagagcgagactctgtctcaaacaaaacaaaacaaaaaaacaagcaaacgaaaaaatcccaaagtacttagacataaatgtagaaaaagtctgtttcagtgatatgtgttacagaaaagaaaaaggagacactaaatactcctcactaagacaatcatggtcatggtcaacagtggcccatctgtatcaggatgctttgtaatgattgcagtgtgagtcctgccagcgagaccagggccatcagaaggagccacagttgcatggactgacagagacgtggcttcctaatcgtttgtcaaatcaaaaaagcaaaaagctgttgaacaatatgaagaacccagacattacttaaaaaattaaatatattttaatatatttaaaaacagaataggataatagattaatatattaaaatagaatatatattacactaaaatagaatactataatacattatataatatgtaaatttataatatatgaaaatataatacgtaatttttcctgaaaacacacatatgtacaaatttaaacattcttatttatatatcttttaagactccctgtatgtatagttgtgtgcatatttgtatattcgagaattctctacccgcaggcctttgtctctcagcacttcttccccccctcgtctgtttaggtgctgtactttgaaaggaagaaagtgcacctagttctcagttttatctccacacggtgcggcaggtgtgtgggggtgggaggcagctgcagagaacacgtgttttgtttcttagcatcatattttggggacaacggttatgagggcagccgctccgaagcccaggagccgggccccacgccgcgtgggcctctggtgcaagcgggggccaggccgtgggcagatggacgacgcagcgtcccactggtgctcttcctggggtaggaagcgtcatggacccgggctcatcttcagtgtcctgaaccaagaggcagctagagccaggtgtcggccctcaaaggggccaaaaaaggggccttcacagtcaccccaggtagatgcccacgcgacccctggactaatgtgaccagagtcggctgtgtttggaaataaacttccaacgctccagactagcgaagcgtcgttaaaaaaccgaaggtaccctgagtggtttttagaaactgaaattctgcagcgcgacccggcagagaagctcggggctttctgagcggctctgcttcgcggcacacggagccgctcgaggaggaggcgctcctgctacacccggtttgctctctgcacaaagtctggctttgaggtctgcctcctcccaaagatcccctgagctaccacgggccgcagattctcccccggaaaaatgaaacacacatggctacatcatggtttaagaaatcttcaaacctggaggcactttgatgtcttcccttagggatttagactcagagcttgagcttattctggggaatccgcagagccacacgagtgtgaagtgctgagcaaggattgggagtccaatttacagcctgtggaggagtgtgtgcgggggtgggggcacaggccatgttaacttgacagacacagtttcattggtgaatggaaaatctgtaattccaataagcaatgtcttctaaccaaccaagaggcacggaagacacagccacaaccttccgtggccagagaacccatgcctctcctcacacagaccaaggagagcctgcggaaagggtaaaagtaacagcaatttaccgaaggccaagtggatcttcaccaaaagttaagaggctgacatttggtcggtgtggctagctagtaaggaaatgacaggtggcctaaatagaatttaaagcactttataatcacctgagggatgccgattttcagcacagtatttaagaagagcaaaattgtgagtcagataaaaggagatgtagaactacagtaattacaaacaacctctcatggtcctgtgggtatttcctgatttgtggagtctgcctgatcggtttaaaatcttagattggcatctcgggctaagcagcatgctctagggggcagccaaggtgtgatcagggaatagaaaccagcttgagcgctggctgaagtttcagaaaagactgaaagcctaactgtaagaaattcccactgtgagtccaggatctaacatagaggatttgtagcttatccattgcttcagagtcacatttctacagctgctcattcacccagccatgtgctcagctcacatgcttagaaaatcctactctcctgtacaaatcagaatgagtttaatgtgtctttagcacttcaattactacctacctcaaaggcaaacagtggtgtgataaattaactgaaactgattggagaactggaaacactaaggaataaaaaaggcaattctgaatagcactggagtgcattgtgtctaattatgttttccttaggctattattaaaatacaatggaattctctagaagctcaaaaaaagcttccggttccactggccaactaggttggggtttaaattcttcacagataagataaaaggcatgtccatatgaatattagagttgactgtattaacattttcttaccaagcagcacaaacatagactttctttccacattttaaacacacagccccacatgttggcacctcacgaggatgtgtgcacgttctgttagggaccttatggtccttgtggacttagggacaacgatctcgtggtcagacctaattgcctctgagctccttttacattcaggccaacaataggtggagaaatatcatgacttgcttgggtgacctgtgggcaggggcaggagggaatccccaaatcctgccccatcttttcaaactcagaaactgaaaagtaatcctgttctgtgaattgggttaagtttgtcaatgggaaggaccaaccccaacacacaaatactttctaaggaagctgagaatggggtgaggtgaaaatcccacagtcacttaccggagagagcagacccagaagtgttctccaaggcagcctcattacatcatgaatcagtgatgaaccaaagctataatgatagttttaattctacctggggactgcaggatgacccaaaagaagtaactgagcagccggtggcatgactccctggtttacagtgcccggaatcagctttcttcctgttcttggtaccaatgtggcctgggtcaggagctggcctaggcccatcaaaagtcccgctaaaagccccgcaaccctccctatctgcacacgctcacaccctcctcaatgtgttcatctgggtatatgggaaacagggatttcaccaacagctgaatctggaggaacaaagtggattctctaacttcatctacctgacattttgtggttgaccatatatttgtttcccgattatcttttaaaaaataagaaaatttcagattcaaaagcagcgagaaaaaatacagtgaatccccgtagatccaagatgcagcctggccaaccaccagctccctggacttgtcccacttatgtctacagaaggagcttgtggatggttttgtacataaccagcatactgttagtgttgtggactgaattatgtccttcccaaattcaaatgttaaggccctacccccaagtgtaactgtatttggagacagggccttgatatggttcagctttgtgtccccacccaaatctcaggctctgtgtccctacccaaatctcatcttggagccctcataattcccatgtgttgtaggagggacctggtgggagatgactgaattatgggggtgggtctttcctgtgctgttctcatgatggtcaatgagtctcatgagatctgagagttttaaaaaggggagtttccctgcacaagctctctctttgttgccatccacgtaagatggggcttgcttctacttgccttctgccacgattgtgaggcttcctcagccatgtggaactgtaaattcactaaacttctttcttttgaaaaattgcccagtctcaggtatgtctttatcagcagtgtgaaaacagactaatacaggcctttaagagaataactgaagttaagtgaggataaaagtgtggggccctaatccaagaggactagtgtccttataagaagacagagagacaccagagctccatcttgctgtctttgcacacacagaagaaaggccacgtggggacacagcaagaacacagctgtctgcaagtcaaggcgagagctctcaccaggaaccaaccctgtcagtaccttgaacttggacttccagcctccagactgtgagaaaataaatgactgttgtttaaaccacacagtctgtagtattttgttatgatagccctatcagaccaggataattaccatatataaaaaagcagactttaattcattaatatcccaaaaagataacttttaaagggagctgaccagttctgatgaaatttgctagaccccaagagtaatttcagacacaccaggagaccaaatctatgcatccaattgctgtgctatttagtagccgatactacttttcaaatgggtttctgttttttgcatgaataatatctatagctcataaatctatagacataactgacagccttccctctccgtaaatgcactttaattgaaagagggattttaattgcctccagtttcttttcttgctcttgctgtgtgtctctctgacacaggaagtaactggaccggtgtcttggaataaggataccttcatcatttccaaggtggaggttatatagggaacaacagagaactggggctatcacttaaacctttatcactgagcagagaaaacaacaacaaaaaacccaaacagaatggacagttattttccatgaaaagaattctgaggcatgggaatttcttgttcctagatatctgtctctaaggggtcaggtgggagaagccaccgatagagggaaccactgtggcacacacctgtgggcgtccgcgctgtgaactcggggtcaaagtggaaggtgtcctcaggcctgcccactgctggtttgaacggtggcttgatctccttccggtacagcgtctattaatacaaggaaagcaagacagggcactgaggatgcacagacattgccacagaacactggggacagagaaacctgctgtggggagggaaggatgttcttatcacagactgcattggccttgtggattacaagggatttctaaatactctgaaatatagatggcataaaatatattatgtgtagtatgatagatactatggcatatataataacgatgtattatagaaaggtatagaaaaggcatagtttgaggtatgagggtttggggacatgccaagtgttcttcattttagggcaatagttttctagcttcttcttggtagtagaatcttcttttccaagtaaaatcatacaggacagccaccacttgcccccactggggacagcagtgaagaggccgtgtggctctctcctccctgccctgggactttggggccagcaccacggaacttcagctctgcggggcactgcaaaaaccgccgacccagagccaccccagggtgctctcttgccagtgtctcagggcctgtgctctggggccttggcacctctgccagaaacctgccttgggtgtcagaatgagggcgcccaggctcctcgacaggaggacgcctgcatctgcagagaaccggcccttcccatgccccctctgggcccaaacttatttccccaacaggaccttggacagaaggcacagaaagtccacagccctctgtgctccggtctcagagctgcctgcctgacaatgctttccaaagctgagatgtgttgttttcaatcctctagggcaacaaggcattctgttgggaattcaatgtaaagaaagcacacacaggtacctggaacctggcgtagtcctcaggcgggtgatgctgcaggtggtgcttagatggagggagccgggggagcccagtgctgagagaagtgtggagggggaggggcactggagggaggactggggcctgaggcctgactggaaggccgagggacctccgggcagattcagtagaggatgctgggtttagtcaaatcaccctgacgacagaaggcacgggccatgccagtgtgctgaggggccagcctggtagttagcagggcagcagcagggcagggccaggctggggtcttgccccccactgagcatggggtttccttaatcctgcctagggagggtccccacggtgttcgcagaaaacatccagcctggagtcctgtcctgggcacttgtgtgtgaccatctagagctcagttctggactcagggaccctcatggccgtgcagctctggaaaatggacacagtgactccagctaaaacctgttctacatctctggaaagcaaatttcaacacctcctccgatgaggcccgacgggaagggagaggagggaggagggcgtctgacatctgggtcccacctggggcacaccctgctctgcttatccgggagcacctgggtcagagcccaggccagaaaccagggcccacagctactgcaggagggcgaggtgccaacagacgcccccgagctcccccgggggcttatcaggcagcaggatgtgccctgatgtgcaagagctcagggcgtgcacgcgggaaccatcggaggagaaacaggattgaattcagccctgaattatttgctcatttcctgccttgggggcatagatttcattagcaccgagttactcttcaagccattttcagaaatgaaaagacgctgctttctgcagtgaggcacaggacaggtgggaataatctccccagacacatgtgcttgcctgaggaagtctcctgagctgggaagcccaggccatcgggtgccacgaacaggccagtgcagcccattccccacccagagagtcctgagagccgggctattaagaatcctgctgaagtcaaaatcacatcctccctctgtgtgagagcaagcgagggagagaggtggagagagagagagagagagatggggagagatggggagagagggggtggggggagaaagagacggaggggaggaggggagaaatgggggagggggaggggaagggggtaagaaagagagagagcacgcactagctcgatccagcacagagccaggcctcctacttttattatgaggaggaatttatttacacaagagatttccattaaaaacaaaataaaatacaaaactggttgtcacgtattcattccagtgtgaagtgtttacctccggaaagcaggggcccacatggcccctctagctcctctcctccgtgccagctcttcctccatcatcctggggacccatcttgcccacccctgcccctgccccaccacagcctctgataaaaccatccccagagcctggtgcccagtgcttcttcatagaggggttttgcccccactgggacatttggcagtgcccaaagacactgctggctgccacacctgtgtgaccgctgcaggctcccaaggggtggaggccagggtgtgcagaacccagccacccataacagccccaccacacagcatcgcgcaggtgccacccagggtgaaggtgggagaccctggccctgcctgcttccttctctacctcacccttcctgccttgtttctgctccaaccctcaaaagtgcaacgtcaaccagcttcttcaagaaggaggactggatgttgaggcgactggccactgtccttggaaccccttcccctccccatggaacccccggtggggcagggctgcaggctctgcctggcttcctacaggccacatccttctccctcctcgtccaccgatggggcaggcaccacagcctcgcttcacagctgtccaggaaagcacaggctctatctgtgaccaccctgcctctggaggctcacatccagaggctgtcaccttcctgccttctaagtcagattcacagcccagcactggtactgctgtgacctcctctgggctgaggccatcccactcctttaatactaagtatctgctgctaagtcaggtcccggttccctccagcccaggacactgcgcctgggggctgggctcagacttcccctgtgctctgccccatctgtgcctagcccggtgctgcgagtcacctgggatgcccagtgaggaggtcctaagcccaggtagtcccgtagcacttttgtaccacacaaatagctccccctcacacggcagcaggaggaagcccgcctctgctttccccgtgctttccacccctcggctgtgagcccaggctttcagctcacagaccccaacaagaccagagggaggcatgcgtgtgagagtggacggagcgcttgctgagggccagggccttccttctgtgccgcgggagccttcaggcaactggccaccccgtaacatgggtccgtgtgccaaccgcagctatgaacacagcctgttcactggggcctgcagaccaccatgccccacctgctggaggctgctgcgttctcactctggtctgggccaggcagtgaggttctgtgcgggccgccggtggccaactggagccggtcactctggccctttggacggcttcctcgaggcttgctgcaatcttaaaggccggtcaatgtcttcctgatgctgcgtaaacatttggaaggtgctaatatgtgttattactgtgtatgctttttctttccatgtgcaaacctaagaacgggtttgaggctttgggggagaagtcatccggcctcttgctttgtatgtaaaccactgtaggcagggttgtgttgagagtgaaacagcagcagcatctcacctgggattctgagcttaacgagacagacactggcaattctgccctggatcccccctttctgagactctgggacaattcatgccgaaaccgacgagagaaaatgcagtctcatgatcaaattcgccaggcacatttaaaatcatctcatttgtcccaggatgtcagaatgacacagtgtggccgcagggctgaaacgaatttcacgggaaacaagcgcacgtgaggaagcccggagcaggcccatcaggattctatttatactaaagaccttcagctaagtgagaagaggaccgagacagcaacagaaaaacgggaactgggtgatgacataggaaacagatgctagtttggggtctcagaccctaacatctgccttctgtagacggttttggcttcaggcattttggaattaatacgctccaataaggcaaagggcacatttatagattattcctaaaataataatgcaaaaatatgcagaccagagagaagacaggatcgaaagcgccgcaggaagaatctaaacgattttcaaagcgtcacgatgggtgtgacaggtcagtggctcatggagcgggactgtgcctgcagtttacccggctgtaggtgggtccaacagaagaagcacctgaagggtgatgattcattgcacagagtccttgctgggttccctgaagggggagtgctcctagtgtatataatgtaggaataaaaggatagaaatctcgctgctggcaatgggagcaacagctgcatggagacgcctgtgctgtgaggccctgacccgcagcctacagctcccacacccccaaaccactctctgcgccatactgcaaatactccacttgtgggcaagaagaccaaagtggcctgaagacccggaacccaccctctgctcctgccaggacacacaacagccaagttcagggcacaccccacgcgctgccagatcaccgagcgacctcaagcttctcattgtcctgtgcctcagtctcctctacaagtttctcccatctcacagcatcacagctaatggtgtgcttggaagggtttcaaactgtacaaagaacataaacatgagctactagtattgatcatgaataacgaataacagtaataataagagtcagtgcaatactaagggtctaggccctggacagagttccagaaacaaagatgtccctccctggtgactgtgtgtctccagcatcatcattcactgcctgtaataatatttgcagttccctgggtccccctgcaagggacgccaggctgggctgggagccgtcctcagactggcttgtgctgtctgcagtgattaacttttacgaagctttttttgggttcgtgctaattctgtgttctcagcatgcttcagccacgggggaaaaaccaacacagcttctatctgctggactctgccgtatcctctgcagaggtttgtagtccgatcattaactcgtggcttctcactcagctcatcaagcagagctggccttcagaaggaatggctcccgtgcagacgttcactcgctcatctctgaagctaaattaaaaggcagcagcccacacctccaccgtccccacacttactgtcagcagatgggtcctgctccagcaggccactgaagaccccggggacagcagtgggatgacaggtgtttacttaaaaaaataaataaataaataaataaataaaaagatctgctggcagtatcggatcacagagagcagcagaaagcaaaataaatatcctaatattttcccagttggatcctgaggcaagccattgggtgaagtacccaggcagaaatctagtggttaggaaatgtcttctcattcgtcattaaggagtgtctgcattgcagagggaacggcttttggtgttaacagttcttgcaaatgaggctgaactgtggttttcagttttctgagctgccgaaaagcagaatgggcacatctggacaaatacatcacggagtaaaattaccccttaaataaatacctttaaacatcttgcattttagcccctgctttctgaagaatgggttgatggcttgcctggatgtgttattggggtttgaggttagccatgaagacacatgggctgctactggggccgcagacacaggagaacacacgggcaaacttgactcatgagagaggatcagctgagatggggggaccactggactcatcctagcaagatgttgacagcttctaagaccatcacggagcgggactgtgcctgcagtttacgcggtgtcctgaacacggtgttttcatgcctacacatctttgctggaagcatccttcttctcctccttctgcccctctgctggttaattccactcgccctctttcaggcatcatttctctctctttctgctggccactttcactgtgcacaaacctcttccatcggtggatgatggcgttatgggacagcagactcctcagtctgtgagcagctggaggacggggctctgcgttccagctgtgacgtcatggacatggacactttgctggtgcaccaccagggtgagcaccaagcgttatttatcaaatgcatgaattaatgcaaaagtggcatttctgagctcttctgccactcacgggctgtgtgggttcagggcgctgggcagaacaagagcctgccattcctctagcactgctgcctgccttcctctgggaagtacagacatgaaggaaacacgcctggttctgatcaatcacaaggacctctctcaaaacgaaaacaaggccaaaataaaatcaaattaagtgctaagagcaacaaaaggaacttctcagctctgattctagtctgattcctttgaaatcacgcagaaatgccaccttcttgggttgtgtttgctttccagccacagggagaccagagcaccctgagcagaggcgctgtgtagagaaggctcttattgccacaggaaaaaggcggcttctgctcagagctcgccggacctcagcattctggaatgcacattaatctaatgtgtcatagttttccaaatccatcgtattgttaaaattccaggcatctcacaaggttgtcttagcaagtgcgtaagcccttctgggccatgcatactttggagtggctccactcttggctgagtgctctgtgttgcactgtgtcacctgggggttcggtgtgaagagacttctctttcctaccagctgcagccctcagggtctcccatcccaggatgctgccctgcccacctgcagctccccctcccagcccagcaatcctggttctccattctcccaggcatggtctctggaggaaggactagagtgtgagagtgaggaaatggagggggcaagtctccctcgacagctgtgactcctgtcttgagagtctcactcattcattcactgattcattcactgacttactgactcattcactcacttattcactgattcactgactcattcacttattcatttgctcgttcactcactccctcattcactcactccctcactcactcattcactaactcactcactgactcccttactcattcactcactcactcattcactcactccctcattcactcattccttcactcactccctcacttgttgactcactcattaactcactcccttactcattcatgcactccctcactcattaactcactcactcctttactcattcattcactcattcattcacttcctcactcattcactcactcattgactcactgactcattcactcactccctcactcattcactctctaactcactccctcattcactcactccctcactcattaactcattcattcactcactcattaactcactcactcactcccttactcattcactcactcactcattcattcactccctcactcattcactccctccttccctcactcatccattcactcactcagtagggattcataaagtgcctcctttgagccaggccctgttttagagctgtgggatacacctctaagccacagattcctgatcttgcagcttacattctagtggcaggagacagaaaataataatatacatcagaaacacatggtattttgaggcgagtcagaaagtgataagggatatgaaaacagagcaaggccgggggctggggtgctgggagaggagctgcagtttggaagagccgcaggacaggtctcataagatgacactgaatggcagactggaaggaggagaccagtgagcccttgggagacttgggcaggaggggccctggaagccagaccagctggagccagtgcttggggggaacctgttccatggaggcatgggaaggaggctccgtgaggatgggaggggtgaggtgtggctgtcctgaccactttcgtgtgcttctccatctgtcccctgctgcatcctccttgtcagcacagtgtcctcctgtgacatgtgcagacccatctgtccaccgcctttctctgccaagtcatcacaagacccacgggtgcaggactttgttccatctacggctctatccccagccctggaaagtgcctgagactgggacgcccagcagaaagggctggataaatggagaagcagatcatacggggagaagctgtgtggtcccaccttaaccactggcaggcaggggaggggatgcaacatgctgtgaccccctgaggggcaggcatctgggttccaggcacagtgctgtgctaaccatccacaggctgacacccaggtccattcttcatgaaacaggcttgcctgagatctaaacgccgtgtaaggtgaagtctccatagaaaatacattccaacgcagagtcgaatgacagtgaccttaggtgcccatctgtgaggtgagcacagcctgagcttctgataagcctaaattttcagggaagctaagtaagagactccaaagggaggccttggttttcatttcttggaggtcctggttgggaggcacagatgtcctgaaactttacactcttttctctaatcttactttcgaaaagaagtctaatcttacgaaagttctttagtcagaactgtaaaactaggttttaaaaagttatcactcttccccagtttgagtgctttgctggggctcaggctgaaggaagaggagagctggctggttttatccagcactggtgttacacattcccagaggagaggtctggggctgcaggtggggcccacctcttaatgaaatgcgtggaggccccggactccatgaggacataaagaagacagaggccgggcgcggtggctcacgcctgtaatcccagcactttgggaggccaaggtgggtggatcatgaggtcaggagatcgagatcatcctggctaacacggtgaaaccctgtctctactaaaaatataaaaaaaattagccgggcgtggtgggggcgcctgtaatcccagctattcgggaggctgaggcaggagaatggcgtgaatctggcaggtggagcttgcagtgagccgagatcgcgccactgcactccagcctgggcgacagagcgagactaaaaaaaaaaaaaaaaagaagacagagaggaaagcgaaagcagataataaactctatactgtagagggcatttaaatcttaaaaagtgttccattaaaatcttttgaggttaatttgttaggtcaggaaaagaaaatcccaacatagctgtttttgtgttaacctaaaggaaagagctgaaagcaactgataggaaaggaggtatcgccttcctcagatggaaggaacagcctccgagttttagccgcgagaactccctgtgtgggggacgcgtcagacgctgactgcttcaccattcggagttggcgtcttggcagaaataggcaattgacacttgtagcttggtgaaaagtgagatacgagaacttctcagacaatgtccagcctggcccagagaactggaaatggaggctttaccaataactccactaacagaagctccagtttattccaacaactcggcactgttgttttttttttttttttttaaatgtgacttccacgtgggcatcagcttgactaacgatggaaaatgcagtatcgaatctgggcctgcccatagccctagcactaaagggtcctggttgagcagcttgtcatgacttttgtctgttcagcccttgaggttagaagacagtcactcctggagcaatcgggaatatgcagggctcggagaggccggggagtgggtgcagggaggacagaagcctcgactctgatgggcagaggagagtagaaggaggaaagctgaggggacttcaggcctcaagctggagggaggggcactcacgtgtctgtgcctcccaagttgccagcccgctcagcagggtcctgggggctccctgcctgcaggtggcttgtctacattcacctccgacctacttgtgacccggacactgaggaccctctgcaccaagccgtatgttccctccacccacttctgtgtcacgcgtgtgcaggtggggactgtggcatgcaacttacgttccagtctatggtcacaaagaagggatggcgcttaatttcctccactccgtcaatgccagcacctgtcaacaacacagaaatgatcatcagaacaaatccaagatggggttctctgacagtttccaatgcagcagtgtggagggtggggatgtgcagaggtggggccgtgggaaggagcccagaggctgctcactcctgcccaaggcacctgcgcacctgccgatgcccccagctcagaaagccacgactcagccccgagggcttgtgaggcagaggtggcctggggttggagtgagcaaaagaggtggtcaagagaagcatgggacaggccagccaggtgctgcctgctgcatgtgacggctgcctagcaccccactgtcacccccaggagcttgaggtgcctgtgagtgtgagcaccaggtggacctcccaggaggccggaggggaaggtgcagagcagagttcctggcaaagctgctgcagttaacccgggagggaaggattccaggaaatgaagaggagttgacaggactgagtcccggaggaagccagagcccagcctcctgcccacacctggccacccctgagcctgctcagacaggtgactgtgtttacctggaggctgcttacaaatatctctgctttgttctgttatttctacctaacctcctcccttactttgttgcgtacaatcctaaggccctggggcagaaaggaaggagggaggagtaggcggagcgctgggggccctttcaggcagcatgattccctaacggtggatacatgtccactcatctgccagaaatcgccactgtccccccagaacgagcccagtgtggacaaggcctttagtcagtagctcagctcaccgactgcagaagcgtgcccattcacggaggcactactgttcgggaaagcggtggggcagggagtgaggggccgtggaatcttgctgcagtttctgttcagtttttctgtaaacttaaaactgttctgaacacaaagtctattaattaaaaacaaaaggccctaaagctctaggactctgtgttttctccaggatgggacggccacagaggagcccatcctcccgggtcacgaatccgagaagaggcgggcttggctggaaggggcagtggcggcggtggctggggaattcctgccagctccgggcccagggctggggagggtctgatccctggggcccggctcccctgttctgcaagctgtgttcctttccgctgccaactcctaacggctgtgctccaaatcagagcctcctgtgccatgtatgccccttcgtggagcccccctcatgtccagctctcactcctggaagagcggggctgcccggggatgctgtggtcagcacaggtgtggcccggcctgtccggctggaagctggcctggagtggcgcaggtcaccgggagtcacagcagatggtgccatcgttggctggaactgcccgtgtcctgacccctcccacccctccattccgcactctgggcagtgatgtggaggaggctcgggggctgtggtggcctcagaaagcgcctctaggtggtcaacggctcagagacagtccccttaccctggaagcttggccagggccatggtgctaggaacgaacccacatactaaatgcccctgaaggcactctcacagcactctcagctttgtgttattcacactttgacgtgaaagtccatctagaaggaattagaggaagggcacacattcaggagtttctccttccatgaggacgcagaatcataggacagacatagcacacggacatctcagtcatccgatgcacaattgctgttcccattttacagacgaggacactgaggctgacacaggttgggtagcttgttcaaaatcagaccagaggttatgagttacaggtactgggtttggaggcacatgtctgaaaagcagctgaggtgccccaccttctgaagtgtctttcccgaggactccctgctgaggcccctccgggtccccagtctagctcccttgttctcctctaaaccctgagcccagggatctgatcccaggcctttgcaatcgcagcagctggcatgagccttcgcaggcgcaccagtggctgctgtaatgaaatttccagagcgacagtctgacttccaaacagccctccccaagcgcccatcctgtgtgcaggcctcctttgatgatgaccagaactctgggttgaagagtccttctggtcacgatgattaacagaaagaccctcctctgaagtgtgcctctcctctactcttttgtttggtgactgttggacgcatggccagaggcactctcaaaaggctggagattggaacaaacagttcagaggccctggtacacgcacaggtgtggcaacttgttggctgtacttctttggaggatctatttcacattttgtacccactgtatttccttcttgttcatcatttgcaaatatggtctgcaggaattttagaaagtgagaggcagaggaaatacaggtattggtataactactatgtaactggtatatgctgggtttacctggatcactgcaatcaacacatttctatctttacctcctttcccctaaggtagtaagattttgcaccatgtttgtattttaagccctcagcaaaaagagtcaacaggggaataacactttggttatcactaaaaaattacaggggttccaattacagggggaaacatgaaacaggaggaggacttttgcactcagcaccttgaaacctgtgtcaaccctcccagggcagtcaggtttattattcttgttaaaataggtgactttgcactcggctccccctttttatctccactgaacccactggacaaatgacggtgagtggagttctgggcggggagaatcggaaggtatcaggctgatgctggaatcacggctggctcgctacgggatgcggatgacacgcactgaaggccttccttggttctagaggactgctgccactcatctagatcatgaagcactgacaagaacagggacagaaactgtgagcacagaaggccggaattccctcctgtcaggcttagcaatttgtcgttaagttccttaatgcagggcaaataggagttcaaggttcaggggaacagaagattcaagaatcacacttcttctcggtagtaataacacctgatcctgtttgtttaaatggcttgtggtctatctccaaattggggcgtcacctaatgtgtttatctgggtctgtgtctccaattgctgttctctggttaagggtataattttgcaaccagttggaactctcatatcaatgactaaagtgcagtgcagtgcctgtgaatggatttttttttttattttggggggattcattctgtcgcccaggctggtatgcagtggcatgatcgtgactcactgcagcctcgatttcctgggctcaggtgatcctcccagctcagtctcctgagtagctgggactacaggcatgtgccactacacctggctaatattttgtattttttgtagagatggggtctcaccatgttgcccaggctggtgtcaaactcttgggctcaagtgatctgcctgcctgggtctcccaaagtgctgggattataggcaggagccactgcacggatgatttattctttcattgcaccgattctgtccagctcttctactccatatttttcacgaggtaagccattcatttcattgtggggattctaaattctcagcaggtgattcccaaagggttttggtatctgccaaaaatgtgtgcattgtgtctgtatatccacagatagctttaggagatggttaattcatggtttgggactcctttgcaatattttcatttttgttgtttgagagtcacacaaacccatctccgacacttctgggaacattcagtagaatcttactggctgcctccttaggtttcttacatactgcaagcttctcctaaccagcccaccatgtccagcctataaccatccagggcaacttccatcattgacttaaatactaggtctgctttttcaatttcttcatcacttaaaggttatctacacattatttgtttaaaggtttttttttttttttttttggccaatttgaaatttcatctatttcatgtttacaccctttgtcagggagtcgctcgtgtcccacaggactcagccggttaggagtcagggatgggctaggggctcaggcttgagcggtgtgggagtcagatctgcagacaggccctgggcatgggtctctagcggctccctagggctggttgtgagggtggggctgcctggtcttcagcaaccatcaaagcctggcttatgacaggcagtcccagcaatgccagtagaaactgggatgaggatcagaatggaccacgtttgaagtcattaaaaacacatcatctggagatcagttctggacaggaaaacagtaacaagagcaacggaaaacctctgcccgtgcgtcagccacaggcagcaggtgtgctgtgaagacagcacgcctggcttaggtgatgggcgttgatttgctgtgctatttttgtgctcatcagcacatcgaattcctttctaacctttccctcactttaaacttccccctgggagtctcagaatatctcatgagtttctaggagaagctacagatgctcattaggaatgagctagaaagctgtcagctttggaaaaaaggaagatttggaggtaggcttaggaagttttatactcactgcaaactcctgtcctgggggggaagtcgggagataacaaataacaaacactggtgctgaaaaccccagcagttcctgatctcagtgcaggatacatttacagctgtttctagacatcactatggtataaacttccatcagaaatggaactcacttaagtaatgagaagcagccaacaccacacccagggtctagccctacaaagcctgttcagcagaagcatcacccacaaccgcgagcctctcccatctcagccgggagcagcgccaagcacagagggaccaaatgtcctgctgagcctgttcctgcagagcttcatcccggagcctacccgtgatgctgccttggtccgtgcttacagggtgcagtgccgagggcgctggccaggagcccctttctcacctttcttttattctattctttgaagtccctggatttgcaaatcactcagagtcaccgagtcctccacctgggaggcgttttcctcgcacagacaagaaagcagacagcctgagcaggggtgtgaccctccaaggcctctatcgtgggatgtgccccagcctgtggtgcttctgcttagactgggtcaccccatgctgctacagccaccccagggtctttctctaattcacaaccacacaaccaccagaacaacagtgcgaagaaacaagactggtgtcccctcggctgcacccttgagagcccccacgctcaccacacccactgcgtactcccgagcgtggcccggcccctggctgctctgtctcctctccactcacccgtcacccaggcatggggacattgcagagtcacacgtgcccccaggtgtgccattcttccttccttcctcccactactctgcacgtgacgtttcttgggcccagaaggcccctccccccacaccccgtccagcatctgggacatcttctgagacccaacccaggcgtcctcacagagcagctctgtcgcccccactcaaatagatcagtggccccaaaccagtggcctctggaggtcagtggcagtgccatccaccttcctaagccagcacctgctacgggcattcagtacacattcactgaacagatcacacacgaaggcagggggattcagtctagaactcttttgaacgaagacattttatcttcaggggatgtggaggtgggagaaatgccagtcttagactcagaagcctaggagcctggagcaactcacacgggggcagagggccgttttctcacctgcagagtgtaagagaggaatgagatgcgtctgtatttctggtagtctggacatgtataaacacattatgccatctcttccagctgtcaatatctgtgcagaaactctgggaggggtcaactcccccaaatttgtatgctgaagccctaatccccaatatccccaatgtctcacaatgtgaccacatgtgcaaaaggggtcactgcaggtataatgagtccggcatcagcagggcaggcactcatctcctatgactgctgtccctagaacaaggggaaatttggacacagacccacacggaggagaaggccacatggagatggaggcggaggtcagggtgtggcattcacagccaggggtgtcaaggctggccagcaaagccccggggtctaggagcggccagggacacattcctttcagtgggagcacagccctgcagccttgagcttggacctctggcctccagagctgcgggaggacacatttctgctgttcaagctgcccagtttgcagttctttgtcaaggctgccccaagaaactcacacagaggggcggccaacgaacagctcagtgttcactgtggtccgctgggcattagagacgtgtgtttttatccgtgtttctcgctacactgtgcgcacacagagggcacatttttcctttgatttcctaatttctagcttattgttttgtccactgatccctctgtcaactggactgaacggaactgtctggaaatccagaggcttcccgctggtgggggctcattaaggaagaggcaggggtgaggaggtcgagaggcagagagggtcccctctctccctgggggaggccatagagagggagagtctacagctcgaggggactcacactaggggagacaccaagagaggacaggtgggaggcaatgaagacgcatttgctcctcctcccagcccctcaattgggccctgaggtcctgtgtggcgagtccagggcgggagagctctggcattgagagctcttatcagacaggctcaacacaggggcagctggaggtgtgcgattgccttgcatatccatgcgagggcccagggttagaacgaggcctctaacagccaccaattccccagatggtcaaagggagaactcaattccaggctcttttggaggaacgagaataaggctcacggcagtcagaagcagaggtaagttccagccacaaaaccggccgcctgtgcaggtgaaggtgactctgcccagcggggttttcagactacctggctccagctccgcaggcaactaaatccagcgccctccctggataaaggctgggcaattaattctgactgtagcttcttcatgttgagcctgggcatcttaggttgtaaaatacacctgtgggagggtccacagctcctcgaaagcttgatgataactcacttagacacggtttgaagggcgatcttggcccgaggtgagccattctccatgcttgtgtgagcttccagggggctggtatcttttaaccaatactcatctctacacctagggaggaggtagctccatctttctctcatccataatttaaaccaaatactaaaacaatattttaaagaactatgattttagtaatgttaaatttgaagggttttaatttaaaaaataggttatttagaaaattatttgcttctcccagaacaaggggagaaaaagtacaaacaccccaatactttgtcacattcacccaatttactgtagcaaatcctctcccagcaatataataatgtttgaaagaaaatagtgactctggccaggcacagtggctcacgcctgtaatctcatgttgggaggccaatgcaggaggactgctttagtccaggagttcgagaccagcctgggcaacatagcggggccccttctctacaaaacagtaataaactagtcaggtgtggttgtgcatgcctgtagtcccagctactcaggaggctgacgtgggaggactgcctgagtccaggcaactgagactgaagtgagtcatgattgcaccactgtgatcagcctgggcaacagagcaagaccctgtttaaaaaaggaaaggagaggaaacagtgactccaagacaaagcgcttcgattgctgcaagaatagatctgaattgttggctctcatgtacgtttggatgaataaatacgtccagcatctccacttctcctttctgactccaattcgcatttccagggggaggccaagcaggggaggggtgcacagcaaaccctcacgcatgtggccccacaggtggtgactgcggcagctcggctgggcgggggcggttaccatgcgtcacctcagagggagtggcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctggcagcaactgtgtgaagatgttaccctctgagggatcagaccccgggcaaggcgggcatgactctgtgctcttgccagggtggatttcccgggtgagcttcgggactctggcattggcctcaatgttcttctggctggtactgcaggctttccatttacccttccattctgcaaccagctcagtggagggtttaacaacatctattaaaatgcatctcacaaaacgatggttttctccagaaaacgctcagaattgtggctcctcggctattgtgcaccagataacgttcctctgttctgtcccacagccaagtggcagagaaagaaaagtgtcagatgagcaggaagcaatgaggccggggggttggacacccttcccggccacaggcctctgcacaccggtgctctctgcttgtttatgtgtttactcgtcagacccattacagtgcttcccacccatcaggcactgctctgcctcctcaaatcctcctacttcacgatgtcggtgctggtattaccctcagttcgtagaataaataagcaagcacagagaggtgaagccatccgctcaggcccacacggccaggaaggggtgcgtggcgtgggtctgagcacctggctctcgcttcactttgcttctgtgccctgccctggactccagcctctcccacacgctcccctctcctctttcgctgctgctctttcttccccttccatcaggccctctcccctcttctgagatccattttgtgcctcatctgcttctctgccctggctgcaggcatttgtgcgcgtctgggctgcagctggccttgctgtttgctgtcagagagcccacgagcatgagggccacactttggcttcacgggtccccagagcctagcccacgagtgagggaaggcacgggccagactgcccattatccactcacacttgctctggacgaaagcacccagtgtctgcccaagagccatgagaaaggggcagcaggcgatgctggggacaggcggtggccccagccacggcgaggtggcagtgtggtcctgcaatctgccaggggggcggccccggccacagtgagatggcagcgtgactcgccagctgcccgaagagcatggtgagtggcagcatggtcctgctaactgccaggtgaggtgaggtggcagccatggtgaggtggcagcatggtcctgctaaccgccagggggtggcccaaggtggggcgtgtgctagcacgtcacagagaagtctctggcatcaaatgtttctccctaaaacaactttttaaaaactgggttttcaatcataaaaataatacatattggcagaaaaagtccatattggcatgaatgaggtgaaaggaaaagctccccttctgcccgtccctccggggagaagcacccgctgtaggagctgcttgcctgtgtttgcagaatttttctttgcttacctcccttgcttccaaaaacacaaacaggataattctgaacgttctgtgctgcaatgagctatttttacttaacacttctttttttaacttacacatccttccatgttagtgcatgcagaatggcctcactcttcagtactcacatagtatcccctgtgtagacgacggtaattcagttaaccgtccctgggtgatgtgggtttcagcttccatatctctctgtgcacttgtgtgaatatatttgaaggatatattatttgaggtggaattacttgggtgaggtgcatgtgctttacttttgcagagatttttcaggttgacttatgaaaagtgggaaaaacacaccccttcacccggaagttgggaaactgctctcccatcgccaacagtgaggattgccaaatgtgtgcctctgtgctaacttgagaggtaaaaatgggctagacctccatgaagacagtaaggacatgaaatatcacgaagaaatgtacaggtactggctgattcgaaagcacaaaaacattcacggaaagcaacaagtgccgaactttcaatagccccttcgtaagacagggagggctttaggaaaaatcttcaaccctcgctagatgttttggacctgacaagcaagaatcttatattccttaagattgtgattttatatatatatatatatatatatatatatatatataatatattttttttttttgagagagagttttgctctgttgcccaggctggagtgcagttgtgcgatctcagcttaccacaatctccacctcctgggttcaagcaactctcctgcctcagcctcctgagcagctgggattacaggcacccatcatcacacccagttgatttttatatttttagtagagatgaggttttgccattttggccaggctggtcttaaactcctgacctcaggtgatccgcctgcctgggcctcccaaagtgctgggattacaggcgtacaccaccactcctggccaatttttgtatttttggtagagatggggtttcgccatgttggccaggctggtcttgaactcctgaccttagctgatccacacgcctcggctgggattacaggtatgagccacaatgcctggccaattttatatacatatctttcttctagtgtttttctaaaccttgatgcttttcgcccaatttttctatagaataaaaattctatataaaattcaatgaaaacaaataagttgggatttttacaaaattctgaaattaagctacagtgaaattctgggaaattctctgcaggaaaagagaataattatacattcattccatattaaagtataaaagaattgagttgtgaattaaaagatagttcatttttcaagtttaaaaggccaagtcaagtactcttatcagaaatacaagcatagctatagggaattttcctgaaaagccttttcaatttttaattaagactgagcaaagctcaaagtggtctttgttgttgcaaagattagaaataaataagccatgaaggctcagctctaatttgtggctttaaaaaggatactgatgtctgacattgctctggaatcaagccaaggtcccctttgaaattgaattaatagatcttaaagtatttgctgcagagtggaggcctctgatgagatagtagagtgtacgtatacctctctgatcaatcttaaagtatgtgctgcagtgtggagagctctgctgaattctctgatgagatagtagactgtatgtatatctctctgatcgatcttaaagtatgtgctgcagagtggaggcctttgctgagttctctgatgagatggtagactgtacatatacctctctgatagatcttaaagtatgtgctgcagcgcggagagctctgctgagttctctgataagatggtagactgtacgtatacctctctgatcaatcttaaagtatgtgctacagagtggaggcctctgctgagttctctgataagatggcagactgcaggtatacctctctgatcgatcttaaagtatgtgctgcagtgtggagagctctgctgagctctctgataagatggtagactgtatgtatacctctctgatcaatcttaaagtatgtgctgcagagtggaggcctctgctgagttctctggtaagatggcagactgcacgtatacctctctgatcgatcttaaagtatgtgctgcagcttggagagctctgctgagctctctgataagatggtagactgtacatatacctctctgatcaatcttaaagtatgtgctgcagagtggaggcctctgctgagttctctgatgagatggtagactgcacatatacctctctgatcgatcttaaagtatgtgctgcagcgtggagggctctgttaagttctctgatgagacgggagaatgcacgtgcatctctttgttttggtgcaggcacacacaagtacactggaagtcttggttctttctcattttacttgggttgtcaccagtttctggcaggaaattctgcctcagctatcggggcccaagagccaaatgtgctccaaatctgggccctcggtgactgcagagatgccaccctttcctttcaaatgcaactgcccttgctgggggaggaatgtcccaggaaattctctgagtaacactgtgtctgggacaggtatctgtgctccgaggaaagaaatagttttctaaatagtttgtttttgtctcagaaaccagagccaggagcaatgacagggagccactcagttaacgcctagaggccttgcttattctggctgcgatcacagaaggcttcgggcgatgatgaggaaacgagtgtgaccctctcaggctggcttcacagggttagccgttggaggagagaaaacccacccaaattagtgaagtggaaaggtttcatgaacttctccagtttcaacaagtgaaatctgtgtgtttgggtgggactggagacaagggaagatgagggagaggaaggaggagagagggagagagacatcacatcctattgcatcttccctaaaacccagagtgcttcgcagccatgctacaggacgccctcaccataaagcaaatgtgggggatcattttaaattagttgcctcccaaaagggactgttctaaacaaaggtggccgtgcagccttgaccttcaacagggagtcccaacacttttccaattgcctcaaaagcagagattctggaaaaccagatgcaacaagatgccccaagactcacagcctgaagactgcggggagcctttgggccgatggggccgcttttataggacatgtttgtgccacaccaggtaagagaccacctgggacgtctatgtgtgtggggagaggacacgcgcagctgcatgctgtcggagctggaaggaactgcagggaccatcaaccccaccttcatttcccagagaaaaggagggacagggcccatggctgtgcagctggccacagcccagtagggtctagaactcagaatccggacaacccccatgccactgtgggccgcagaccagaagctcacagagctggggccgtggcctcctggatcctgctctcacacatcctgctgccacaccaacaccagagaatccaccgcttctagcaggaggacggcccgcaaacgctcaggggaaaggaaaaatcaggcctgatttcttacggagttggaaaaaattaagaaaagcccattttgcattttgaagaccaaaaatgtcgtgctaacgaagaatgagaagagcagggcctttttttcctctttttaagattaagggtaaatcgcatcctcactaaataagagaagctcatacatggtcttctcagaaacccacagagaaggaatgggtttgtgcttccacattcgggaagggaggacccaggcctctgcgacagctgcactgctctctggctggtcgggtgccaactagagccgactcctgcacacatagggtcccgggacaagcccttgtaccttggaacagagcctcactcaaacagaaaatgatgaacacaattttacagtcttgtcatgaagatcggaggagatgacaggtgcgcatgcttggcaggtgtgaagtgctaagagaatgcaggactgtgcaagtcactagcagaaaaacactttgtgaacaagaattctgggtaagcgcacagaaacagcatgacgtccatgtccacaggcagagcccgtgcatctgagcaggcactgcgggggccaaggcgtgacatgcccgcaaacctgtgctgtcttttctgctttaccacttgacagggaaaatggatagagatgaagcaggagcaccaagggtcaggctcgactcaactccacacacttcagggcaaggagcttttcagagcaccttaaagaacaactacaattccttcaattcactttagttcatgcatattcaccaggggctctgcgtggtccgagagctggacacaaagatgagccagacacaacctctgccttcgtggatctcatcacttagtgaatacctgtggccggcccagctgcctggccagtaaagccgccactccagccctcatttccttcctccaaccacagatgcttgttctcctgccttccttacggtgccatatgtcacgagtgccatgagacagggttccagtcaacaagaagtacagagaactcccaggggcttccagaaaagctttgtttttgtgaaaaaggggacagaggcagctggcctcatccagttcctttttctcctgcagtgaggatgtgattccaggaggtgttgtagccgcattgccatcacaaggcaccgaggataaggatgaaaaggcagtgcactgaggatgggaaacagaagccacaggaagatctgggctcctgacagcagtagttcagctgccagtgtctacaactcatccaccaccacgtggtgtgttaataagagaatgaaaccgtgatttggaaaactaaattaattgaacaaaaaaattaaaattatttaaaggttctattccttgcagctaaaagcaattcctatggatacatctgttttcataagtgaatttcgtaagtttcttgtttgacctgctttgaagtactgtcacgagaattcaagtcagataatgactaccttagtgcagtgccaaggcatcttctcatcctcatcaacagcaccgtgccgggggaaacctgaggctcgaagaacgacctgttctcctggttcattagaaatccgcccaggcaggggaacgtcggagctgtccacccaccctctgccaccacccatggggcctgccttccagggctgtgtgggggaggctgtgcttacacccagcagcatagagaatgaggggaggagagccacagacacaataaaggtgcaacctagggtcacggaaaagaacagctctggaccagacactgaaaaggctgatgaaatgagaccaggggctccagacatgggcaaacttcagagttgagagatgagtggaaatggcatgcaaagatgcttctgtgcattttgtggcagtttacagcattgcaaactcgattctaaggcaggcgtgtcctgaagtgggttgagatctgctgagctggggagcaagcccctgccagcgagcccctgatcccctccagctgggagggttacttcctcccagaaggattacatccacattgctcttagggctgacggacactgcaatggaagggactcaatttaattcacaatctggaagactcagatcagaaacatgacctttgacatagcatttggacaaaccagggcaccgcgatgcattggcttagctgagacacgcttctcaacttgcatctgtctccaaacacgccctcagagttaagaaacaccgcctcccccacctccccagacgcacggtgatgaacgggggggtctgtaaacaaaaggccagaccacacccagatttgggaaaactgcagtgaaacggcaacttcgggacacagggtgggacacaagcccttcctgccttgcccagcccaggctgtccctctgtccaaggctgcatctcccaccactgggaccccaccctcagggggtgaggtcttgcccatgacaggccctgtgtggatagggactctgggcactaagggtgagcgctgagcccttgctgcgtttcctgagccgagtcactgtgtaaccgtgggtgtgcaccaggaccagcgagtgaagggccaaggtgcagacagctttaggagctgcacatctcttggaaatgtggctgtgaccctggctaacgacgaccgtcaccactgatgaaaaggaggagtcctgatgactcttggttggaatctcaggtcccatctgggactttgctgagggggtcccagtaacaacaacgtggcaaaaattgtttggtcagtaggttcctctaagccatgaaccccacacacagctgtgagcacacacacacacatgtgcacgcacacgcatgaacacacacacacagtgcccctgtgtgtgctgcagcatgggccctctgtcctgatcaggcgtcctcccctctggtcctgagtgctctccatcctgggcctcccatctcattgtcgcccccagctggcatctcagtgacttggggctgctctgctggggccttcagctttgtccacagcactgttggtgaatacccctctaaggaagctgcctctgtctgggtgacagttccccagcctctcagacccttgactggggacagcgctataaaatgtgtgcagtgacctgctagttagttttcatccaatgcactggacacagtcctttccacagacaccagcatggggccctgccaggtggcattgggggctgggtccatcggtgtctccatgtgccctggcatggatgcactgtggtgtgggtggcacgggctccgctgcggggtgagtctacactctccagccatgtgggctgcaattcagtctagaccctggcccttccatgtcagtaacagcaacgtggagattctcaacagggggactttgccaatgtcaggagacgtttgatcatcacggggtgggggtggggatgcgctaaacagcctcaatgcatggcgcagctcccaaaacaagaattaaccggcccaaaatgcagacggtgcagagccgtggccgagacaccgtcctccagccccaggctgtggtgtggacgtttcataattgattcaatgatttccttattgattgatgcttacttcatcttcaggtctttgttaaacaggaagaccttcggcaaacaccgtttatttgtaccccttttacgcaggtatggctatttctgttggagagatttctggaagtaacacttctgggcaaaagggtgcatacatttaacattctgatggttttaccaaggtgctgaaatgttgcagggatttactctcctgacacacacccacgtgccctgggctttctggattggcctgcagtgactggcagacagtgacggcagaacaccctgtgacatcacccatgccacggggagctcaccgtgtcacctgctctgacgtcaccagtgccacgggagctcactgtgtcacctgctctcctggtagccacgctcggcatgcagaggtgctcggtgacaaggaggaattgctttactgtgttgtgtggaagaatgaaaacaggctgagtggacaaaggcgctgacagtgggttatcaccgagaggtctgtagagtggaataaaatatctgcttacacagaggagaactgcctcggaaatacaactatgggacatctttatatgaagtaaagaattactatgaagatgaatctgcaggaaggaagagtggtttacgtgataaaaatctggattagaagttggatgtaaatgtgtttaattaggtgaatacaactatgacaattcattacaagatgaatctcatggggattagtactcagtactttaaatacatcaatgttgatttttaaaaatcaccttaactccttttttctaagatcacagttatacttcaattatctcacattgtgaaatatgactgtggagtaggaaggtacttttgattagcttcactttcaatcactgaaggattgcaaatgaatgcaaaagttccctgcaatggaagctgatgtggggaagaagttaaatgggtccttctttctttggggttaaggcatgcagagaggaaaatctagtattttttccgaaatgaagtatttcctgatttaacttttgccttcccctctggtatgtcttctatctatgaggttagagtttaaaaaaaaacagaatttaatgtgttcctttcgttttcttgttaaaataacctgaaacaccctgctccagttgctgtctaaaccgtaaacaccctgctctagttgctgtctaaaccggaaacaccctgctcttgctgctgtctgaaccgaaaacaccctgctccagttgctgtctaaaccggaaacaccctgctcctgctgctgtctgaaccggaaacaccctgctcctgctgctgtctgactctgagacaacacggccgcgccaactcgctaagaccggcccagcccacggagtaatcctcaatacgctgtcacatacacgaaaagaaaatcaatcagtagttaaagtagatcctgattttaatagatgtggaggtttctcaatttagggagaattaaattagaagcagcttttcaacggttctgtccttagcttagagactttcaaaactcagggaagtcagattggttgaaggatactaccattttgggtaaaaccagtggcttttagaaaacagcttatggtattttggcagcaactatgtgttttagaagctgtgaaggggccttttttcctggagctcagatggcactggtactatttcaacctctaggtgaggtctgttttcagtgaccttggttggcattgggccggagcaggagggtggccctccacatctccactgtagcttgcggggcagcgccctgcacgttcccgtggtggggtgtcccggggaatcttacccagccggttgcaggggttccgtttgaagagagctcgcagcaaactctgtgcctccccactgaggaactgcggcatccccagcttggctctgaaaaacaagatcctattttaggatctattttaggagaacaaggacaagctataaagagggccccagtcagcattcagagacctcaatcgcagtcacccagagcagcccgtgctctaccacgtgggtcttaggacccttttatgctttaaaagttactgaggacaccaaagagcttatgtttatgtgggttacagctgtgatatttaccacagtagaaagtaaagtgagaaatttgtataatttccatttcctaattcactttaataaatttttattaataaacattatttaataataaaatcattaaaaaacaataacactcccattaacacaaataacattgttaatggaaattatctatgttttctcaaacatacatataaaaaagtctttagtggcattgttctgcacttgggtgcgtctcttcctggctcataggagacagctggaccctgtgctcggtctgttgcgatgctatgaagaaaacctgcgagaggaggacctgcaaaccccgggagggtctcaggaccaccggagtcctcagagcacactgagaaccccacgcgcagagcctagtgctccctccagaaattctccatccctcccaagtggaatgccctgaggccacacccgtgacttgctgtcagggattattccagctttagcaaaagtaaagaacatgtcctcccttaaaattcaaacaatgagaatcactgcaaaggtcctgacttgcagctctcagtgtctgctgcaattcaaggtcccttgatggaggaaaaggctgattaaataaaaagacactccttagcttgacaaaagggtcctcacaatggggcttccttcactcccctctctccttccatctacataaggaccgagcttacaaaagctgagctggtggtgttttaggtgattctcaattttataaaagttatgtgtccatttgcaagcagagttggcaagagcagctcatgaggacaaacagctttatgactcctccaccgagtggcctcacttaggaaggaactgattaggggctcccagcctctctgtttcctgccctcctgctgtctgctctgggacagtgatagtcagtggtgtctgctcacatttaggatgctatggcaaggtggtatggggatcaggcttcttcctacagtccaagagcaaaaccttggcttagtaaatgatttttcatgagaattaagcagaaaatggtttgtatccagtcacatggtaaaacgataccgagtcctgccaaggtcaaccaggagtgctatatgaatggggtcagcaggtggggagggaaaggagacccctgctcctgtgatctctccggacaaggccctggaggccttgtgtctttttccgtctatcctttacttctgggaggtcaccaaccatcacgcttgaaaaccagccactacacattctaagtgacttactgatggaaaactatctatggtagaagagttcatcagaaccactcagcaggatgagacaaaccagcaactgctcccttgacccactgtcattagaatgcccagcaccctattaccactgctactggcggacgagcgctaccattttgtgtaaaaccagtgacttttagaaaacagcttacaatactttggcactgtaagcctagcaatgtaattaaaacttcacagttccaggttcagaggcagcagctcttgatatcagaaggtgctcgcaggtctctggggtggctcccacactactcacttgaggatgagagccatggtctccttcctgtccttcccctggaacggcagggaccccgtgagcatctcaaactgcagagcaacacagagcacagtgagttcattcatccagatggacccggcttcacggcagagtaccccagcagggcagcctgctaccgtgtccatttcctcatgcaaaatctccatcagtcaattgtagccactggcctacgtgcttggggtacaacagtgactaaaactgcctcgcagagcttgccatttggtgggtgagacgggtaaatgacagatgtggtagataatcacactctgtggcaggccagcaggccccgagtacgacagagaaaagaggcagagcagggtcctgtggtcaggcagtttggacgaacacatcttacacgcggtttaggaacctgtcctgccctggcaggtgttgtggaagggatgagctaggaggaggaggaggagaacagctagctcatgttgaacacccatgcatgcctggatggtgggggctagagtgcttccagcatgagatagacctgaccacagccattagcctctgacgaggacaatatggcacagcaacctctcagatacagctgccgcaccctacatccttattttgttattactggacacctgccaggacggaacttgagataaggaggggatggagcacagccttgtctgagcatgggtttctttcttgcaccaactcccccgggcacatgcagtggtgattacacacactctggaagcagtggcctggaatggtctcatcagagcaaggtgcacagctgaccgcttctcacaaaagaaactagggctgcagcaggaaccaatcttttcataaaataagaccctgaatctaagtggaatgtgcccaaggatcaatcctactcggtgtctttcacgtcagtttaaattacggggaagcaggtgtttccatggtcttattgaattctctctcatctttattttttgctgcgtgtgtctctgcccttttagaattcatcctccagcattcgtcctttgcagttcgaaaatctcaggagatacacaaagtagaaagaccaaaaaaatcacgcagaattccattacccaaagatatccaaacttaacatttgttagttcctcctagtacttttttcaagctgttttttattttgttttaaaaacacagataaggttttgtatactaacttttcacagaataatataaaactttcaatggttatgatgaaatctttgtaatatcacttaacaaacatggatatgacaaaatgtatagtgagtgtatttgttgctgtacacttaggacatttccaattttctgctattgtaagtactactgaaatgtgcacagatgatttcctaagatttattcttatgataggctgctaggagtgaaattataatcttaaagaaatgaatgcatttaaggttttattaatattaccagtctgctttctgaaaacaacattataaaagaaatggaaactcttccaccagttctgacgtttgaagcctgttctgtcacattaaaatgtgctgtccatccggtgcacagagtaagtgagggaactcagagcagacaggctgcaggcaatcaatcaatacaaaagtaataaaaagcaagcggaagggggtccagatgagaactgaaaaagagacaagtgtaattaaacaggaaaggccagaatgctctgactggcagatgagctgtttgtctggtaaaacaggatgaaagtttataagctgatcatacacactgaaatatctctcagaatagaatggtattagcaaagggaactcctttcctattctgctctttcttctttctttcttgagtctattaatagcactatgaaatcccatttccaaggacaagccttctggctacatgaaatgagaaagctgtcatcccatacacaccgtttaatccttgttacacaaatggtgcctgtccagatgcccggatatcatttattttttgctgatggactggtatcttgcatacatttgtttggtgatttctttttcttttctttttttttttttttgagatggagtctcgctgttgcccaggctggagtgcaatggcacaatctcggctcactgcaacctccgcctcctgggttcaagcgattctcctgtctccacctcccgagtagctgggactacaggcgtgagccaccatgcctggctaatttttgtatttttttttttttttttttttagtagagacagggtttcaccatgttggccaggctgaactggaactcctgacctcaagtgatccgcccgccttggcctcccacaatgcttggattataggcgtgagccactgcgcctggtctggtgatttctttttagcttttgaagatgattcccttgtgatcagggtccactgctttgtggttctctctcttcctccccttcttcctccatccatatggtaggaggtccccaaccatctactcagccagagaacacccagcacagcacccatgaatattcaacaactgcttcttggtgatgaaggtgctgctgacggtggggatgatgctggggcggaggtgtggactttgcagcctccaccagccatggggttctgctgcctttcccatccccttatccacccttttctgtggagaagggagatcatttcagtatgattgtctgaatggagctgcccgggaactttccagtgccgaagcattactgactgaggttttgctgatgagtttcttgggacgttatttacagtaagacttttgctgtgttgctgagcagcactgagacttgccaaggcttccggggtgaactgagaaaagccgaggttcatcttggggttcccacagtcaagtacacgcaccgggggagggagggcactccaaaggattctttcccaatcggcaccgagaccaggctgcagacaggcacagaggggctcaaggagatgtagccaaagctccaccgggtgcaggcccgatgcttctgggaaggtaattggacagacataacgcagtgcttctcaactggggtcaccgttgcctgccaggggacatttccggctgtcatgcccgggagccctggtgctacaggcgtccactgagggaggcacagatgctgctaaacatcctatgacacacagggcgccccacaacaaggaagtgtccagtcccgacctcaacagtgctggctgagaagccctgtctaaagggacagctaaggaacctggaaagagtggcggccccggcacaggcaggatgcgcctcatggaggccagtggtactgggggcaggggaaggaggagactctggggagacccttggtgacaggagcctcgatttcaagtttacttggccgatcaccattcttaaaagggcaccaaaagcaagctaacattttaatctgaaaacaggcgaggacaagccctgacctgagatggatgacttgaagtggtagagggcctggctttgcagggtatggaggggctgggtctcggagagctgtgttgatccatgcccatgtgtggaggtccctgtgtgcacagacacatgccctctaatccgagctgctctcgctccgtgtgctgcaccccactccgagtgccaagaatctcagtctcaaaacagccttggaaggtgccgttcctcacaaccgtctacagatgaatggtccagtggcaagcagcagagcctgagctcagaaccatccgtgtttgctatggtggcataaggacacatcacatggcacctgaggcgggatgtccagaacattccgtgcccgtggttaagaaacgggagaaggataaagtggtctcacgaaaccagagtgctcaagagatgctttagatgtttacaaaacagcccaaatatccttctagaaactggctccagcctggcgtagaggagtgctggaaattctacaaatgtcaccacgcagccggccaccaggtttgcacgttcttctccaggtaccagctcctaatttcagacacggaattttattcagggacactgacttcctgcccctggcacaggcatccttccttccaggtctggggagggcacttgtggatgctgctcctcgggaagagatcccagcacacatccacctccaggggacggacggccacccacacatgaggaccactccctcagcacgcggcctccagggtctcagccttcttttaaaacaaggcccctcacacgcacaacggctctgcaccgatccgcttacaaggcttgggtaagatacgacttcaaaggtcacccgaggcccatctcttagctgcaaatgagaattcagaagtcacttctgatgccacccacggacgtgtgggaagcgtggggcctccacagtcaagacctttgcctgtgtgcagccagtcaccacgtgggcgggcggcactaaatgagaatgtgtttctgggactattatgtgatcttgagcccgacacttaggctctttcagctttagttttcatttctgtgcacagaaagaataccgtctttcctgcccggcttggagattgttgggttgagatcaaatgtgaagatggccaggcagccttagcttgtggtcaccacggcaacagccagccctgcctcgggctcgagagtgacacagcagttctggagccggaccccttccccagctgtcacgagacattgaatgcgggacgatcccagcaaacaagtgaacaattcagtaagaaatgtcctgtgcccagggaggcacgtgggaggagagtgcctgctgtgttgacgtgccgggcagcgctgggccaggcctccttcagaagctctcaatatcatcttcttcacactccagggacagggagggtggggactccaggatgggtgaaggctgccgggcactgggtctgggtgtgagtgcctctctgcttccaccctgttgtcttcactccctcatgggtcccttggaggcctggccaggtgcaggcacttttgtctgtgctggggcatcttgggtaaggtgactggtgtttaagaaactccacgtgccaggagacactcacagagacagacaacgacaataaaagatggcagacgttagagcagtggcaagccaggagtgctgagaagacaccgaagccagagccaccagccagagccaccaacccggccagggtcagcaaaggccactgggagtggtgcttctgtcttagggctgatggtggaaggggaccggggggagtttgctggagcaaggcgagcccgacgtggtctcatttcctcttcttctggcccctcgtcgtgtctccatctttggatcattcctcttctgtctcttctgttctcctatttctttttctttcagcttctccatttgtcttttcggtttgcagtgattaagaccagaagaactgggcgtggtggctcacgcctgcaaccctagcacttctggaggccgaggctggcagactgcctgagcttgggggttcaagaccaacctgggcaacacgatgaaaccctgtctctactaaaatgcaaaaaaaattagctgggtgtggcgggtgcctgtagtcgcagctacttgggaggctgaggcaggagaatggcttgaacccaggaggcggaggttgcagtgagctgagattgcaacactgcactccagcctggtgacagaatgagactccatctcaaaaaacaataaaaaattaaaaaataaaaagaaaaaaaagaaaaaaaattaaatatatattttatattatgagataggttttatgatctgttgccttaatagaagaaacagaagactatcaaatctcccctccccctgtccccccagaaacctcacaaaactaagtccagttggttttgacttatatgtggtgttttggctgtgcttttctctgctaagttactcctctccactccagcctggcctcttgttctttttaaacattggttcacctgagagccaggtggcaacattttatgaccttgttcattacacaaaggctggcccgcagtactgctggatgggccacttgtgagcccagagttataggacaggacccagagacagaaggatgccaggagccctttcagggagcctggatgtgcagcgtggccagccctgctctctgggggaatttggggttctcaggagggggtttaagaactggaatctctcctgaagccacagactataagcttggacccatagcccagcgtcagcaaaggcaacatcagacttccctgcaccggcaaaacctgcaccagcgtgggaggtctccacagggctatccccgctgccctcacccaccactcaccagccagggtcacacaggaaacccacacatgtggaagggagtggacctatcgaggcagaaatcacctccaagacggcaaagcaaacctgcctcactgacctatctaaagaaaacctctttcagtggaaggaaagcagaggtggtctcagaggggtgaccgtgggggacttagctctgtggtctccgcatggagaggacctgctccttagccagtgccactgaaggtctgaataatagtaaaaaataaatcagcagcatcatcctcttggctgagctcgcgggccccttgctttgctgcaggcattctctcaagtgtcgtgcctgtgctcacgtgttgaactgcacgactgtctgtgttgtgactcactttacaggcaggaatgaccagggacggaaggggcttccacaggaaggagtagccacaaacgtgatgtgggcatctccgactgcgaactggctttctgggttaggctgtgggcccatctccggagctggtctaatgtgtgtctgcccctcgcggagaggtgagcagcccgtgcgggcacgtggaacacagccagggcctgtgagctcccggggctgaggccggagcctggagagtgctgcagtgacccaagtggcaaaggaccagcgaggccctgggcaccagccgggggttctccaggcgacaccgcaggactcagccctggggttccctagcaaggggacgaggagtagggtgtggtgggaggagaggcggtcaaaactctgaagggaactgggtttggcaggcacacagttctgccacacgccagcggagcaaccttcatcccgtctcctaaagtgctcatggcctcagtttcctcctgtgtgtgatgcacaggccggagggcgggatacccctgaaatgccacgacccgattgtcatccaggtcagattccagagcactcactgcacgcctgctccaccctgaggtcaccagccccctgcccagctgggagagtgggattgggggagggagggagggtcctgtgaagattgggaaaggagcccacacagttcctagggcggagaagacccagtccaaactgggttctgttaagcactctgcctgcgaaaacgcgacagagacaattcacatttccagacgctgatgcaaaaatgcctaactccgtgtacatctcagtttgtaactaagcgcaaggattctgtgtctaaataagaaaaatactttaactcgaaaatcatggcatctcttgtaatcatcacgctaagcccgaagagcacaaagcataaagagggttcgactcctcccacgtctgcgtttctgcgttctcgtttgcatcccagccccactttctgatggtggggatgtgggatggggaggaggctgccaggaaatgcttggcctggacacttgcccagtgtcccaagccctcaggcactgccttcttccgcatttcgggacctctgaaccaacctggggacaggggtccacgtggggaacagccgccatggcacagaagagggtcggggcaggctcaccatgagcacgccgaaggaccaccagtcggcactctgcgtgtgtcctcgccggttcaccacctcgggcgccatgtactcgatcgtcccgcagaaggagtacgctctcttgtcgtggtcaatggcctccttactcaggccgaaatctacatgcaaacacagcacacacactgcctcagtctctgggtgtgttcgggggtccacactcaggcgggcatcagcgtccttctgtgggctctgccccctctccaggtgggcgcagcagagccctgctcagcaaaagcgggaccatgtgagtgcttcccgaagcccgtcagtgcccgaagcccgccggtgcctgaagccgaaatcctcaaagcgtgaggagttccttatgagtgtacacactcaggagcgccttggaacaccacccagacagcaggttgtcagtcagtgacgggaactcccccagacccttttccacaggcacgtggaggtggggtgttgcagggcagagggacctggggtggaaggcaggtgtgtggctgacagctactgggaaaggggctctggctgccggggagccaaggggaaggcagagtgtggcgaacctgccctgccccgacaacacgagggtgtggagagcacagacaggcggaggaggcctggggagcagaggccgagctatgatggaagaacagggatctccaggtgccacagagcaaggaggggcttctgaaggaagtggccccggggctggaaagaacaagagtgcattggctcagggcccccaagtcttggggatgacagagcgtggctaaatagagccaaggcaggcccagccagtgggtagagcagcagtgcccagagaggccatgtccttgcccctgagcctgggaatgggccaccttatgtggcagaagggactgatatggtttagctgagtccccatccaaatctcaccttgaattgtaagaatccccacgtgtcgtgggagggacagagtgggaggtaactgaatcatgggggtgggtttttccagtgctattctcgtgacagtgaataagactcacgagatctgatggttttatacagggcagttctcctgcacatgctctctctttgcctgctgccatgtaagacgtgctttttctcctccttctccttctgccatgattgtgaggcctccccagccaggtggaacagggtgagtccattaaacctctttcctttatgaattacccagccttgggtatgtctttattagcagtgtgagaataggctaacatggggactttgagaacagactaatacagggactttcagaacagactaatacagggactttgagaacagactaatacagggactttgagaacagactaatacagggactttcagaacagactaatacagggactttcagaacagactaacacagggactttgcagatgccattgaggatctggagataggggatgaccctggatttctgggtgtgcccaacaccattgcaagggtcttcaggttaggaagggaggcaagatgcagtcagagagcttggaagatgctgcctgctggcttccaccatgggggacgcagcccagccaaggactgcgggcagcttctactagctggaagaagctaagcaagggagtctcctctagaggcccccaaaaggcaggcagccctgctgacaccttgatttcattcctgggagacttatttcacacttggggcctcctgacctgtcaggtgataagtttgtgtggtttaaagccccgatgttcctggcattttgttgcagatgctatagggaactaatacaaatggggtgtcctgagactagaggagctgttgccagtttgactgaatttgctggtggctgccagggctcagatggaaacagggagggaagtcacgtggccaccaccacggtccagggagtgagaaggaggcagggacagcatcagtgagggcagcagtgcaggccgcactccagcgagactccagatgtctgccctcaggttggcactgggcatctgcaaggcccacattgcaggctacactccagcaagactccagatgtctgcactaaggtcagcactgggcactgggactcctgaactaaacacccagcgacgctgaaggagcccagcaaacagaacgtggcaggggagagggaaaagaaggggccaccgggaagctgcatgggtctggacgttatgaagacatacaatgccataagcagtctgtagctatagaaaattctgccaaatcagagacaagcatctggcaaagggaagggcggtgtaaataagagggcttgggctttgaggtggtccccaaaggtaccagggctgagatgaagccatggagggggcctgccgtcttttacaaacctgtgatcttaatgtgcccctcttcatccaggaggatgctaaaagaaagggagagaaaacagatgctttagaaagagacccagcctgccgacgggcacgcagagctcagaggagagctgcggggcagctgggggcggacgttttcagggagccctgatggagctggcccaggagatccccacggcttgtgcggtgggccttcccatcctgcctcgcttctccacagctcccagctcgagaaagcatttggtgccacacctcctggataaagggatgtgtgttcgtgcagctggaggactgctggctttagatattcgtgggtccccagggaaggtctaagagccctccagactgctgtgcgcaaagcataggtggagagcgtcctgggactgctgtggcctgtggagacccagagcctcgcagatggaatgtttctgcactcgggatgcccttgatgtccaaagacccccttcttctcccatgtatcctcccctgagccctgccctggctctccagacccacccaggtgaggcctgcacaagcgggggccaaggcatcgaggagcttcgggcttcagcaggtacatcttgtgatgagacctgctcccggcttggcacccctgcgggccactgggtccctgtcttgttccctgccaagcccttgtcacgccatgtgccggacgtgacagttgcctttgctcctcccaggtatcctgccgtggggtgaaccctgcatagagaatggaggcagggtccgtaaagggctgggtgcaggcataaatcccttcttccctgaacatcaggcgggagtctgggctgtgataccttgacacacctgtggccctaaactttccccatttatttatttggctgtaattaaatcctgttcttccagatgctgggaggtaccagcctagccctaaagagaccaggaagtgggctggaaagaaacaaaggcaaggcttggaggattaatctgtgatacctttatagaaacctgtgaaaggaaggaaagcctgacttgctacagcacagaggagcccggaggacattatgctcgattaaataagcccgtccccaaacgacaggtattatatgattttacaaatataaaatgtatggtccctagaggggccagagtcacagagatggaaagtggatggcgggtgccgggggctggggagctactgtgcagggggacagagctttagttctgcaagatgaaacagttctggagatggacggtggggatgggggcccagcaatgggaacgtgcttaatgccactgaactgggcacttaaacgtggtgaaaactgtaaaagtcatgtgtatttttctacaattaaaaaaaatctgccacagagttaaaaaaataaccactattttctggaaatgggaaggaaaagttacagcatgtaattaagatgacaatttataatgaacaaggcaaatcttttcatctttgccttttgggcatattcaatctttgcccagaattaagcacctttcaagattaattctctaataattctagttgaacaacacaaccttttccttcaagcttgcaattaaataaggctatttttagctgtaaggatcacgctgaccttcaggagcaatgagaaccggcactcccggcctgagtggatgcacggggagtgtgtctaacacacaggcgtcaacagccagggccgcacgaggaggaggagtggcaacgtccacacagactcacaacacggcactccgacttggagggtaattaataccaggttaacttctgggatgaccttggcaacgacccaaggtgacaggccaggctctgcaatcacctcccaattaaggagaggcgaaaggggactcccagggctcagagcaccacggggttctaggtcagacccactttgaaatggaaatctggccttgtgctgctgctcttgtggggagacagcagctgcggaggctgctctcttcatgggattactctggataaagtcttttttgattctacgttgagcatcccttatctgaaatgcctgaaaccggaagtgtttaggatttggggattttgcaatatttacttatatataatgagatatcttggagatgggccacaagtctgaaatgaaacaaaattcatttatgtttcatatataccttctacacatcacctggagctaatttatagaatattttaaataattttgtgtatgaaaccacgtttgtgttaagtgcttatgtgtggaattttccactggggggtgtcccattggggctcaaaaagttttggattttggagcatttcagattcggatgagggatgctccagctgtatttacacacgtattcaactcacatgtgtgcctgtggcgttccacggactggtggtgaagtcagatcatcaagcacatgggcaaatgcattttgcatcctgcagtggatatgggatgtgacctggtttctgggtaaacccagctgtttcccatagatgacagctgcatctaacaacaccagcttcggagcagggcttgtcttttctcagttccatgcaggtgacagggcaggaatgtggagtagcaactgggacgcgtttgcagaccccagggcccccccttggtcttagctcacaggcacggggctctctggtggtacccaaggccggtcggtcccaccaggccacaggtgatgcctcatctaggggcggctatgggccctggtctgggtgggtggcattaatcggcccctcagggcagggaagagtgagtgatcacctcagggatactgctgaggtcaactcaacctaaaataccatcctccaaatctcttcttttctaagtggatcactcctagttatgtgtcaggtctacaaagaatatgtaaaaacaacaacaacaaaatgaaaatgggaacactattattttggagggactttactgttcaaaaatctagaatagattagcaaaatatcgtagaaataatagcctcacaggtcaccactgccaaggatatacaaatctcagtggactctgggtctgagaattctggggccgttgtcttttaggtaagttcttgggagagctgttctgactggggacctagaggtggggctgacaagtaactgagtagaggttcattgaccacattcctgggacttgctgaagtagatgaaagggcttcctgaatctggaggacagtagggaagagatgagagaggaggagaaactgccctggaggcagccatgtttgagatggtccccagtggccagatgagcctcacccaggagagagggcgggaatgtgggtcagggtcgtgggcgtgcccctccccagctccggcttcccgtgcatcacagacatgcacctgagcctggcctccctcaggcgttatgagtgtcaggtgagaatgggcctgggcatttcctatgcaaatcagcaaggccacacctgcatctgggcacctgatgcctgagccggtcctgccggcacaagagtctccccagcctgctctctgatatgtcctcatttaggaaataaatatctagcagtggctaccaacatgggccaggaaaatacatggagctgatgggcgtggggaagtcagccctagttttttctcacttacttctcaggcttcagatctctgtagatgatccccaggctgtggagatggtctaaagccaaggccagctcagccaggtagaacttgacatcctcctccgtgaacatgacctagtaagaaaaaaacaaaaacaaaaacaaaaaacgtttaacttgttttatggctggtgtgttttaaagaactctgccagagagactgagagtccacactggggtcagtttgctctgtggaacgctatggccccccagagtggtcttctgactcttctcatggaaaagtgagttccctctgcagttccaagatcagtggatggagacgagggcttcctgcacaggtgactcatgccgccttgagagtggggtgctgagattcagcctctcctctctgtgtccttctcacccctgcaaatcatttggctctggagtaggtttctgggtttacattctagcatgagtgctgctcatgtgaattcataacaaatgtaatacaagtaagacgctgagggcttgatgaggtgactgaaaatggggctcaaatatcattctttccccatggattatctatctccactccttgggttgatgcaaactagtagcctacgtaacctgctgtcaacccaaagtgggattagttctaccaaagatcacccacaggtggtacagagttggctatgggtgccccaagctgagggggcgggatggggaggggtttccaggtgttggggttggcagccacattccgggatcccacgtagctgggacagctcagggctgggaggtgaccaggcagggatggcctaagtgtccatgtcccgggggctcactcaggccagccgaaacatgcatgaggcctcggagcccaacagactccaaagccatcgccccataatgactcatccccacccccgacttgttagaatcagcacatagattttgtagacccccttaagaggaagcaaaatcatgaccacaagccattttctatattcgtcaggagaaatcaatgttatggagactacaagtccacatgattactgaattctctccggtaagcagacgtgaaaaatcagcacgcagccagaaggctgcccggcaaacacaaaattagaagggcagccaggggacctgaacggtgagtggcgtcaggccgacagccgggcacccgcttcacacagggggttcttccacagggctggacacgcaggctctgcatcctgacagtgactggtgggtgccagccacccaccggccccccgagtccccgtcctccattccacgcttggccagcgcctttcccggatgtatgtttcttttctagatcggttaaggtgctcagtggactgactgacagcacgttctgctagtggcctggttctttcctctgacttgacatatccacacgtggcccaccatgggttttgtgtacaatttagggctcagaggcaaacctgtctttccactcccctagctcttagtgtaacccccaaggacaatagcaggaagtttctccatagaaagggaacacctcacggtgtgagttctgcaggttcaccggcacagcgatggtccccgtaagatgctggaccccgtacttgctaaatgacgacccaaggtgagttctgcaggttcgccggcacagcgacggtccccataagatgctggaccccatacttgctgaatgaggacccaaggaaaagactttccgcaggttcccagcaactccacgaatctgtggtgcccgccctggacaacttccctcctactccgaaatgaaggccctcgggggaggcacacattcccacgtggggagctgcaggactttttgctgattactgttgtctttttggtcagggggcccaaccacaggcgtgtcatagcagctgctggacaaaactggaccccaaatggactgactccctgtggatgagaggggagtggacaaaccaacagatgataccacatgaggaatgggcagacaccaggctccagcatctttggaaatggccacacagcaggaggcaaaggaaggggccagacgccagttcccaaaggcctttgtgtagagcttggatcaggttctcccggcccactgtttttcctccatgcaaggagccccacagaaacgtgcaccactgtccaagggactgctggacgcagagggacagggcagccatggtctctgggaccctttgcgcccgattcaggagcagctctgccttggtttactgttcatttggggctttgtgcaagacagcggggtctcctgctgaaaagggggaaggtggggaaaagggagtggggggtgtgaaggccactgttgctgtgaaagcacctcggccactcctttgtataagagatgaacaagcaggatcgtcagaacggaaagcccggcactggcactgccatgggcagaatctgccttttgccatcccatgaagcggggtgcttttcacgtcaatcagggccacggggctctcagggtgcagtgaagttgcatcctggagggttcctacctaaggcactggaggtcaaggagaagccctggggtgtgcagtagcggctgtgagacaaaggtggcgtgcgaagaccacacccgatgctcccgaacagccccaatgttcagccggcttagcagtacctccctcttccctccctcttcccaggatggaaagtgagaccctgtgagagtctttcccagccgctcctacccaccgacctgcgccttccatctgcgctagctgggaggtcaacagcgtgacttatggtcccagagctgcaggggcgctgccagggccacctgggacgattgctagggccacttgtgcagcttccttagaaccaggcagcaatgcacacagcacacccaacacacacacacacacacacacccaccccacatcacacatagcacacaccacacataccacatacagcacacacacacaactcatacatacacacaccctacataggcacacaggatgtcaaacacacagacaccccacaccacacaaagcacataccacacataccacatatagcacacacacacccacacacaaacacaccccacacatacacacaccctgcatatgcacacatgcacaaagcacaccacacaccccacacatagcacacaccacgcacaccaaccccacacatgcacacagcatgccaaacacacccccacatatacacatagcacacacaccatcacacacagcacacatcacatacaccacaaatcacacgcctgacatatacacacagcacacatcacacacataccacacacttatcacatgacacatgcacaccccacatgcacacacactcacattcccacacaccatgcacacacaaccccaaacaccacgcacacccccccacacacgcactcaaacacatacacaccccacacatcacgcacatgcactcacacagcccccatgcaaaccccacacatgcacatgcagtctcgcaaccccccaccacacatcatgcacacttgcacacactcacacatgtacacctctcccacacacgcactcttgcacacactcacacatgcacacacccccacacacacacacgcactctcgcacgtgctcacgtcctctcaatgctctccacccctcctcccctcgagtcccagacagaagctcctgcccgccctcctgtgtgatgtggcggctgctcacctctttggagagccgggtgaagaggtcccctccccgcaggaagtccaggatcaggtagagctttccttccgtctgaaaggctgtgggggacagagacccgcattttgacagcttgtcgaatgtcctgtggcaacatcgctctctggcttctccctgctcacggtgctgcttactccgggaggctgagtcacttgagaaacggcaggaccccggctggtgaccagctcagaggggcagcacccggcagagggggtctgacactgtgagcgctgcccctctctcactgtcgttagggggccttgagatttctttcatctttctttcctctcccctccctcccttttttaatcacaaaggaattgaaagatacacggggagaaagatgtgaatatttaagctggtatcgttgctggcttttgtcgtaatgcattagtgagcagcctgaagatggctctggtgggtttggaggacatgtcctttccgtcctatggaagtgccttcttcttacagaactccactctggtaccagggagccccccgcttgccttcctctcttgaggcagttctggtgataggtcagcccagttatttgaacatcaacaatggggctcacgtcctaggtctggtcactgtgagctataactgcagactttctgtttcaggccacaggcaggctacacagctcctgcccacactcagcaagggcctgcctctgttgagcgggcgcatgagcacgggagggtctagagaagcccgtcaccatcgctgctgtgacgatggttgctgcagtggcactggtgaggcaccgcgtggcatcttttttatctacaaaggaagtgtggctggaagggatcccaatatccctgcatactagaaaacgttttattttctaaaagtaaatgctagaagcatcataaatgtgggggttttagaaacatagcccccagctagaaagccctctgccaggactgtgtaaactgagtgtgcattaaatgctccatcctgggcttggcaggcaggtggaggtgctgggtcaccactgaggtgatgtggaggtctgtttaaagctctttgtaggacacccagttctcaatttcttcagaaaagcaccctagcaagtaatgtaaatgacacgtgggatgggacttgacaccagccacttggcagcagcggagggggcagagttttggaaagccagcctctgcagcctcctctgccgggaggtagaggtttgcaactgcgctgcccacggccgagaaggaacagcagggtgtgcccagcttctgcaggcctccttcatcctgtcctcagattcacgcaaatctcactaacacctccccgacacaccaccttgccctttgcaaccaagaacaaactattagttttgttgctgttcccttctgtactttgctcatctggattattaggtgggaaagtttaatgtaataagccatgaatctgcagccaccatctcatcacatcttttttaaatttgaagatttcacttactgcttctctgttgggataaaaaggcagacagcaaatgaagagaagttgtgtggcaaagcagctatgtggcctttggttaattatttgagcctcagaacatgaaaataataagctaccttgaatagaagttttgagggttcaacgaactactatctttaaacatgatattcatttgaaatgaggtgttaccatttctggtttaaagaaattattgggtcatagagtattttattctaaaacaacacaaaaataagtcatagattcaccccaatctaggttaagatcttctaaattatcaatggtatggtaataatttaataatggataccccatctaaaattagatctttgagatgaaaacagggcttcttgctctttcaaagaaaataaatacagaagagattaagtgatcaggatagaaggcaccttcctccccaggcagggcaggactctatggtataggaaagattttcttctttctgatctgttatttctttttcaattttctttgatctggagaaggttgccctgggtcctctttaaagtgtcattttgactctacttaccataatgaagcttcacaatgaaggggtgattcacttctgccaagatgtctctctccatcttcgatctcactcggtcccgaactgcaaagtaaaaagataaaggctttcatgaggcaggaaataagagttctgaggaacactgaacatgaaatactagatataattcccgccaacttttcattaaaaaatttcaaacatatacaaaacttgaaaaagttgtacaataatcctagatttaacaactgcttacgttttaatacatttgctttctctctctcatatatatatatatatatatatatatatatatatatatatatatatatatatatatgcatctctagctctccaaaaaattgtaggcagcacgacatgttactctgaggtgcatgtgcaggtgtctcctaagaataaagacagtctcttagcataactttaacacctactgtgccacataggaaagccaacaatcactccatgaaacatctaacatccaatctatattcagtcctcccctccacgtcgttttcccgacctaggatccagttcaattatattggttgttaaatgtctttgttttgctcctagaagacaatggtcccatacctatttccctcgccctgtattttttcgtggactttttgggaagtccaggtcagttttcgtctgtagaatgttccacattctgggttcgtctgatggttgctcatttgctttctaaaactcttgtatttcttgtaaactggaggcgtgataagattggggctaaatgattttggtcaccaggtgatgcctgtactttagcctgcctcagatcagggggtgcctgctgggctcaccctctctgtgtgatgctaaacgtgatgtgtggttgaggtggcaggtcaccatctctccatggaaaaggtcttcatgtccctttgtaacaagaacctgtgggctgatatctggcatagagtgacctgcgggttccctaacaatccttcatccaatggtgtgagcatacatacgtgatccctgcctgaatcattcagggctaaagaacagccatggtcacatttctgatggaactggaaatcaagaggaagattccttctctccctctccatgaagataaccatggaccatgtactttctgttgaatttagtgtgttacaacagctacatattcttcttagtgctcacactatctcaagtgtggccatctgggaatacagatgtaattagttttgatgcagaaacaaatgaacaaacaaagagcaccacttgagtaaaaacagctttagcattcccctgggcaagctgctacacccagggcagtatccgggacctcacacagccccatgagcgatgggagaaaatttcttcaaacattgctattgggacaaatatgatcagtattgtatcatgggccaggtatttaaatttatccatatttaggacttgtgatacatactgctaaagttttatttaagaaattcttcaccaagaatgctgcaataataaaaagaaaatagaaaattacaaactgggaggatgtggagaacttggaaccatcatgcattgctgatgacagtgtaaaatggtgcagtcactgaggaaaatagcttggtagttccttacaaagaagtagaattaccatgcagcccagcaactctgctcacaggatacacatccaaaaaaactgaaagtatggatttgaacgggttcatccacccatgttcatggcagcattatttacaacagaaaaggaggaagcaacccaagtgtccatcaacagatggatgaacaaaatgtgatgctgtagtaaatacacacacacatacacaaacacacacacacacacaatgggatattattcagctctaaaaaagagtaaaattctaacacacagtatgaatgaaacctcaggacattatgctaagtgaaataagccagacacaagaggacaactattgtaggatcccacttataagagttgcccagagtagccagaatcagagagacagaaagcaggatcgtggtgaacaggagctggaagggggagaatgggaagtcattgtttccacctgggatgatacaaagattttgggtataacattggtgaggacaacattgtgaatgtattgatgtcactgaactgttcacttacaaatggttaaaatgatcaatattatgttatatatgtcttaccacagttaaaaagagaaagtccttcctcattcctgggtccctgagtttcactgtctcaactcctggttttaatactcacacctaggattcaggctgtctgaagtccacctttgtctttggtgttgggacagttttgctttcccgtttggtctgtaatactgtctccgggggcccaggtggtgaccgtggtgtatggccctgcaacccagctcactgtcagtgtcactgtgccctactcttggctttggtttcctcatatacaaaccggatgagatggctccccctcctggggctgcctaagaaacctgtgcagtgatgtgtgtgccacaacaacacggggcccgcccacactgtgccgcttcaggtgtcattgcagtgacacctttattatatgctcagatcccctttttttctttttctttttttctgatctctccttgctgttccactgctctgcccatccctcttctaaccccagacccttgtcatcaccgtggtcctgtgacattccttacagcaggggtgtccaatcttttgacttcctgggccacaccggaaaaactgtcttgagccacacataaaatacactaacactagctatagctgatgagcttcaaaacatcacaaaaaatctcataatcgtttaagaaagtttacgaatttgggttgggctgcattaaaagctatcctgggccccatgtagcccacaagctgtgggttggacaagcttgccttagagtctagacaggcatcgagtaggcacccagcaggcagtgctgtgggcagagctgggggatactagtgtctcccctaaacctcagcacctccttccccagtggtcctcgcagttcctaatcccttgagaccaaaacaccaaggtggagggtgcgggagcgactgcttatcacttctgcccaaggggacacaggaggtccttcttctgcctcaactaacggaatcaggattttattgcttaaaagaccttggggagcatgcaattcaaccccatgttcttacagaagaggaaacatgctcactgcagtaaaaagtattgcttaaagttaggtagctcctggtagcctggaggaaggagacccctgcctgccccgctccactgggtgaaggcctggcgtacgtcccagccagcatgtgagcactgtcctcactggacacaggggcagcatggactgtggcacagaagacaaacgctggggaggaaaagggggaagcaagcaacctgggctgaaggagatttaatgagaggggccatgaatggaaaccactgtcccagtcgttaaagtggagcactgtgttcagaagccaggatagcgcagaacactttcaaagaatacaattttgtacccctggctatgattttctctctagagtaatgaccccggagtttagagattcttttcttcctttctgattgtagtcattgtgtgcaaacattttcagaaggctctcctgcagaatttagtcttgcacccgctcctgtttatcatttgtgagttcatgtcttagtgatctggattctgcgtgctggtcagagtagtttttcttctctatgtaggtgaactggaaaataggccataggatcgcggattgtggggagatgtgggagcaaaggtaggctcggtcttcctagcccttttgcaaatcagacagctgaatggtgaggtcacaattcttgccgcttggcctcaaattccttcctcccccacctcttctcctggcccactcctttcccatcactacttctcagtcttctttgtgccaggtgtttggaatgtgaagaggcaggctctgccctccaggaagtgagagcccagtggggagatgccctgtggtgatggcagcaaggggccaccagagggtgaccagtcccacctcttgtgtgctgggggacctgtgcatgctgggggaactggaaacagcctgggaggttttcacagaggaggggctaagccttacaggggacccgggagcctccaggtgcttgggcaggaggatacaggccaagggatggccctgtagggtggcagctggggtaccctcagggatgccagtgggctggcgcacagagctgcagtgccacactgatgaggcctgcgggcagggacatgggggcctggggagccaagagaccatggacaggactttcacacagcacatgtttagggcctctagatttaagaggtcatgtggaggatgcaatagcaacatggctggaatggacaacgtggctagaatggggcaaaaggatactgctatccagccctgcagagggacagatctggcctggaggagggagaactgagacctcaggacctctcagctgctgagaataaaaagaagggagctgcatcatcctagccctctgcctgggcgactggtggagaaattagccaggagagaagtcaggtggtgggcagggagagaagaggccacctgcattctcggcctgttgagtgctggggacatgcagggctcaggaaaagacttggtttggagctttgctggaaatacagatgcgaacgcccaccccacagcagcagccaagggtgcccaaggaccactggaggatatgtaggatgagagtagaaccatggtgaggacctcggtagggttactgttgttctggggaaggagggagagaggatgcaccatgatgtggtccacagtgggaagacctggaggagacagacagagaaatcaggaaatgtgaaagaagtgtttggtggcagcagatgctcaagacagtccaccaggtggggactgcaggaggccgctggtggagttgcatgactcatggccgattcatcagggacgatgtgatgaggacatcgctcatcccccgggaggggcccgcagctgggtctgtgatgtggtgggtgagtgaagtcagcatctctgtaaccccttggtgtgacttttagaagctctgatatactttcttattaaaacattttatccattcattcttgaaaaaatagttcctgatgtagataaaaagaagagagcttgttttattaaccatgactgcagttatgcaccagagaggacactctgaagggcaaaatctcatatcagcatcggcgtgacgtcattaggatgctctcaacacaagctggagattgccgaatggagctcttgtatctactaccctggctctgcagcagaggagaatgaatgtagggaggaaaagcaaaatgattcacagggaaaatgttacaaagaatgtctctgtgaaaggaaaataaatcctggggcccccacatcactaagctaaagggaaaagtcaagctgggagctgctgagggcaaatctgcctcccattctattcaaagtcacccctctgctcactgagataaatgcagatctgattgcctcctttggagaggctagtcagaaactcagaagaatgcgaccatttgtctctcatctacctatgacccggaagccccttccccgctgaagactggaaagtcttcccacctttgcttcgagttgtccaacctttccggactgaaccaatgttcatcatacatatgttgattgatgtcttatgtctccctagaatgtacaaaaccaaacggtcccctgaccaccttgggcacatgctgtcaggacctcctgaggctgtcacaggtgcatgccctcaaccttggcataaactttttaaattaactgagacctgtctgagattttgggggttcacatctccattgcccacctctcccccgttacagcctccaatagctacagccagtgtgagcaccaaagagtttcagggagttgatgaaagcaaacctggaatctattcactcagcacaaagaccccaaaggaagaaaggacacagtggagtcagaaagatttctctcaaagtaaaagcaaaggcctaggcagaagacacagggctcacgaatgcaggcaggctctgcaggaagccaggggtgggggaggcaggagtgactgcacacagtgggaggggtggggacactgccccttctaggatgattaaacaacaagcctctctctctctgagctgcctgctggcatcaaacaaagttaaactcaacaaggaaaacttctctgtcacacatcacacagccaacggggctgccattgaggacccgtgggctctgccacgccctagactcagaatgcttccacaaggagaaatcctcatgagatgcatgtggccaggcttcctacactgtgccctttatctcagcagagcaggcccaggctcggcagggcccacgggagagcaggccatccgtcattccaatgtgcctcctcttctgggtgaagtccctgttccatctgccaggccctgcatgatctgaagctgagacctggtgaagcagcatggcagagaaaaggggggttcctactccatcttgccatctccttgcaaagcttgatctttgactctgggtaagagcatctaaaaatcctctaaataggactgatgttattgaattcacatccatttggaatgaagaacattgtttagccacatgtctgactttatagcattggtaaggaaaacttggtaagtctggtgaaaaattagagaaagatagatgtcttatattcaaattttgaagggactacctagttacagtaaaaaaaaaaataggtctcctccctatatcttacactaaaataaatcccagatctattaaagaattacttaaaaaacaaaacaaaacaaaacaaaaaaacacaaagctggccaggcacagtggctcatacctgtaatcccaacattttgggaggctgaggtgggtggatcacttgagccgaagagttggagacaagcctaagtgttgggaacaggcccccaaatctggccataaactggccccaaaactggccataaacaaaatctctgcagcactgtgacatgcttgtgatggccttgacagcatggcccacccagggcggaaaaccacttaaggcgttcttttgttttgtttttttttttttttttttttttttttttttgagacggagtctcgctctgtcgcccaggccggactgcggactgcagtggcgcaatctcggctcactgcaagctcctcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccacttaaggcattcttaaaccacaaacaacagcatgagcgatctgtgccttaaggacctgttcctgctgcagataactagccagtgccatccttttatttgggcccatccctttatttcccgtaaggaatacttttagtaaatcttatgactgacttgctgtcagtaaatatgtgggtaaatctctgttcgaggctcttagctctgaggctgtgagacccctgatttcccactccacacgctatatttctgtgtgtgtgtctttaattcctctagcgctgctgggttagggtctccaccactgagctggtcttggcacctgagcaacatggtaaaaccctgtctctactaaaaatacaaaaaattagccaggaatggtggtgtgcacctgcagccctagctacttgggaggctgagatgggagaatctcttgagcctgggaagttgaggctgggtgacaggagtaaaacactgcctcaaaaaaaaaaaaaaaaaaaaagcaataacaaattataataaagttgaacacttatctggtgtctggaaggggaatcttttttgttttttaaatataaactatggaagaaataacacagtaaacatagttacaaaatatttacaaattggccattcaaaaagattataaaattaaaaggcaaacaaaaaaatatgattatcttaaacaagcagaaaaaaggtcaaaagccaaaataaatacaatacccaaatactatcattatgcttataataataaacagagaatccagccatgacagtgaatgcaacatattccagattaaacccatcagtgcagggaagacgtttttataagaatgttctgtatggttgactccccaggcacaatgtggcctaacacaagtatatgttgagtttagggtggcagaaaacaggaaaaggatgtgttcattccagggcagggctatattactgctgacaacactgtgtaactgaccatgcctagtttccatatatgaatgcaaggacaaactaaacaagatgtcaagggacaaggacagtcattacaccaagcaatgccctcagcatatgaaatactaggactggaaatggctcttcaagagggactagggaagatgttcaggtctgtgcaaattctagctttgctgggcagagctgcaatccactgacctcaccattgcccaccctaggtggtgtcagtcattcatggcccatatccagggatggaatgagagagctgcaaccatggatctgccaactgacagccatggagtgattcttccactaagaaacagacagtgaaagcaaatgtttcattttctgatgctgagtacgttcaagccgcctctttgacagccagggagtccaaggagttttcatttctaagatctagatgtataaaaaagaaaaccaagtgaagaggtttcttcagaaatgtcagcaacaatttcctgttgggtagttctagactactggagactctggagccaggccatttggcccaggctatagcgtctctgtgatgtttattctctggtacttaacaggttagtctggagttgactggggattgctactatagatgtgaaaagaataaatgttctcggctatcttgagattcgctaataaatggtaggcactggggataagttaaaatttcattgtccttcaaattagccctctatttgtggccaacctgccgcgtttcgggtttggatgatgtagtttccgtggtttactttgctctgttcagcaacctgtgcctactggtaccagctctaactgccatgtgctcttcacctgtcatggccccaagacaatccctggggctgagatggttgtggaggcaccaacaggttcaccccactgtgaagggcacactggtttccttcccaggaaaacacgggaggaagcactttgtgagattatcctggcaggcataggatatatgatatgcaactagagctactttctggaacccctcttcaaggtgcctcttttcaggcagcaatgcaggcattgctttgtgtttctgatttttaaatgatctccaccaatagacattatatgtatattacattatgtagtatattgtggtggttagttttacatgtcaacttgactgggctaagagatgcccagagagctggtgaaccatgatttctgggtgtgtgtgtgagggcgtttctggaagatatcaacatttgaattggtggactgagtaaagatcaccctcccctatatgggcaggcaccatccagcccactgagggccagaatagaacaaaaaagcagtgggagaggaatctgctccctgttgaactgggacatgcatgttttccagccctcggacatcagtgcctggttcttggactgagacttaaaccattgcactcctctccccacaccaagttctcaggacttcgaattcagactgaaacttataccaccagctctcctggttctcaggactttgaatttggactggaacttataccaccagctctcctggttctcgggacttcgaattcagactggaacttataccaccagctctcctggttcttgggactttgaattcggactggaacttatgccaccagctctcctggttctcaggcctttggatttgaactgaatgacaccccagccttcctggttctccagcttgcagacagaagctcctggagcttctcagccttcatacccatgtgagctgattcctgtaacaaatctccctctaagaaatgtatatccatcccgttggttgtgttactctggaaaatcctgaataatacagaatttggtacccaaaagtgggatgcccctataataaaacctaagaatgtagaagtagctttggaaatgggtaatgggtagaggttggaagagttctgagatacagctagaaaaggcctatcttgccatgaacagacctttcaatgtgattctggtgaggactcagaaagaaaaggagagctgtagagaaggcctacatcttcttagggaataactaaggaatcctgaatgctgataggaagtcagtatggaccagccatctccacagaagccggcagcgattctccaaggcaacagaaacatgaccctgcagccaactcagagagcatcagggctgcccacccatgtcaggccaggcacaagagccccagggtagaatgatttaaaagtaggggccactggtgcctgggactgcaagggcactgcctcacatcatgggctgcccaccctccagcactgctgtccctggctgtcccgggtgcagctctgccttgggcagaccctggtgccctgtgagccccagcagttgccttctggagggagcaggtggcaaaggctggcagtgactgtgtggttctcttttccccaccatggggagtgcaggagccttgggggtgtggctgcccttacctaaatttcaaaggctggggtccaggcacagaaccactgtagggccatccaactacactggattgggtcacccaaagctgtgggaggccacccaaagctgtggggccagggacttggagagccaacccctgccctgcaaagctccggggcagaaccgccaactcgttatgtccaaaaggcaggacccctgctccagtgggtctggagggcacagcatctagtcaaagaggattattctggagtcttgaggttccatgttattttctctgttgggttttagacttacttgggacctgttactccttttctttcctatttctcctttcggaaagaaaatgtctgtcctatgctggtcccaccacgggatttctgaggcacagagctcgtgtgttttcataggctcacagctggagggtgactgtggtcaggatgaatcataccttggatctcactaatacagagagatcgcagagatactgacattggggatcagaggaaaccatatgatttggatgagatgttgggctttagacttgagttgatgtgggaatgaagcggaggctatggagatgggatgaatgtgggaaagatatgaattttagggactggggtggaacgccatagactgtgtatgttccccccactaaattcatatgttgaaacctaacccccagtgtgatggttttaggtggggcctccgggaggtgattaggtcagaagggtggagccctcatgcatgagattagtgcccttagaaatgagaccccagagagctcattcatgccttccatcaagtgaggacacagccagaagatggctatgaaccagacagcagccctccccaggcacaaaatctgacacagcctggatcttggacttgtggcagaactgtgagaaaaaaatttctgttgtttagaagccacacaatctatgatgttctgtgatatctgcctgaatgaactaagacacgtatcgtatcatattatagcatactgttctgttctgttctatctaggtgataatacaaaagaaaattaaggttaagataaaattaaattaaatgcaattctgtcagctgctgtgaagatgagcaatggctgtgtaaatgcacctaaggaaaccactgtgttggggacgtagtggatgccgcactgaccgtgcagtgccaatagctctgctgccacaaacccacgggaccttggcttctgcacacacctctgtggggggctgagcatacgcagacggccttggtgacctgaaggcctggcagtcagaggctcgatgatgctttgtggttgatgcagcgcaactggagggattttgaagactgagccgacagacacactttcgcctgagacttaccagcactggagagtgcgggctgtgctagctcggtctcccccactgcgcggccattgcctgagacttcctttctttacccccataaaggctattgagcctgaaattatatcccgagcagtctcccagatgcagaataaaagtccttcttcccacagtatcttttagctttcaaaggtttaattcatagtaaaaaacggacttccacgagccatcgtgtggctaaacttttgggggcaaactttttacagtgaattactccacacataaaggaagagaagaaaaccataaataataagaagcaaagttaaccacactgattaccagaatgggcatgactccccaacaggtgtctttttattcttctatactcaagtattttttaaaagactgatatggttacttaactgacttccttaatagagaatctttgtcagaaaaatcttaagcccattactcttaactacttacactgcagaggtattaaagatgacaagtaatgaaaaaaatctatttcctcctttttgaatatctgtaattcaagaaatgcaactctggtaataaacacatagaggactccaccatacagaggcgggtgtatctgtaataaatcagatgcctgttaggtaagggtgatgtttatctgaaatgcaagagacagagtgagatcgtaccttacaaagggcttgagaaagacagaagtcaaagatggcttaaggaggagacattttcattttgtttgtcatcttatgcaattaaatgggaaatgaatcccttgaagagtaaacaccttaagtaccatgagcagggatgtagcttcttgctgaagaaatgcagggagtctgtcatctggtgaggatgcagctggcccagggaggcctggggaccccaggagttatcttgggataagcataggattctgaccttcaccacctccaaacaatacgcttttgagtaactttgctgccttgtgccttagtttcatcattcgtaaataaagatgatgatttataaaaatataataataataataacagtcctcccctcttaagagagggcaaaattgtgcttagaattttccttacttttttctcccctgggaatctgaaatcatccaaatgggaatcaaatgacataaatgaattagcatattatggaaatacaatctgttcaagctaccagattgatcggagctgagtttctgagtgactcagtgccttctaacgaagcatctcagcataagagaggaaaacaaataaagaggtgctgaaaataacattctggggtttgcagccaggcgggctaactccgaggaggttctatttcaagatgctgtcattgatacctgtctatgcgggtcactacacacagctctgcattcccagtgcctctgcagtgatcccatcttacaggacgtgctccactgcttacaggaaggacagagggggctttgacatgttggcaagctcggactgtgctgcctaggcccattccagcatctcctgactgccgtgggtgccatgagagtgacccaccacacagctgccaaaaacacacaccagcataaccatcagtgacttgacttgcttcaacagagagattctgctggaatgattttattttctcctttacaaacaactgaacacagcttatttccttccaggaagggaatgcatatctcctctaggctgagaaagttgacttgcagggaaaatgcttgaaaactagttaggcatgaaaacccaggtgcagtcctatcagaaaaatcatcattaccaagaaatatttcacgtaagcagctcattcgacactgcggagagcgcctaccgagacgaaggaattccacactgcaagccctcctgcagaagggcgcacctgtgttctccgtgcaggcaccggccatctttagtcatgaacatgatcacaggcctttcatattgtaactggaggtattacagctgaaccaagacatcattctttctaaccaggtggcatctaacttcctccccacatccctattcagcagaactaaataaaacctcaaccaggaaagtcctaacacagctccaaagccaagcagtctttgtggagaaaagggctgaaggtgaacacagcttacactttccaagcctttgcttgagccggcagcactctgcacactctaacaagggagagcctcacgtcggcaatgatgtggggtagttatctgttaatacaacctatcccactttcagcagggggacactgaggccaggagaggcaccccaagatgacacagctcgtggggttagagctggactcagctccagggtctggacttggtgttcctggcccctgtatcagggattctccatgttggcagtgccctagagacaccggcggaggtagctttcatcaattctcgcgctcagaccaaccaacttagagtctcccagaggggtccgaggcatcagcatcttgtgaaagtcccccaggccattccagcttgcagctgaggatgagaactactgctccatacaatacagcccatctcttaaggtgcatgaccaaccctgtttgatgaagatgaggcttggttcattcttggtctcacggttgggaacacgtttctttgcaacacattcttttaaatcaagttcccttacaatacaaagtggggatattaccctttggaattcattttatgtggaatgcattatatagaacggttacctgtaataactccatgttgagtcatgaatatggaagctttgtcaagttaaaggagtcgagcacatttaaggcatccttaagtactggggcgacaggcagcaccgccgggtcagagggagaggagcaaggttgcaagcgcaccccagcagtgtggccccctcagcagctgagcagatgacctccctcggaagtgacccaccccctctctaaaggaaggagacgggtgcccaacgctccaaacttgtttggagatcaaatggagccgtcggaagccattatcctccgaggtgagctggaaggaatcccactgacaaccctcacttccaggcacaggacaatcagccacggtttggagaaacaagctggagtttcaaaatgacttctgcaggtctcccgcctcctttcatttttctttttcaaaacatttgactattcacatgcctggcatcttccctggacggccgcctgggctttcggggttttgctgtcagcaggtggagagcatccctgcggctgttaccatgcgttccttctttctccttgacattcttcaggatgattaatgatctcacaaatcagggatattatgagggtggagaacgggttaggagatacttgaacaacttgggctaatggaacgcagaggtgttagagctgagacaaacttggaggtccctttgagtcaactctcttctttcacagatgaggaagaaacaagaaactaaggttttgggccagcaggtgtccttgcccaggctaagtgctagttagtaccagttagtgctagttagtgccaggcctcctctccacataactccgctgcatcatggttagatccagggacctaacctacttcgaagtatgcaaagtattatttgcaaagcttttctatttttctcttcagaaaatagattccaatgaaatttttgggaaaaaaaaatctactttttagtgatggatcattacggaaagccgaaacagtataagatgtaaaacaatgattagttttaaagctgacttttaaggaacacaaggaaacaaaaatgtttctattcttctatgtttatatggctttttttttttttttttttttttggacagggtcttgctctgtcacccaggctggagtgcagtggcacaatcacagctcactgaagccttgagatcttgggcttaagcaatcctcccacctcagcctcccaagtagctgggaatacaggtgtgcgccaccatacccagttaatttttgactttttaaatttttcgtagagatggggtcttaacatgttgcctaagtctcgaactcctgggctcaagcaatcttcccacctctgccccctaaagtgctgggattacaggtgtgactaccacatccagccacatggctcattttcatagcataaaaataattttagctactcaagcacattgttccaaaatattttaaaaataactttacattacaaaaaaattagagatatttcatttctgttgaaaacttgcagtaacagagtatagggaagaagacaacagctagccccaatcctgtaagtcagcccttcactttggcatgtttgcttctggcacaatgtccatctcatgtgtgtacacacaaatacacacacctcactactgctcaagtcactcttaaatttaacaataccatgattattctgtacacagagttttatgtccagcctattccacataaccatggatcaggagccgtttctcaaggacactgtggactggattataaacagccgtggatacttgcattagggagagtgaagtcatcgagatggagcgttctgcactttagctaagaggccaaggtcagccctgagggagtccaggcttagcgacaacttaaacagggtgcagcttcccgctcctccattccactgtattcctacagagcagagcaggcaggcacagattccagctgcattcccactttgcctccctttccttcagtggcgggggagggtgaggccaactttgaagggaaagaaggaaccgttacgcttgaaggagaaaaggagctcttccgggtcactcctggtgccctggagaggtgaacatggaaccgcctgatggacagtaggacagtgtgtggccaaggacaggctggagagcttcccgcatccacttgcctttgtcttaaaccacaggaagatgcctcatctgtgtttgagagcaaatctcaatgcctcgaggatgaaagagtgggttttaggaaaggaacgtattatctagcagctgttcattttaagaataacagctttttggagatataattcacattccatatgatttgcccatttaaagtgtacaattcaatggtttttaggatattcacagagttgtgtaccatcggtgggttttaaagattttaatcacccaaaagcagctccagacctgtctgcactcagttcccacctctctcaccccccagcctaggaaaccactcatctacttcctgtctctagggtctgcctctcctggacggtcatatgagtagaatcttaacccgtgcggcttggtgcctggctgttcccgctaagtacactcttcccaggcttcacccatgttggagtgggcaccagtactttattcctttctattgcccaatatcattccgttgaatagatagacactttatttttccatttcccagatagtggacatttgagctctttcccttttttggctactgtgaattggctggtgctgccatgaacattcctgtgctagtttctgtgtagacagctgtgttcatttctcttggtgaaccgcctaggagtggaccagtgaggtcgcatggtaatctctggtcaacctttcgagaaactgcaagaacagttcactgtgttggcattcagatgatcctgcactaacaaatgtctaatttaacttcctattttgaagagatagctgtaactgaagagacatagaccaatggaacagaacagagccctcagaaataataccacacatctacaaccatctgatctttgacaaacctgacaaaaacaagaaatggggaaaggattccctatttaataaatggtgctgggaaaactggctagccatatatagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattaacaaatgggatctaattaaactaaagagcttccacacagcaaaagaaactaccatcagagtcaacaggcaacctacagaatgggagaaaagttttgcaatctccccatctgacaaagggctaatatccagaatctacaaagaacttaaacaaatttacaagaaaaaaatcaaacaaccccatcaaaaagtgggcaaaggatatgaacagacacctctcaaaagaatacatttatgcagccaaaagacacatgaaaaaatgctcatcatcactggccatcagagaaatgcaaatcaaaaccacaatgagataccatctcacagcagttagaatggtgatcattaaaaagtcaggaaacaacaggtgctggagaggatgtggagaaataggaacacttttacactgttggtgggactgtaaactagtttaaccattgtggaagacagtgtggcgattcctcaaggatctagaactagaaataccatttgacccagccatcccattactgggtatatacccaaaggattataaatcatgctgctataaagacacatgcacatgcatgtttattgtggcactattcaccatagcaaagacttggaaccaacccaaatgtccatcaatgatagactggattaagaaaatgtggcacatatacaccatggaatactatgcagccataaaaaaggatgagttcatatggtttgtagggacatggatgaagctggaagccatcattctgagcaaactattgcaaggacagaaaaccaaacaccacatgttttcactcataggtgggaattgaacaacgagaacccttggacacaggatggggaacatcacacactggggcctgtggtggggtggagggatgggggagggatagcattaggagatgtacctaatgtaaatgatgagttactgggtgcagcacaccagcatggcacatgtatacatatgtaacaaacctgcacgttgtgcacgtgtaccctagcacttaaagcattaaaaaaaaaagttcactctaaaaagcatgggttaaattacgttacaattgataacactgaactaaaaacttgagtgcctacaataaactagaatgtctcacctaagacttttgtgtacgtaagaattactgggacatcttgtttgaaaagtcatatatctaggccttgtttctacaagatgatgattcagtagatcaggagtggggccaggatctgtgtttgtaacagtcctctccccgcccccaaacacacagacaattctaatcaggtctaaccaaagtggtcaacttctgcattttcttaccattggttgtactgataaatgtcaaccagatttctctcccctatagaattttcaccagaagtcccacggaccttctaactcacttggaagagctcttttcctcctttgtatacttaagtggtttaaagtctgtacatatttggtctatgcattttttgtccttcttgttggtgacaggtccttcccaacatatatctcatttcctcagctagaaggcaagtgacctgaaggcagagaatgatatatttgtactgctcccctgcctgtagttgctggggacactgttgcaagacctaaaaattcaagtgccgccttcacatctcagagcctcatggggccccaaggcctctgcatgagctccctgctctgccaagtgtgcccccctcccagagagaaagtctccctaccctgcaggtttccccataagctggaccagctgcccccatccagcacccaccctaaaaggcttcagttccctgccagcccacagaatcattccaacaagccagccacaccttctgcaggaaccaggggccacgtgaccctcccgttcctaggaagcctgcctctcaccgtctcggcacctaagtgctgcccccgtgacgccctgtgtggcacggggtgccctcctccccagggggtcagtttatgtaactaataagctgctgtcagttcatctgtccagtgcccggcgctgtgtgttcaatcgcctaatgctgtttagggcagggggaagttccctctctcaccaacacagtgaataggaggtgatcagaacagatacggtaggtgcccagctagtgacgggcttaaagactgtgagcctggaacggagattttggatcacattctgactctaacgctgcactaggggctcatccctcacttgcaggatgggcgtgcagaggagctgggcagaaatcggtatttctaatgcccagtcactgggtcaacaaaggaaaacaacccaacccaaccatgagtcacgttgtatttaaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctcttctctgacaattgtggaaactctgcagggatattttaaatattcatggaaatgtttatactgtttattatcaatcagagagtaatgtgctcatttagagacattttcagaaatcgtgaacattaaatggaatgaatatttcctcaaataacggagtagaaattgcagttacctgtctctgaagcagccggcccttccgaagctcttaccttttagggtggctttcttaaggaccttcatggcgtagagctgcccagcgtcggaccccttcaccttcctcaccaggaacaccttagcaagagaaaacggaacatcagaaacccgtaagacttcaaactcgctttccatattggatttgacaaggggatacacaaggaagtttagagcattttcaataaaacaagtacactggtgagaatttaaaattttctccaacgtcaaggctgccggaaaatgctctaagttcctatagctctgcggcgaacatcactatgtgcctgtatgaagaagcgtcatttgtttttggtatcattaactttgcattttatgccagaaataataccgccccttgttttgaagaccagctgtttagaaaaacaaacaggagttttaagggagatcctttggtttgagtatccctctgtaaatccttactgagagaccacgctgaaaggtattaccaatcacacaaaacaggctctatccgattttcaagaaaagctactttctcttacttcaactgtcttcacccaaattttagctgtgagtagcttaagagttcctttctaactggatcttaaatacacttacggatatttggcaatgctttctgaaatacattttgatgtgtatcactgagaaaaacaacaaaaaaaggtaattgagagcttgagtttaaatttgtattagtgattttttaacaaacttagtaaacaaaactggagttcctttgtataaaaaaaaaaacttccatgcaaattaagaaaatagtacttgattttcctaaaagtgttttccaatagatgcaaatatctgcttgcatgatggagatgacacaggcacacggtgcactggtgtggctgcccatgcagtatggctggagggccgaggtagggtggctccttcccaaaacgtctcctttactaagcctcaaaaagccagaaagaccagccactatagatgttctagttccatggaaactccaggtggcccaagtgagcatccgtgtggagcagcagcctcacctgccatgggcagagggacatggctgggacctttgcactcttggctcccccccaagactggaggggcaacgtctagacacttaccgagtgcaggggctctaggagcaggggctgctagggcagcccaactggagggagaccaaccagcgtctattctagaggcacaaataaagagggaccgggaagacgcaaggtcccagcacaggcatgtggattcacggagttgctgtatcagtgtcacgctctcaccatgtgcccctgaagtgattccggaccccactgctgccctgccatctgtcccgatcactgtcattattgaatcacagcccctccccaggtggggactcttctagatgacgcccatgggaaagcaccccagcacccctacccggggtgcaggacggtacagcatcatcctgtgtgatgaaatgctgcctctcggacccgattaggtcccaagaagtcacaggcaattagaaagaggcttccctcttcccctgggttatagactataccatcaccgacagttaatattcatctctgggagatgtgtggagtgtgagagagagagagagagagtgtgtgtgtgtgtgtgtgtgtccccaaagctggataaacaagcttgtggtgaagccctggggcgatagctggggcatcacccttacgcacactgtggtgggagacacaggcacaagcccttctccgggctcaggatcccatggctcttgctggcagacccactgtagccctggaagttactgcacatggaaggactctgcctcagggtgttccctctgtgcagtgggcgagcttcctgacaggcaggtagagatgtgaaggcagtggtctgaggacaggatttttacagagagaaaaacattagtgcttaactcttgagatcttctgctttgaatcacgggaaagtcacatgccatgcacagttttagcttccatctgatgcaactcctttcatttctccagcccgtccgtgtgcctaatgtccctaggttgacttgatgagtggtgctgtggagatcaggaccagccaggacagtgcagggaggaggcaggcgcagcccaggagtccaggagctgggcaaggctgcgtgagcgtcccggtgccggagaggccgcactggcagagaggaacctgggtcccaaaaaagtcggagggggtgtggaacaagggacagttgtgtttgtggcagggacgccacatttccccggcatcctgcaggtaagttgggcagtgacaccagcaagggcaggggtgtgccttcctggcctaggcaatgaagagcaggtgcaaaacgttccagctgccactccctgctgtggcaactgaggacacctggtgcaggacaaaccgggcagcctggtcactgagtcactgtgtggaggatggaagccttgggtggttgctccagcccatggtggactttggtagggtgacagatgaatctatccattccattgcggcgaagctgacatgttagctcccaaaataaggcattcttataatcagaaaacaaagggccaggttcagtggctcacacctgtaatccagcacattgggaggctgagacagaaggatctcttgaggccaagaatttgcaaccagcctgggcagcatagcaaaaccccaggtctagtaaaaataaaaataaaaattagggctgggtgcggtggctcacgcctgtaatcccagcactttgggaggccgaggcgggcggatcacgaggtcaggagattgagaccattctggttaacatggtgaaactccgtctctactaaaaatacaaaaaattagccaggcgctgtggcaggcgcctgtagtctcagctactcgagaggctgaggcaggagaatggtgtgaacccgggaggcggagcttgcagtgagccgagattcagccactgcagtccggcctgggcgaaacagcgagactctgtctcaaaaaaaaaaaaaaaaaaaaaaaaagaaagaaaaaacaaaaattagttgagtgtggtggttggtggtgcgtgcctgtaggcccagctatccgggaggctgaggcaggaggatcgcttgagcccaggagtttgcaaacaacaagctccctctttcaaaatgggaggaccctgaagaaaaaggaagcaaggtacatgacggatttgtgtttggacggtgcagccttcacaatatcctgagtgggtccgtactttcaatacctctgcactcaacccctaacccataagaagtacgaccgtataaactcaaagagcagaggaagccccattccactcaagtctgaactggagaccaagtccacatggggcagctgccagttaagatttggtttaaatgatgtcaagttttgcataggtcttgacacatgaaacttttctctctcgtatgttaggccttaaagatgagatgactgatggtcgtggctaatgttcatacttatctgttttgaagagagaaccatacttttgctttttaaaagaatggaaaaaactccatcctaccaatgtctgccaagcttctctgtggggccaggtactgcgaattcctgcagcaggtgctgcctgactcgcaagcacaggacccagtggaggggaacggcaccttgagacgagcagcaaaatacagcaaaaatgcaaaaatgattttggtaacgagtgtggcaacttgctggtctgcgacagggatcttgacccttgggtgccgtgcagttccctctccctctctgctgtcattcttgtcactgaagatcaattttaatgtagtggaataagctccaaaacaacactgtaacctcgagctaacgcaggcactgtgtctttaatactcaacccagtgggcgctgtgtgtgccccctcatttcatttttagaactgcctctccagcagcttggcgtgctgcattgcaaagatgctgtgagaaccgcgacctggcaacaggtgcgatgtcactctgaactgcctcatgatgtcatggatcaccgtgatctgctgattctctcagcagaattctcagctctctctcagaactggagggtttctattgggctgcaaaatccttcaagcaggagctaaatgcccatgtgcacttccagggacttttgagtaacagccacccccaaaaggaagacatttaaagacatgttcttatcatgctaccagcaaagtcagagaaagcaaggatttttaaaaaactttggtttggttcctttttcgaatgcaggaatcataacctacagttcattctccagaatattttaaaggaaaagaggtttcctatcctactcctggcacttatgcgaataggggagctccaggagcaggtgaggaggtgggaccagggcaaagccactttcccagccccggggtggttcccacacctccctcctctaagctcgcagggaacactgggtctgcacccctcctttcaacactgaacaagcttcaccatctttcattgctttcctgattcaagctttaaattgcttttcattttgaggataaggctgttttctgtgcttttctctggtcccaagcaccacccatggccctgctctctagatagcgatgaaatcatgatggcttcgccttgcaggactgagctcagagctcatagacgcttcccgctggtggtgagtgcagcttctcccacaggaacaagcttattccggctgaccaggtgaagagcagcggcttcggagagcctaagcggctcacacaggcaggcaatgggacaagtcactcggatggctcctggtgcagtctgaggtcaggagctggcaccagtgcaaaaagtctaaagggaagaaactgcatgtcatccatttctgcatctccaatgtcatcattaaataagagagaaagaatggagtggctcagtgacaggcaactatgagccctgttgaaggactcggctcccaggcaaggcctgtcccgggacactgcgtccagattcacaccaggtctttgctctttggagcggaggcaggaggtggaaacctgaagaacaggtgctttctgcagaatgagaacattcagtgttgtccttctgtccctggtaggtgcaaaagggaagatgactcttgcataaggttgtgttatttgcatgtagagaggaggaatacagtaacgtggggcattagaacacacggcttctccccctcgtcatcagttttgcttaaattaaaaaaactcaccacaaacaaacctatgtggacaaatacaatttgtatctgtgactctctagtgacgatattagctccaaccttccctggaaatgtctgagcaacgcttttgagaatagtatctcttctttccagagtccagctcgcattaatccacgaagcggacctaagcctcccttcccacgccagccccagcctggacctcctgccccgcccctcacaccagctctggacaggcattactggagctggcccattccgtaatccctggaggtcagacacccatgggcgctgccactgcctcatccttctctttcccctacctactactgttcttgaaactttacgttttaattcctcatataataaagacacaagtaaagataaaattagaagtggtgaaaggctgggaaggaaagggacagagtgttatgagcattatcattccaacgggattctgccaaacaccatgatttcacttgttttccaaaacatgtttttttaaagcaaaattaaaattcaaaatttgaaatctgaacgagggagctggaaaagcctttctcctttcatctttaataccccagttctgtgaggaggacattggtaagattcactctgtaacagaattggtcaaccaaagccctccagacacttcctgggcctccgccatgggatgtattccagcgctccttccctccagataaagacgattcggctgattctgtgcttccacaggtggaatctgttctcaagaaacaatgcatgggcaacacccttgaaaggtggaaaaaggaaagaatgcttgcttgtctctgttttcaaatcatggagaaaattattctcctctctcttttttctctacatttctaattaatagtgaggcattccactgtcacattacgcaggctctgccttctgtgattttgtgctttttggtaatggctattaacatcgtgagaaactgaaatcttcatccccctatttcataaacaccatatcaactagccatattaaatagacatttttgtaggcccaaaatattgctggtaatttcctatggtttaatctaacgtataaaaattttacaaacaatccagttcatgcggactgtaggattatccagaacaccgatgtactattcattccatccagttcatgcggactgtaggattatccagaacactaatgtactattcattctacacttaaattaacagcagccacatgcattttggcacaaagtcatgtgaagaatgcaaagatttggtaaatgtctacataccacacaaaaatagttactttaaagagccaggctgttctgcttacatgtaaggaacggttggcttcatggtttatttcaggcccttatgttctagaaatcaagttgtcagagcctatatatttctaacagctaacccaaggaggcagagaaatcagcattgtgctggagtaagtcacgtgtcatcataattgaaaagcgttattgacatcttgttgtatgtggacgtggcattaaatgaagagccaactatttctcatttcctgaaagaaattagcttttattgctgcaatttgaaggtgacaaaaaagggaaatgaacaattccactgcacaaatacatcttaggcacctgctgggtgggattcgtgccctatttactccatggaacaactgtataaagtaggttttatcctttccatttagtgggtggggaagctgaggcttcatgaggcaatcgtgcagggtgaggaggggagccggctgcagaccctagccttcctggctcctgtgcccaatccagaggaatggattcttttcttttctttattctttttttccttgttctcttatttttttctttctttggggaaaacagctgctagaatgcactttcaaagatacattggctcaggtcaataaccttcctcaccttggtgatgatttaccaagagccaagggaggctctagagagaaggcaaaagtgcatgtgacggctccaacggcattttgttctcacctggcacagcccagccctgtgccactggaattctggctgtgcaaagtgagaccccggttctgaactgtccaggttcccgtgatcgcagccctgcaggtgaggaccgcctgcaattttcatccaggggggctctgtccaggtgtcctttgtgttcaggaatgagactcaagagacagccagggctgaacttacctttccataggatccttgtcctaaaaccttcagcagctcaaactgggaaggatctgccttctcaaagccctccttcacatgatggctgatgtctatctccttcacgacgccttcttcctgcaagagagcggcacgggtgagaaacacaccgcgaggagtccctcagagccgctcacagcttcctcctcccctgagtttaccacgagctgggtctgttacagattttagcgctggagtttgaaagtggagacaccatttagttgtgtttttttcttttttttttcttaagacggagtctcactctgtctcccaggctggagtgcagtggctggatctcggctcactgcaacctccacctcccaggttcaagtgattctcttgcctcagcctcctgccaccatgcccacctaatttttgtatttttgtatttttaatagagacgagatttcaccatgttggccaggatggtctcgatctcctgacctcgcgatccacctgcctcggcctcccaaagtgctggggttacaggcgtgagccaccccgcccggcccatttagttttatggaatcaacttggtgatgtgtgtggttattgtgtgcaccctgtgggccttcatggtttcttttctccatggacttttgtcatttggtcttaccaaggcctccgaaaaatctaagggtactctcaatgaaatccattctgctctttaacagtctgggcagaagttctggtacgatgaatatagcaactatggaacaaaatgacagcaaaagcatattgacgggttcctagatggagaagtggtctggaaaatgcagacggcttgtcctccttctccttctgattcacgctatccctggtatgtttgtcaaagctaatgtaaagaacacgtcattgccatcctatagattatatttcagaagaagcagtcaggtaagatttgccaccagcccagaaagcaagatttccctgtaggagaaagagtctataagtgaaaacactgacagaaaacactacaaattttcatcccagagcttcctgtccccagagtcacatgacttcccttgtaaaggggtaggccatctgcccaagtgccaggccctggaaatggaacactggaaaggaggtgtttctcccaacatgagacattcgagcccaactgttccttgaatttatctctgcatttctctgagatttctgttccactatctatacattcgtacacccctttctacagttttagctcggggtgaggggctgaaaaacttcagaaactgctggctaaaatgcgcatccaaaaacagcaaccaggaattgtatgcatagtgtgctctgggaaccaggggcctctcattcctcattgcttcttttcatgaagaaactgtgaagtggagattttctcctgagactcagattacacattaatagctggaagtgatagaggtgggcttctcatcaaggactgacttcgaagccaagtacttccaccctctgttttactctaagagtgaagacttccaaatgaaatcacaatagcaataacgtacatgacgatgtttgaaaaattcagtttctcaaaacggttacttataaatcttgctattttacctccatgtcacaaatagaggcacatgtaaaagcagataaggtgtctgagccgtggaaactcacagcggattagaggcctatgcagttatccatggcttttccattctcagttaaaggaaacactttcgtctccatatcttcaaggatgatttgctatttttgtaaaaacagtggtttttttttgtttgtttgggaaaacaatgagtatagccaaaattgactctgtttaatccatcctgaagttcatatgagtgcagttggaagatacagaattacaattttgttgcttcataattacttcttgaatgagtaagtaaaaatgctagaggcacagcccagccaatgggcattatatttagatgctaatttgtgaggggacatcacattttaagcccttcctcccttcacagcacaggcttactagaattgcaggaccatgctagccacccgagactgtgcagcttttgtggtgaaatctcctggtttatggaaagggacagaaaaaaatgaggccctcagggatccacgtgtgtcactgcctgtgagaaccactaccttccacgcggctgctggaggtggcttcctgcacaaaaaacaaaggcaggagcccaagttcaaaaaaattcatcatggaaacatgtatgctatcttttcccgtcattgacctacgaaaggaagaaagaaattgcagacgatttgtcatttaaagaacaacaaaatactcctcttctgttactaaaacactgtcctcgcaatgggtccattaacatcctctacctacaggactagcacgcgcatgagtcatccaaaccccagcctccctcccaaaatagctcccatcatgcagctgtgttaatgcgacgcccacactatgaaaaaaggaatcaccaccaaagcacacccttctgtgacttcattttggtaacgagagcatggcaacggccacactgcagaacagaaagtaaaattcaacaccgcccagaggtgtggggcaggcgaggcacgagctggccagggaggcttcacactgcagccaccaccctttcctggggcacgtttcccagcccttgtgtatgtttcctaaagatttccagttccttcctttttcttcagcagctctttgtggagggtctgagacccacagctgtggtgaatgagctcatgcagtcccatgggtcctggtccccttcactgcctttgtgggacatgcctttgtgggactaggctctgaagcgagagtgacagcatccgggctacttggatgccacctggccatggacgctggcacctcagaattcccatgggtgttcccctgctcccagtcagcccgttttttaggctggcttcacgccttcctcagcacttccaaattgccatcccctgttgcctcccgcctccccggtccatgccacacccccacctccgttgcagaagttcaccttctttagtcatttctgtaacgtttcgaatcaaagccttcgacgcagatatctcataacatttcaaattttgtgcagattctttctgtcaaagtattgagagcaaatgtacctgaagtacacacataatttcatctcctaaaatgacatgaaaaacgccagctttcttccctaataatattgcgatagagttcacttctcatttcaaatcagtaaggtttttaaccgcaaagcatctgaggcgtcaatggaaaaaaatccccaagagcatcacctttcagacttcagagttctgccttcacagtgacattttagcttgaacttgctggaggatgcttaactttctttttcactttccccaaaacgaaaacaaaacaaaacaaacaaagatctggtgttccatggactcggcgcgcactctggggtctgtgtgaataggaaacagccagatgaagccccagcaccatactcccgggcactgctgataacgaccctctctggacagccctggtttctggatcccttcatgacaaccaccctaaggggcaactagcatgaaaatgttactcacatttcattttgaaatatgtgccttttctgttttatgaagcaggtaattttatctagagcttgatgaggatttgcatgcaatgccttaggaagatcaagtctgttcctgaatcggctgcatccatggcaggagcatgtggtttccagcacagctactgtaaacagtatttttaaagctaacttgagagctttgggaggaggagctgggacggtgatcaggtgctagctccataagcaacaattccaaacattttgtaacgtaagaaagaaaaactagaggtataaactgtttaaatgatgtttgaatgtgacaaattgtgacaaggaatttttaaaattcctgcagaactgcactcaaaattccaatgactgcaggaagtcccgggcaggtatttcagcagctgctgggagcggctgggaagtgggagtgacagggagaaagatgagggcggttggccactggctctgcatgcctctctctgggccaaagtcgccttcttaggtcatttcctctgctctgaatcacctgctcttcatgtcattaaagggataatatttataaaaagtgcaaattaaaagttgtggaatattaatgataaggacataggaaacaaaataggcaagggttcacctcatttccaaaaaaggagagaggtcattctataaatcgcagattcacatgtaggatattaatttccagaataataacagaatatattattacacaggtggtttatgaaaatgtggaaaagaacgtatctccaactcacaggtcccatcaagccagcactgttctgctgctgacggcatgaactcatgagcaggtggacaagagcctggctttgagggcagctttggtggagtccctcctgaatcccaggtgacaaagaggctggcatcatataaacgcttaatgacagagtaccacatcgcaagtcattctctcaaggcacagaacccggacacacctgcccaggaacagtatcgtgtcctggaggttctgaacgtatgaatgttctatgttgcccacctgcttcagaatcaccccaaggaacttgttaaaatgcagattccaggccctgggcaaggccttcttggtctggaatctctaaacttggcttcgtctagaatctgactttcattatctcaccaaaggtgcccttctcaagccatccaaatcttacccattgctaaatcgagtggctaaatttccatcctccatagcactgggcatggctattcactccctctcacttgaaacactctcttcacctggattccagtacatcctactcccctgggttcgctcccacctccccctctttctgtgtctgccaaggtcacctttcccctgggcacagtccctggccttttgtctccatgtagttacccccttggaacctcgtcctgtctccgggctttataaaccatgtgaataaacactgacaactctcaaatctcaatctccagcaggggctgctcccagaggtccagttctagaggcccatccatcacaggcaactgtcctgagtgtgtgcacgtgtgtgtgcgcatgtgtacatgtggaatgcacatacgtgagtgtgtgtgagacaggtcttgttctggctttttctcacattgggatggagctccttaaagtcccagctttatgcaggaagtggggcaagaggtctgcctggggccagccctgggatttgtcaccagttcccctgccctgtgaggctgtaaacagccaagctcaaattcaccaggttgtcacctggcctccaggagaaagctggctttaactgtctccttccttgggttccctgctctaacacagggtttggcctctgcgtattccttactccccagctcactcacacttttaaacattcttaaagggatacttgatccaggactttcggttgtatttcacatgagggctagccacatgtagtctaccacgccgctagaatggaagctcaggaatgcttttaaagggagagaagattcactaaatggctttttagcctcttccggaaaagaaagacagccgcagacttgctgagaagagtagaggggagtctgtgcaggaacagcccccggagagcgagctccatctgcggcacgactcctgatagctcgtgggtcctcggcctttggttaccaggaaagctggctgcaccagtgaacacatgccacccatgacaaaaatcctccagtaggccgtttttgtaattactaaaacgaaataaaaataactagacatttgaaccaaagactcttaagaaccagaaggaacctcccatgtagcaggttgggcatcttactattcaagggacgagaattcagatcatctgaggcccaggacccatgctcctggcaaagctgcttccattccaaccagggcctaggacgtttagagtggtaacggctcgcgaactctggggccttctctgccctttaaactgccctttctgcatctccgcaaatgtgtctgcttttgctggtgtgagcaaatgtgaaatgaaatgatgggaccagctgcatttgtccaatcaattccttaggaaaccatttctacaacaagtttcccttccatttctaaaaagctaaatataagtgagccatttagtacagcagaacgagtaccctcaagaatggaaatcaggctggtgacatgggcgcttgctggaatctaggtgaaacaaagatggcttaatttaagatgaataaatctgctacaaaatcataggaggaagggaagcaggagaaggaaagagaaaggaaaataccgggtgccatgtcaagatcgcagatagaagctctgaaatttcaggagtgtgagcctatctacttgatagagggctgctcagcgagacaaggtctccatttcaaccctggtcattttcagagtttgaactgcatctattcgatacaatgctcaaatggatgccgcagaatccgcggagggaaagcaatgtgcaggaacagggctgggctctgttttctcatccatcctagaatatcactttttctttttctgaccaatgaaagtgatttagcttccaagagtggtcactgcagtcaccgcatgcacagtgacaatctaggagtgggctggctgctcgggctcctttcctctttggggagaagtctccgttaagctactcactgaagctcctcggaactgaggctgggctaatgtaaggttcctagaacacagcagcactgagtggacagagactatgggaagaaaggaggagaagcagcaaaaccagccttggcatttctctccttttttttctctttctatccaaacttgcctttctgcctccccaccccgtccctgttcattttagtgactgaggagagaggaacctcccaaggatgtttcctctctggttttaattaagccctgccacttcgccactgtttctgccttcgccttcattgcctgttgttcccgtggattattttctcttcccttcttctcagccctcagtctgctggtatttttataaatcacagtcaaggcaaattggactctgaaagttgtgcttataaacggtgactgacagatggagcgccgccacttttgcaggggcctccttcccacagaaaagacgtgcaaagagtggagagccagggcttcctgcacacacatgggctcccagtcctgacatcggccattctgtcggtgtgctcattctgataaatcctccaatccttaacctccctgggaaacgtcagtgtgaagtcctcacggaagcctggggtgttggtgtctgacacggtgttttaggtatggctccgtgaccccttccacttcatcttgaaaattatcttcaatgatttgctttataaagactcattactagcatcggggaatgagacggtagctactgactgacatgagtgtattaagatgcacaggaacgatctccgagaagcctcacactcggggcaggtggaacacgaatgcagattaggtcaagccacagtgtttcctcgtggaacagctttagatgggaccatttccggtctgggcagtgggatgagtgcccaaaggggctgaatacatctgtattatttagcacaactttaaaataacgccaggtaaaaacccggtgacagtgataccaggacgcatgcctggtgtgcacccaatgggacattatttatgctagtgtgtcaccctgactgggaaaactttttttttttttttgtctctgagatatatagtatgaaactgcactaagagatgagagaaaactgataacacgggatttaaaatcacaagtggaaaaacctacatcatcataaactacatcatcagtataaccaagaaaactacagtcatatcccagtgagacctattgggataaatttcctatttctttagcagaaaagggaaaatagaaattctacaactatcatcttctcccagactcaattatcgatgtgtccaatgtgatctcctcattctttttcaaaagcaacatattggtgaatgtttggtcaatacctctaccagaataagttgatggctgcgatgtttccattaagaagaataaaaaatgctgagtcaactaggatgtaaagaaaacgcacatcccaagagtgcccagctgttgggaacgctgagctggtgggctcttctcacacaaagttagtttcttttcttttttttctttgagacagggtcttactttgtcacccagactggagtgcagtggcatgatcttggctcactgcagcctcgacctcctgggctcaagcgatccttccacctcagccctgcaagtagacaaaattagtttctatttcaagtgtactgagcaaaatcgcaaggctatattgatcagaccgttcagatacccagcagagggacgcttgctggggtaagagaggccggtgacgtgcgtcctcctctccagcagctgaaatgggagtgtgcacggggccaactcactctacaatgctgcaacaccaccgacttagaggaaggaaggcagtttgggctctgcaaggaaaggctgcttaagtaatggatttttaaaaaatggtccaccaaatccatggcaatcagtatcacagctgatggggtgatggggaaagtctcatccccaaaatggttctgaaaggtcggcagctgagttggcagctgagtgcccgctctccggcagtggtgctggtgcccaactggtcatgcacggtgtttgtgatctggatgagagctggcagagcaaaactgttaggctgcagatcaggatgaattattcaaattgataacatcttagcaaatggagaggatgtgctagaagatcagaagaggccattccggcaggcagagtgatggcggcagccgcttaacccatggcacgtgtgcagcacgaggtcatgttttcaaaaaaacagtaattgtgccttatatggaactttatattaattgtgatagagagtagtcagctgcaatgcaggaaaggatggaaagagtaactgagtccgtgttttagaaaaagaaataccactgtgagtggaaacgcacctgccctatggggcagactggcgggccctgaacagaaagcctgcttctattctgtacaaattccatggtcgaccaataggcataacgtgcacaccttctgacccagggacctcactcctcagaattcatcaaaaacatttacacatagaaagctgtaacattatttataacagtgaagaaataagaaacaattgaaacgtccagcaagtggggaagaataaggaaaatgatgatctatccaccaaatgaaagtttacgtaggctttcagagtgattgcgctttttcccattactccaaaaagatgaaatacttacatataaagtaacaaaacaagtatagtatctgtgtgtcaaaaattacggaacatattattggaagaaatcaaagatctaaataaatggagagacatgtcatgttgacagctcagaagagccaacatggtaaagatgttaagtgttcacaaatgcacctgtaggtataatctcccatcaaaatctgagcaagcatttttttaagtatagagaagtttattctaaaatttcatggaaaagcaaaagacctgtaatacccaattttgaaaaaacactaaagtgggaggaatcactctacagatggtaaggtttgctacatagctacagtaatcaagatggtgtgctattggtgaaggggtagacacacagatcaatggaatggaatagaggacccaggaatagaagcattcaaatacacccagctgcttttggaaaagcaattcaatagaggaaaggcagcctttttgacgaatgatgctggagcactggactttcataggcaaagaaaaaaagacatttaacctaaattccatctcttatacaataattaactgaaaatggatcacagacataaatataaaacataaactacaaaacttctagaagaaaacataggggaaaattgtccaaacttagggctagggaaaaattcttagacatgacacccaaaccatgattcatcaaagaaaaaagtgataaatcaaacttcatcaaaatttaaagcttttgctttgcaaagactctgtgaaggagatgaaaagacaagctatagagtgggagaaaatgtttaaaccacacatccaacaaaggttctgcatccataatgtataaggaattctccaaagtcaatagtaaaacaaaacaatccattagaaaatgggggagacaagcagatatttcaccactgaagatacacagatgacaaataagcacatgagaatatactcaatatcattagtcatcagagaagtggagagccgcaataaagtatcagtacatacccatcagaattgctaaaataaaaaaatagtgataaacatcaaacatcggtgaggatgcagagaaactggaccttgtacgttgctggtgtaaatataaaatgttccagccattgtagaaaacagtctggccagtgtcttacaaaacaaaacatcccagcaaacgtattccagggcatttatctcagagaaatgaaaactaagctcacacaaaaacctgtactcaaatgttcatagcagctttatttgtgatgcaaaaactcgaacagcccaaatggtcttcaatgaatgaatggttcaacaagctgcagtacatcacatcatggaatactatacacaaatgcaaaggaacaaactactgttagtcacaagttgtatggatctccagaaaattacgctcagtgaaaaaaagcaaatctcaaaggattatacaatgtatgattccatttacatattttttgaaatgcaaaattatagaggtgaacagtttagtggttgccagaggtgagggatggttggtgttgggggggtgtgtgtgtccataaaagggtaccatgggggatatctgtggcgatgggacagttctgtatcttcatcaggatggtattgccacagattacacatgtgatatatttgcagagaactcatatacacacacacgagtacacgtaaaactggtaaaatacgaataaggtctgttgattgtaccaaatgtgaaattcctcgttttcatactgccctgtggttgtacaaggtggagcccggctgaagcacaaaggacctctgccacgtgttttgcagcttcctgtgactctataatcatttaaaaattttaaaaatggtaaaaagtgatttttaagtctatttgccaatattgaaagagctttgttataagatttaaagaaagcagaaaaataaacgtcatgtatatgatgattaccgtgacatttttacaaggtaggaaaaatatttatggaaaatacgtcaagatattagaagtgatagtattagaaaatataaatgattaattttctcccctttgttttctgaatttcctatacagaaatagaaaactggccaagtttctatacaaggacatttaaaatgataaactatgcgacattccctctgtttactcactgctatcctattcagctgcactgaactataatggaaagttcaggcaaaattaactgtgagttttcaaaagcaaataagatcaaacaacttgctgcaagggaaaaaaaaatggaagccaatggaaaacaatttggatatcatttctggatcaaagaataaacctattaattggtaaaaaaaaagaaggactcaatatttttaaagctattaacattttttatactcaacacacagattcctcccgtgcatgaacatggaatgtccaatcagggtacagatggcgaacatggacgcctgcaatatggacggcaacatgcacttcccagcactgcgggcagtcagggaggcagttcacagattttttcctgggaggtgggtgtctctaggggtgggtggcaacaatttactggaaactgacaaacaaaagaacttgttttaaagtgaaattagggttgggcgcgatggctcacgcctgtaatcccagcactttgggaggccaaggcggtcagatcacaaggtcaggagatcgacaccatcctggctaacacggtgaaaccccgtctctactaaaatacaaaaaattagccaggcgtggtggcgggcgcctgtagtcccagctactcgggaggctgaggcagcggaatcgcttgaacctgggaggcggaggttgcagtgagccgagatcacgacactccagcctggcaacagagccggactctatctcaaaaaaaaaaaaaaaaagaacgtgaaattaggtactactctctgtaacactaattagataactgagttaagtgtgatacatttatttcttttacattaagtagttttctagacataaatatgaagggttcaatttttttttctttcaaagtccttaggattaactcaagcaaaaccagcgaccatctcttttgtaatgtatgtgtgtgttggactgatgctcccctaatctttgaaggaaggttcaatgtgaatggtattctccaatgcataaatgagataattggggcaatggaagagaactacttctgcaatactctctggtcctaactactttttcagtttcctgctaaaagtagatcattccggatctccttgagagaggatttccaatgtggccagtggagtttcagaagacatgtggcatgtggcagcccctgctctgtgtgctatttcctatcctgacgattcttacgaatggaagccctacgaaaaacaatcaacactccagaattaggtttcaatgatgtcagaggtaacgtgcagatcatcatttagcagtttccaaaactgttgaaaagatgaaacttttggacaaaaacctcattcaaaggagttcattaaatagccatccttctttcttttctttttaaactaacctagttattgcattctaaaagattatgaagcattttgttaaaaaaaaaattagatatggtgcaaagtttagaaacggcctcaccagcccaccaggcacctgatcaccctccatccctgagcctgcagaatggtgagagcaagaaggacttggcacagaacaataacttgaatggaattaagctgactgctgaaatgcaaacatgcggtaggctttgccaatatgagctacaaattacggatttccgaacagtcttgggcacagatagggtatttcaagtgaggcgacaaactgaagtcgttgacacagcacaatgcccttgcagaccgccttccgacacagcttaattctatcagcgtttccattgtcattcgcaagcagcacagactgacaggctgaagacccacacctagtggatttcacccgcctagagatccttgttacccagtgctgctccaaagcagctccctgaccccatgaacacttacaggggaactcaggggctgtgcatggattaaatacagtctcaattctcaatttcacaggtctttgaccccccacaggacaggccacattttgtactaatgcctgcttatcccctcctacctcgcaaagcgtctggcaccatccttcctcagtctttgttcaaggaatcgatgaaaacttgtgaaatggtttagagcggtgcttggcggtccccaggaggccctgctcaaatgccaggctgcagaatcacccagtggcatggcctcacccacatgatgacagccaatccctctgtgtggcgaaagatgtgggcttgagaactttctacactccagaagccattactggcacaatatataagtgttcaagatcaaaagaaattgtattataaaagttttttttttaaatctaccctagcttgaggtttggtaaaatgccttggccacatcccccaactgcaggtgtcctgttctgcatctggaccacacgccttgcctgggagagacttcagtgatggaggagacaatcccaaaaggtttctgaagctctcacagtcacatgccaaaaagtccactatttattttagaaaaaaggatttggaaacttggttaggaaacccatgcatcgaggatgctatttccgaattgctaagtaaaaagtttatcatttcctatgcacaaaaacgaccagctctttttcagtggcatagcagggatgggccgataaccacgctggtccctggaggctaatgtgggctgtatcctggcaatggccacaggtgtgcaatggctctctacggattctgcagtctagctttgacattgatctactaggttttagtaacagcttgacatctgaatggtttattatcattagcatatgaacacacacttatataatattgctgaatgtaaaattctcaaggtaggctcaactcaaaccctggaggcagcatgtgtcttagccacttactcatttttggtttttgtttttatttttgaaacagggtctcactctgttgcctgggctggagtgcagtggtgcaaacacccctcgctgcatctttgacctccctgggctcaagagatcccccaccacagcctcccgagtagctggggcaacaggtaagtgacaccatgcccggctaattttctttgtatttttttgtagagatggtggtctcactatgttgcccaggcaggtctcaaactcctgagctcaagcagtctgcccaccacggactcccaaaatgctggggttataggtgtgagccaccatgcccagcctccacttactcatgtttagtcccacttttttttttttttccttaaactccttaatgcaagaaaatgcttgggaaagaaacaggagtcatttaaaaaaaaaaaaaaaggcacccactcgtggtgttcccaagtagcaaactgactgggcagagtgggaaggactcagagacaactcactgacccgccccgccagccctctttctctgctggctctgacgtgggccagtcagccctgactcaatgctcacatattatcacacgtgcggctcatcccattgttagaggataccattgctgagccaaacacagggcactgctttaaacagacttggctaatttctgcacccattacaagctgatacgttaaaaaaagaaagccagcctactatcatctgttttcaaatgtttccaaattgctcttctttctcagaatgacagctttggaacattagcgcaaatccccaccgagatttgcatccgtattcttggatcttattcagaacttagccctgctgaaaaatacacagttaggtcaaagtctgttcatgggaaactagtatgcgtatttcagaaggagctctcacctacaggctaccccgaggcagtggctggaaactgcaccaaaccctgtgtgtgtatctgtctatctgtctgtccaggcaagaacatttggaattttctagtgcagttcttggtgctgccatcactgaagcaactgatgcagttcgtaagttcagctttctgctacttcttcccacagagtgacatatttttcttattagacttagagcttttcaaataatgatgacctgagaagcgactgctacccctttcccagaagtaagagatctgcaaaattttgctcgttcgtgagcattttagcttctgtttcaagtcttaagactaacatattcccagactgtcaggccagttttatgaagctgaatgtgatataaagcttaacctgcctccttttgttgtaaacattggatgcaaagaagaattaaccatggaactagaagctgctggctgaataaaaatcccacgggaatttctgttccctttctattcctcttcccagctccggatgtgcatcctgtgtggggacagagagaaacattcagggacaaaacctaagtcacgaggtctgatgcgatgtgagaactcgcggctggcacgcgggtggccatgggggggtgggggtcccactccagcacaggactccatcctcctccactgcagcctgaaagcagggggcaaaaccaacctgctgtctgaaagggttttgtttttttgtttttttctaagcaaacaagtctgaccttccatccctaggaaaggcctacttatgatgagaattctgatgtcaatgtgaggagacactgcccagaccagcaactccacagcaagtcagaaatacagagattgcccaccgcatgaaaaatgtctccagttttacaaaggtcaattggtaatttacaaaacctgattttgagatgactttaggaaattgttgcttctatactttttctctacagagctagaatactgttcaagcgacagcagaaaacatcagttccctaaacccaatgtaaaaattgatgatttctctagcaatttgggctcaaagacactgcaatagcttgaaccaggaacatacatcctaagcaggtaaatctgttttcttcccaggtacgtggtaggttttacaatgggaaagggactcctccaagtcacggttatttgtgcatctcttcataagtgacaggggtgagaagaattgcacgctggcttctggacaggaatacagttctaagcagcattcatcaggccgcactctggcccacttccttgttgtgaaaagtcacatagctctagacactgaccacctgcacccctattgttctgggctctccgaccttggagccataaagcttttgtttaaggatcacttaagatgtttttcagaccctgaattccagcaaccagtttgaagacccccacagaggaatggcattggtgtagaatatagcttcttcctctccctgtcccacgaagtcaccctgtactcttccacaaatcaacaatctccacgctgcagccactccaaaagccacaatcctgagcccaaattcctcggggaggtggatttgaggttttctcccatcgcctcgttcagggatgctacgattgagcctctttctctgctgcaacccagtatctcggtgtactgactcctgtgtgcatcgggcaaagaacctattacgcttacatttcccagtcacctttcatgtttgaggtttcatcattctgaaaggtgacacagaatcatcatggaacaagagcatccttctccctacccagataggtccttcatctgggcgtcatcagagaggtgggctgctgtcacctcacttataggtaaaaatatactttaggcagactgtggggaaaaggaaggagactagaggatgctgctctaggaaggatggcccagggtggaggtgatggggaatcctagagtgacagttgctaagtggggtatctgggggaaaacagttggggcagtgagctcaggactggagtgaaagggccacggctagaagccctggggtaagaagatgcaatttctgattatttctcctgtaatccaggggttatccatatgcacttatctggagctggtctttggggagcagtgaatagcctgttcctggaccctctttctctcttctgcaaagtcctggatgggcaggaaatcaggtggctctctcctgtgcaagagtccttgttccaggccctacctgttggggttctctgctcgggttcagacagagcctcacccactgggtgcaaattcactcacaccaactcctcagctccacaggcgactgactgtagatgttactacattttcatttttcttggcttgtaagtccctaatgacttttccccctactacctgacatgttagaaatggtcattcccatagccactgaaagatacccatgttaatctccacctctgagtcaactggccttgtaagcacactaacccttcatcacagaagaaagtgaattatgtgagtgggttgtggttgggaaccacttactcctgagaagacagcagaatcccaccactaacctataggaatgaagatgaccaagtcatgctggaatagactcaagagtacagaggtgggcaactggcacacccaaaggaacacaggacataatacaaaccttcctttcccaccacaataataaaaccccaaagagaatgtaatgttactgtttctctgtggagcagaatccctctgagtccagctgtctgaatcgggcgtcgttattctaggtaggccacccacagccttccagtaagctccaccagaaacccaaacaaaacacaacaaaaaaaacttgtcagggcagtctttgtaaaagtacaatcccctaatgaacattttctattgtttcacccaggcagatttagaagcccgctagaggctggtatgctgggcgtggactcagtgtgtagctggtgtccagtgttctggccaagtccacgagttctcaggcaagtgccaagaaacctgcatgccagcaaccagaccacggggcattagccggggctgactcatcacatcccgcctcgccaaacacgttttctcttcctgttacccagtgccaagtggctgtgctgaacaagagggcacaaagtagaacatgccctccccctctctgctaagttcctccctgatctacggcaggcagttcccacccagccaacaggcagaggcagctgcagcctgagtgcgcagagggtagctcctgccggggtgaggaccgtgggcgcggagcatgcttcccaagaacagcccgcagggaagacgcccaaaacctaaatcgacataaacacggtcctggccaccacgtcccccacagactcaatggtcaggtggccggggtcactctgaaaatgaactgttctcccactgagctgtgcctcaacccaaattaacctgaagttctgtttacagggattgagagaaatgaatggattgaattatgctaatatcttcccttcccataatcctaattgagtgatatggtctggccttagagtttctctggcacctttgtcaaatgacagaaaaatcagcttttgtgtttttgtgtctgttattaaaaaatgttttaatgaagtattataccacataatagatatatagaaaagtccaggcaacttacagaaataatacagataaattacaagaaagttgttattcccaggcaaatatccagagttcaaaatgaaactcgaaatccttctagtctctatatacagactttcctcactctgtgaaccctcactatcctaatattttccataacaacttgcaaaacattttagccccagttcaccatccaaatagaaagcctgttacaccagtgtatgtcagggttcttcagaaaaacaaaaccagtaggtgatatgtgtgtatgtgtgtgggtgtgggtgtgtatagagatgtatatgtatatacagaggggtgtgtgtgtgtgtgtatatatgtatgtgtatatataggtgtgtatgtatgtgtatatataggtgtgtatgtatgtgtctatagatttgtatgtgtatatatataggggtgtgtacatatatatgtatgtatatataaagatgtgtatgtgtgtattacatctatgtatgtggggagagagagagagagagagagaatgaatcagcccccacacatatagaagctgacgagtcccaaggtctccagttagcaggctagagacccaggaagaactgatgttttagttcaagtccaaaggcaggaaaacaccaatgtcacagctcaagctgtcaggcaggaggcgtccctcttccttgggacagggccagcccctttgctctgttcagactttggctggtggaggaggcctacccgtatctagggggcaactgcctcactcagtccagtgactcagatgttaaaaccatccacaaacaccctcacagacatacccagaataagggttaactaaatatctgtgcatgtgtggccaagttgacacatgacattaatctgcatcccaagcagtgtgtgcccagggcaacactcaaggctgggctggggcagggggagggtgagaggcaagcggtgtctcagccattctccaacaggatggcgaccataagtggggcggtaaatgtgcttataacatcactgttggtggccccatgctgttaacggaaaaggttttccaggaaagtggcaaaccgtgagaagtagtgagggatccgagaggcctaataaagcccacaccgtggagaaagtctacagtcacggagcatcacaagtgctggctggacacgtgaacccatgatgacacacaagctctgacatccttgctatgaaggtaaattcagtcttgaggaaacatttggtgtttcaagtgctttatgtgaggcagaaattcttgaaagattatattggagtttcagagtttttgtgtatttgtgtattttgtggttttgtgcttttgagtgggttgagctaggaaaatgtaattttttgccatttaaaataaaggcatgtgggctcctgatattcataaacttgctatgctccatctcttcatgaggattagatctgggttaagaaggaggctttggacctggaatatgacacaccggaactactgtatcattctgtagtgggcagtgtgggcaaggattcagtagaggaaaagagacatggaatatgacacaccagaactaccgtatcattctgtagtgggcagtgtgggaagggattcagtagaggaaaagagttctgcattttctttctcaatgcacagggatagaggcatgtaacaggagaaaatacatgggtaggatgcatgacatacgaattttgtcagtgttgcctcatccttcaagtgtgcaccagccaaacacgcaaaccttccgacacttcctgaatgccaaaatcatcacatcagagccaagccaaatgaggcagaaaccaccatgctaagtgatgaatgcttctcttattaaggattagttaataatgaccatgctgtaaattactgtatcatatgtccaaagacatccccagtggactggtgagtaagtttcagtaacttgtatgagtaaaaacgataagcagggcctcctaaactctcccctatccagaatccgaattgagtaatatggtctggccttagagtttcactgtcacctttgttgaatgaaagaaaaatcagcttttgtgtttttatgtctgtgttattaaaaaaaagttttaataacatgttataccatatattagatgtacagaaaagtctaggcaacctaaggaaataatagagatatattacaagaaagtcaagttatccccagacaaatatcaagaggcctcttaaaatgttaccaaaaagagaaaaatctatgccacaactaaagatccacatttttacaagaactctcagcacctttcttctaatggcatttaagaagaaaccaggaaaacatacacatgtgaacttacaaagatgcaaaccgcatgaccttccctgacactagcactatgacatcaaaatcagcatgatttagactgagatgtgagtctagtgggcatctcataccacacactgtcaggacagtaccagacacagcagacacaccagaccacacctactgctcataggccatggaaagaagccaccaatgaataagctgggcatgcatttctggccctctgtgttctgcaggggaagggttctatcaccaatgggcccagttcctgggattccaagcacatatttcaatgcgcttacatgaaatactggtttttatttcaaagaacaactagtcttcatatttcttttaaggtcttaacaagtaccttgcaatacaataaataataaccaaacacaatgaaggcagacatgaagataaattatcattccaatgaggcttacaattgttttcctgacagtgaatgttctcaagcacagtgccagaatgcagcataaagaacaatgacacattccatacatttcgcttaagatatgtgatcagaattcagaggagaccagggtcttaatatgcttagggggcttctgaggaaggaaaatcacaaaacacacacccattgtgacgggaaatcacagcagaaaaaagagaaatggggtggtcgcgaaactccaaggccccgcttggtgggaggggagggagggcaggcaccagcaggtggagggggtggcctgggcagaggatgcaggtgcaacgtgaccaagtgaacaggaggactggcttcctacccctgaatctgcacccctcttacaacactcttgctttttcttttattcttccctaacgcttccccaagcatacaccaaaagaaatgctatcaatggtcacttattctcatgcaagtggctcattccacggtccttttggggcgtatttcttagcccaacatggtgtttttttttttccctgagactaatcccattcactcatatgtgcattggtaatccacacccctactaaataaagcaagctttttgcaagtattgatcagagaaaagcgttcaacttatccaccattaaaacaaaaaactcagggctgtttccagtagcaagaacaatcatataaacgaccttcctccatgttggaggtgtgtttcctgggtgcacttgtgcacacacactccccctggagccctacacacctcattcaggagaccctggaaggccagcgggcaggagccctgacctgcaaatgtgttgtcatctccacccatttcaagaccttccctccatccttggaggatgagaccctgtgcccagctcaaggtccctgctttgtccccgataccctgaacacttggtcttgctccttcctcccctccaccattcttcagcttgtcccccttcccaggcctgctcgttccccgccaatgggttccctccctcctataaagaagaaaatctgttgagcatggttcatcgttgactgctgctctgtgcccctactgccaccccctccccattgctgagcccactctgggagtcaccctcgactctctcatctgcttgactctgtggggggagtcctgggtcagtgcttacctgtgacagtttctagcaggcaagacggctgaaggggtattaggaactaggctgcttgactcttgctttcaagttgtagtcacagttgacatgtaccctgccccaaagccttggaaaagtctgtttacaccaggagtgtccaatcttttggctttcctgggccacactggaagaagaagaattggaagaagaagaagacgatgggctgcgggttggacaagcctggtttacacagagatttttgagagggaggctctggagcaatcacagagaagcaactggctttcataccaaacagcatgagggaggagagagcggccaccagaagccaaggtcataaaagtgagggcgtactgagcacgcatatgtcaggcactgtgcaaagcattttgcaaacattatgtcattcaatcttcaaagcaggcggagagggaggcattgctggctcatgtttagagatctggggagggaggaacacagtcacccgaaactataagccctggatattttcagagtccttagagaaggaattagacttcctacaggatacaggacacgcagcttgaggcaaatagatttcaaagcaaaatccaccatctgagaggcacactccaagcagcaccacttactcactttgcatctctaggagagctgcttagtctcctgggcctctgtaaaatggcgtgatcacagtacctacctcgtggagttaatgcagagatggcattaaccagtgttggtgatcagacactacctattatttatattattgttagtatcacccatgtatacatacaagtctctaagtatgcatttctatgtgcatacatacatagcacacgtagaatcaatgaatgtaatgaccatctctggctctctgttgagagaaacatgaaaatttataatccctgccctcaaggagttcagactctggtgacaaaggaataaactaaataggtagactgccaagcacaataaaattcattcccaaactggtcctaagcacctactaagagcccggctgctactaagccttgagtatgtcaaagtatgaccctttctctgcctcaggctcaacctggcgggaaagacaaacccgttacccataaccttccaacattccaagaaacagcctcagaagaggtttatcccaggtgctggaagtctccaggtgggacacaccaagttaatccaagatgctgagctggtggatgggacagcatggccacgatgggggctgggggctttgcagacgaggtgtcttagttgagccctgaaggctacttggacttccagaagttgggggtgcagggggcctgggatgtgtgggcaggatgactggggcagaagcaggggtacaaggacaggcgccccggcgggacagactgagaaggcggccgagccagaccgaggaacagcgcaaaaggtaacatccaagtcacaacaggagtccagagggtcctgagtgtgggaaacacaagctcttctagcttttagtccttggagtcccttccagtgtgtggaagagatccagcctgcaatgactggagggtgggagtggacgaagtttattctggagacaacaaggggtcctggtggcttttccggggtagtggagacaccgccacgtctgtgtctctggagaaggaagatggagaaggcatcctccggtgggatggggtggagctgggagaggccccagcgggaagcactcggaggagcgggggccaacccggaatcagcctctgttccttcttttccgcagctcacctgttcccggcttttcctcccagtctcctgggctcgccgccagcggtgggatccctcttcctgcacagaaccgcctcttccttcctcctggtgacagatgccccctgccacccccaggggctgcggctcccccagatgcccagcctcagcctcctgagtgctgtgcctgcccccactccatctgagcggctgaccagtcaccagactcacccccacccgccctctcccctccacacagggtagcccccaactccagccagagggagccaagacctcccaccccaggcagatcttgtgggcaaggtatctgcttaaagacattgatggattttatgaagaaaatatttaagccaatttaaatatttcagcaattgataagtaactcagcttttatgggctggacctttagggtattgtttgtaagatgtatatgattttcatatctatatcagtgcttataatattgtttgcatgaaaaaaaagtttctcatgtttgccatccatttacaaatgagctttacctatttgtaaattacgggctttcaacacgcagctggacgtggcaggaaagaggagacgattactccgtgtctcagcatgaagaaatggcagatgtcagatgtcagcgctgccaatgtttcagcactgcggttccttgctcactgagtaggaacagtttgcagaaatactggacaacctgctgtggataataaactatgtcccaggctctgtgtttcctcaggaatatatttacttagagaagcggcctattaacatttcccgggaaaatgcaaaatccattttgtgaagcagtgaggctgagttttcatagttctttcctcctccaggtgtcttcactccaagcttgtcacccgcatcattcgatcaagagtgcccagaacatcgcatgtgtcaaatccttaccgtttctgcctaattggcagttacagcctcggcccacctgtttccagggttcccagtgtcagtcggacactggaggggcctccctctccccaccagtctctggggcagattccccctcagcctaaacattctgcactgcagagggcctgccactcacaagcagcttctgtgccgctcttccaaattaccctgaagacattccctgtccgccccacgcctcccctttattctctttctcatctccaatgttaaagagtttctgaagcaaatgacaatgacagttgacagatttcagtctgaatttcccttttctagggccctcttctaggcatctatcttgcacttgctctttaatgtgaagctttttgactatttctgttgtaggagctctcattcagacgctgtaaaaacagctgttttccaaatacacaaataacgcagtctagaaaaactgggaactttctatgggggaaagtccttgctcatcctcccgagccacggatcaaggtcgagggctgcagcgtgtccctgcggcagcatcacctttctgagagtcctcaggaagcatcctcagtggccagatcccatttcaagggccctgtgcttcagggagcgggcaggagctttaggacatgtgatcccttatatgtctgagccgtcatctgtgggccatgaatgtgtttttaaaatggtcattttaattacccttatgaggtgttcacgtggttccccattcagagtctacagccaggagggaataaggcagacaccaagagccacttggcgaagtggagatggctgggctgaaagtcactcctgcatcttcctgttgagtctggcttgaaattcctgggagaaaagagcaggctggggccagtgctcggcctctgctatgcaaccagaggctctccaacttttccccatcccaagtgatttaagtcaccgccaattccaaaccattaaactcacactggagagaggcccgttgtttaagctgagatggtgctgacagcgaggcggtgggggctggctttaacgaagccctgagcttgttcttctgcggtgtgcttcagccatttctccagcttccctcgggactgactgagctcatcagaccccgggatccaaagcctgtgctgggatgcaggggtccgccctccctggcacctggctgcaggctttgctggtgtggctggcctgggccccggctgcctctgcctacagtgccatccacgctagggaacagctgtccccacaagaaccatgtggtccatgtctgggcagtgaccgcctcacttgcagccaaccccacactcttcagtggtgccgaggtcctgtggcagactcagccaatcccagtgtggacttgactcggtcttggacaccgggggccagtgagctagctgttgggccagtggggctcagcctgatactggacagagcctggacctggggcctgtggctggggaggggtgctcctgtgtgggccaacaggacggccgatggcctggaagacagtgtgaccgagctatcagctagcactcgggactccacatggatgcagaggtcaccgctggccatttcaggagacactacgcctaggagctactgcagccagcactgccaggcagcgacatcacaggaggacatttctaacaaaacaaaaagcatcttcccatcttcgtggacaactgccatgtggttctgataaccacttttcaggagaagagacacatgaaacttgggatagaaataaagaatgggaagagtgtcatggaaacctagatgaaaatgtaggaattaatcttcaaagttcagtgtgaggtgtgtgacagcagggaacatcctagggtgtacagaaagggaacagacctactcccgggctcctgggacgtgatggccttggctgggcgcaggctgctactgcaggggaggccatgttcctcttcatgattgtaccacatggggaagagcctacatcggtgtccttgccagaatatgccagaacatgcctggaaatcccaggctgctccttggcatctccaaagggccccttcacaggcgtaggcagtgtatcaggcagggacacctgagccctgccagccatgtctgaatgagggatggatggctaccacctcagtcacctcaataacctcactgttggtgccacaggtctgcccatccaccacatcaccagaggttctgtctccagatgattctgaagcaccaggctcaggcttccaggcagcagagctctgcacaggtgcagggggtggccctctcccaagctccatgcgatgctatggtccctggaagtccatgctgggtctgcggagcctgtcttgcacaggcccatgggtctctcacacctccccacccttgcctggaatctccccaagcctcttaagggaagcaattctgtccactcctggccctgaggtctctcagccaggagctacccttgctagaggggcggggatgagctctgagccagtccctgacagccccactcctgcacctgacaggctcagggaagctgggtgattggctggagatcacacagcccacgcaaagctgaaggtctcatctcccacactgttctgtgcctgtggcaggatcacagaaagcagagctggcaacagggattttccctcggacacagtgacttccataaaccctacattacatcgtcgcaggtgcaaatgtgaactaaaggagcttcttagcccaaagagttgcaaatacgctgaaaacagcttccagaatgggtcacatgaattaatggcaaaaaacaatccatgatgagccactgaggtaacccaggaagacatcacaaacacagaggccttcgctgcccttccgcagaacaccctgcttgctacccacaaaagcaccctttaatcggccatgagtcacatccatggtggcaaatcggatgttctttcctaagtgggatttgagaaatccaaatccttgacatgtgcttggccgtgagcctgcagccctgcctgtcctcccatgcagaccacatacttcgactcaaccttgtgattcactttccacacatccctacacacccatggttaatagggagacagtaacccagaggttcacgtgagtcactaaaaaaccagaaggaaaaatgagtggccacgtgagagcagctgtcagggaggagcaaacacccaaagttttgattaatttcccagggatctaatttaacataagaagtagacatggacagattaactatgggcacatgacaacacatcacggtaccaggtttctaagaaaaatgtttgcccaggggactagcttaaaacagagagtagtaaatcggcagcggactggtttgcttatagcccaatgtgcatttcactgtatcactgaactgagctggggtttcgaacagagctgggattgagataaatcacagcacatgctcggccctcagtctaaactggaaaacctgttcggaggaaacccatgcccttcccatggaacgagctgaattacctagaccagcaggagacaagaggttccatctctccccagcgatccgtgctaagcttacgtttcccaagggcctgtcagaaaaatggattagagaaacctatttccctctgaatctaaaagccagctcacctggggaaagagcacaccaccaaagtccaagggcacgccagtgcagcctctgcgcctggcagctcctcctcctgggaaacatcctgtctcaggtctaggatggaagaggaaatacctccaccgccagccccagaatcggcccttggacatcctgctctcgtaaccaagagaaaaggggacactggatgcccaccacaggcctcagctttcttggggtgacaggaatctttaagaatttcatgaaatcttggcattttcttcctggaaaaacacacacatgcacatccacataaaatctgtcacagactgtctggaattcctgagacccatccacagaagccatgttaagaaagcctgttctcagaggactgcattaaaagaaaattgaatccaaaatctattacttggccaggcgcggtgactcacgcctattatcccagcactttgggaggcttaggcaggcggatcacctgagatcaggaattcgagaccagcctggccaacatggcaaaactctgtctctactaaagatacaaaaaaaattagccggtcgtggtggcaggcacctgtagtcccagctactcaggaggcttgaggcaggagaattgcttgaacctgggaggcagaggttgcggagagccgagattgcgccatcgcactctaagcctgcacaacaagagcaaaactccatctcagaaaaaaaaaaaaaaaaaaaaaaaaaaaaaaaaaaaaaaaagcaaaattttttactggctaccatgttttggggctgaaacacataagacttcggagaccccactaaccaggcagagccctgccctggaggtgactgtgcttgtccctgcatagctagtgaccagcacaggcccaaagccatctctgaatgtatgtggcataattactgaaactagaaaacaaacatgcaaatcacaagtgcgttttgtgcaaataatgtgatattttaaatcagaaaatctgggtatcaatctagactctgcttcttcctgatttcatgattttgaacaagtacttttttttcctcttttaccaaatactgtagttgaaagtgtattaaaaattaagcttacattaataaacgtatacaaaagattatattctggatttaataacaaagaagggtattgggaaaaaaacaagtctgtaagtaaaaaaatgcaagtttactctaagttaatgggtacagacacaagcatgtcccgtataattattccctttccattggattcctccccaaggactggcacaatcttcaacccacaggggctgagaccccgcaggggccttgagactggccctggtttggcccattctgctcctcccgtcttccatggcgggttttcttctgagcgacctctccacagggaggcaccgagggctgggcgtcacgtgaggttagcgctgttcctgccctggccgctttccaagtgatgtttactcccatttcattcggctcccttgcagcatctcagatgtttgcatggtatgtgtctctttctgtagaagaaccttctgggtggtttgggaaaggccctggcctgtcatcggatgcctctgccctcgctgggtccctgctggggccgccctggaaatctccaggccaggcattctcaccaccctcttgccttctccctggacctgctctcatgaggggtctttctggtcactcccaggactcctctatgggcaggggccacatcgtaggctgctgcacggaccacagacaaggtcaccttgggagctgtggacttctgtgtccttgtgatccctctgggaactatacttactctgcacggtgattcgggacagcaaggatggcagaacacttctcaaaggacacccccctcgggaataggacatctccctgtactgacttggtgccgattccttgcaaagcgtcttcccctcgtccttcaggactgctggccagcactgaaacttacatcccaattctacagtcccaggagaaaagcctcactctgtactttcaacccctgccattgcgctgaggatcacaagattcacagaagagatgtcttattttcactttgcaggtcttaaaactctgaactaaagtactgtctagacaattatcacttgaaagaaagttcagcaagtcacacatataaatccaagggagaggctgtccagtatgagggtgacaaagggacacgttcccacaaaagaagcctactgagtacctgtcacctcttgcagcaaccccaagggtgtaacagcaactacgtggtctcagacccaggagcttcctgccatagctccagaccctcggggagcagcactgaaaaatggcagcaccccggtatggagaaacatgggcagtcaccgcctcctcaaagagaggcacaagatgggtcagcaatgggccctggctccccttccactgtcctgcatgccccgaagctgtttctgacagctgcacccactccccacagtcagatgttagggtcaccaatgacaacgcattgatttctgtttcatgtgtttcacctgcaaaaacaaaaacccttaaacttaggatataagaaattgccaccaatacttaaaactcttggacatttcagcaaatgaagtaagcacagaaatagaaataagaactacaaatatagctctaaggcagtatgcttgtatattcagcataaactaaaataaatacagcagatctaataatacagggtttagatacaaaaagaaatacacacataaattccatgcttataaatcaaaattagcatgacagtgagtgccacagggaaaccagacaacattcaaagatttactcctaaatatttaatagtgaatattaaaatattaaaaataacaactaaagggtatacagaaaagcaaagggaaacattacagagacacaaaggtagatctgaataagtagacaggtaggctgggaagactgagtatgttaattctcttcactgtaatagtgtttaacccagtttaaatccaaattttaagaggcctttttaggaatttaaaaatggcaaactttttctaaactttacacgaaataataaagaatagcataggaattctgggaaaataaaggcgtgagagagaagtcgcactgccagatgctaaaccatgctgtgaatctgcactgtcacaacagtgcggtgaggacgcaccccaggaccgatgaggccggccccgcatgcccagcaggcctgggagaccgaagcactccacacaggaaacagtaagcgcgggaccaacccataagggataccggggaaactgccatgaaattcatcaggtgaaaaatcgagtccttctccagttgccatcagataccaaaacatcttctatcggcttaaggttaaacgctgacacacacaacacagagaactagaagaaagaccagcaaagaggttgctgcttcccgaacagcaaagaactcaccctaaaagcaacagcagaaagacaatgatttagctacacaaaaacgtctgaactttaaaagctcgtaagcaaaatgaaaaagccaatgacaaacagaaaatattgagaaccacaaaatagtgtgtgcttgggcgtgtgtgtgcatgaatgcacgcacatgcgcgttctagcactccaaaataaacagtggtcaaaggaatgaaatgcacagttacatggggggaaatttaaaatccaagaaatatattctttaaagtagtctcattagtaatcaaagaaataaaattagataggtgagagacttttttttttttttgcctatctagttaattaaaatgttgagaataaaaatatctaacatttgccacgttgagcgtggtgacgacttgctgacaaatgccagtgtgagcgcagcttgaacggcctctggaaagcaatctggtgcatttgtatcaaaaatcataatcttgaaacaactgacttcctttttagaatttttggaaaaaaatcagagccagggacaaatacttctgtgtaaacgtgccatgttggcattatttatagtgaagaacagtggggggaataaaacccttacatcttctatattgtcttaataaaggcaaacaacagaatattatatataaaataaaatgcattcataatatttaataacacgagaacatacactataatactcagtttcattttaaacacaaaattctatgttcagaattttattaattttatagcaaaactcctacatagatataaattcaagaaagaaccaaaatgtccccagatattaaatatgtgtatctgagtggtgggattgattagggattctaattttctttccagttctctaattggaatatctgatacaatgtcttccatatattagctacccaataaatattgagaagaagaatgaaacgatttcaaacttccaacataaacatgaacgattactaattctaagaaaagagtgaaagcatgttataaaacaaacactaataaacagatattggtttaggaaggtggctggtggcctctcaggctggctaagccaagggatgtttacttttgtcaatttctgcagaaaccacacaagtggctggtgacgtatttagctctttcctcacagtaaccctcctgaggactctaggatgatgttctcacatagctctcattgccggctgctttccctgcctgttgccctgtggcagagccctagttatgggcttacagctcctccacgctccactggtcatatggcctggggataggggaccagggtggctgaacctggaccagcaaggccccctttcctcctgcctgtgacccctcactgagggtccttgggggacacaagcaaagaggaacatagcccacacggagcccgcgtcactagcaacggcacacgtgtctctaccctcatgcagggtgtgagacagagcagctcccacgtcctctgctccccttgaatctgcacgttcgggtctacccctgcctgctgaagaagaaaacaggggaaatgcaggaatgcagctcatgaggttgggcccagggagcccctgcgtggtcagagggagcggagcacaggaaaggaagagaaaggagaggctcctctgcatgcccagccccaccccacaccatgaggacagtgtgcctggggttcccggggtgcccagaagctctcgggagccctccttcactgacaggagggatggcccggtgcagggagggcaggagggtgagatctttggtctgtgggaagccacatcagatgcagaaagtccatttcaaagacaacactgaccctgcacaaatccagctcctctgccctgtcacgagaagggcactccatcagggcaggcgctcaccacctctggttagagcttccagaacctcgtgttatgaagcacattcagggacgggcagcaccctcgtgcaaactcagggaaaacagagggtccactgctgcacctaggttgaagaggatggcagggtctgcagggggatttttatctttttctacgtaaaggacagaagacccagcgcacgtgttctgatgcaggaagacgtactgctgtctatgtaaagtacagatcaacagcaaacccaggaataaattcctgctgaggaaggcatccaggtgcctccctgcagaatgtgcccctgggtcaggctgcagctgactttttacaaagtgagctcgccactgcaaagccccatgggttttgtcacactgactctgtggctccggcctcaccggcctttgctgcacttactcccattgactgccagggtcgtgaccgtaaacaccgaggttctcttccagagcctggtggcataagcttgcagcctcgagtccattggctgcgtggtgaaacagtctgggaacttcccagttttgaaaaaagttagagatggaacttcccagttttgaaaaaagttagagagaacttttaaatagttaatagagcattcagagagaagaaagagctcctcacgcatgtgaaggtgtgtcagatgcagcaaatccatttcaaagggaacgccgacccacaaagagcagccacgcaggatctttaaaaggactctcagtcctaacagctcacaataaaccatctctacgcggtccactcaagacacactcaggccctgccgtggtcattctctctctacagcacacagagggcaatggcaccactccttgctcttatcctgagtcctggcgtgctgaccgaggccaggtgcaagagggttttttaattttttaaattctttaaaaaaacattctggattcaggaggtccatgtgcaggtttgttacgtgggtctattgcatgacgctgtggcctggggtatgggtggccccgtcacccgggtactgagcacagtacccagtaggtagtttttaagttcacatgcccctccttccctcctccccagcagcccccagcgtctgttgttcccatctttatgtccatgtgtattcaatgctgagcttccagttttaagtgagaacatgcatttggttttctgtccctgaattaatttgcttgggataatgacctccagctgcacagatgtggctgcaaaggacatgatttcattctttttatggctgtgtagtattctatcacgtatatgtaccacattttctttgtccaatccaccattaatgagcacctaagttgattccacgtctgtgctattgtgaacgttgttgcagtgaaaatacaagtgcatgtgtctttttggtagaatgatttattttcctttggatatatacccagtaatggaattggtgtggtagttctattttaagttctgcaagagtattttaaataaaaagttatataaagataggagtaagatggaaacaggaaacatacaaatgattgcagaaaaaccaggttaattcatcaggtagcttgaaaagcgggactttctgaagcagtaaaatatctgactaggttctatataaatgaaacttgtattacctacaaatagagtagacttagtaagacaccaagaaccaccaggaagagctaccaaggatctacttttgtcaacagataagaatgattttaaatgaacaaatcgagaaagatggaacaaataatttaaaaatttccctggtctgccccactgctcccagataatttcaggtatctggcagaagaaactgactgccccaaccatgataggcacagccaccaacaaaactagacatgcaaaacgcctggctcttttaacacagcttttgtttacgaacgccatacaacttctcagagcacattggaggaaagattttcaacacataaaaactttgaataactacaatgattcatgtgatttttttgtctttgcattcaaaagtcagaagcataacacgaggctatgtgtgatccgggctcagggagtacgggggagcgctcagaagtgtacggagaactattttcagcgctggcttttgctggagtccagacctgccaaatcgagcacgagagggcaccttttgccaagatggaagcactatgaaatccaaggttgctcatttccggttcattgtgtttatcgtgtgaggctttccagaagggaaaaaagccagcttctattttaaatgacgatccactgatgagcagatgggtttggtgttgctttttgtttattctctctacatctgaaaatatttcaacattttaacttcacagaagtataatgatttttctttccttttttacatgctttcattattaaacgttttacctcaggagagttaagacctcagaacaacacctcccactgagctgaatggaaggacactaatgggtccactgcctctttatcaatgggaaccatctctctaaacacagaatttcctccatggattggtttggaagaataaaattttcaggtgtaaaggagctcaccaagatagcaatctattcatttcacatgaaaaaaaaattccaaagatgagaatgaatgacttgaggtcccaaataaagcaaaataggtgatatggtttggttctgtgtccccacccaaatctcatcttgaattgtactcccataattcccatgtgttgtaggagggacctggtgggagataatttgaatcatagaggtggtttcccccttgctattctcgtgatagtgagtaagtctcaggagatgtgatgggtttatcaggggcttctgcctttgcttctttctcattatctcttgccaccaccatgtaagaagtaccttacacctcctgccatgattctgaggcctccccagccatgtggaactgtaagtccaattaaacctccctttcttcccagtcttggatatgtctttatcagcagcatgaaaatggactaatacagtaaattggtaccagtagagtaaggcattgctgaaaacatacacgaaaatgtggaagtgactttggaacttggtaacaggcagaggctggaacagtctgaagggctcagaagaagacaggaaaacgtgggaaagtttggaacttcctagagacttgctgaatggctttgaccaaaatgctgataatgacgtagacaataaagttcagactgaggtggtctcagatggagatgaggaacttgttgggaactggagcaaaggtgactcttactatgttttagcacagagactgggcagcattttgcccctgccctagagatttgtggaagtgtgaacttaagagagatgagttcaggtatctggcggaagaactttctaagcaacaaagcattcaagaggtgacttgggtgctgttgaaggcattcagttttataaaggaagcaaagcataaaggttcagaaaatttgcagcctgacaatgtgataggaaagaaaaacccattttctgaggggaaattcaagccggttgaggaaatttgcataagtaatgagaagttgaatgttaatccccgagacaatggggaaaatgtctccagggcatgtcagaggtcttcatggcatcccctcccattgcaggcctggaggcctaggagaaaatggtttcctgggctgggtccagggtcccagagctgtgtgcagcctagggacttggtgccctgcatctcagccactccagctgtgactaaaaggggccaaggtacagctcgggctgttgcttcagagggtggaagccctaagccttggcagcttccatgtggtgttgagcctgtgagtgcacagaagtcaagaactgggggttctgaaaccacctagattgcagaagatgtatggaaaacgcctggatgcccaggcaaaagtttgctgcaggggcggggccctcatggagaacctctgccagggcagtgcagaagggaaatgtggggttggaacccccacacagagtccttactgtggcactgcctggtggagctgtgagaagaaggccaccatcctccagaccccagaatggtagatccaacgacagcttgcactgtgtgcctggaaaagcctcagacactcaacaccagcccatgaaagcagctgagaaggaggctgtaccctgcaaagccacaggggtggagctgcccaagaccatgggaacccacctcttgcatcagcatgacccggaagtgagatgtggagtcaatggagatcattttggagctctaaagtttgactgccccactggattttggacttgcatgggccctataacccctttgttttggccaatttctcccctttggaacaataactgtacccccattgtatctaggaagtaactagcttgcttttcatttttcaggctcatagatggaagggacttgccttgtctcagatgagactttgaactgtggacttttgggttaatgctgaaataagttaagactttgggggactgctgtgaaggcatgattggttttgaaatgtgaggacatgaaatttggaggggcctgggcggaatgatatagtttggttctgcatctccatccaaatctcatcttgaattgtactgccataattcccttgtgttgggagagggacctgatgggagataatttgaatcatgggggcagtttcccacatactgttctcatgatagtgaatatgtctcaggagatctgatgggtttatcaggggtttccgcttttgcttctttctcattttctcttgctgccaccatataagaaatgttttttgcctcctgccatgattctgaggcctccccagccatgaggaactgtaagtccaattaaacctctttttcttcccagtcttggggatgtctttatcaggagcatgaaaacagactaatacaacaggattggaacccaggtttcctgaccctcaagatgctgggcaacgtgttccttccctcagaagccacgtgccgtagactcctccatctgtgccctggactgggggctgtcctgctgctgcacacctacatgtactgtccttgagcttataattgggtggccctaggaagtagtgggatagtaggagcagttaagaggcctcaatgctggaggtgaacaggtgggatttgggtccgggcatcattatgtaggagctgggtgaccaggggcaagcaccttagccctccggcactttgctgttcacttttgcaaagcagagatgagtgctttggccttagggctgtgaagtttaacagtgttaaataatgcagaagaaagcaagcatcccacagatactactgatgacaataacacagctctttctttaacaaatgatggcttaaaaactaatcctggccagcatgctccaatctagagagcgaggttttgtaaacctgatcctcaggtgacagcagtgtctggaccagcagggctgctcacaggagtcaccgtgccaggatcactgtgctggagcaggcctactcaatcagagtgtctgggctcagctccgaggtcttccaccatgcgcctcgtgcattttctacacagagaaaagtgtcaattggcccaggatattgatgggatctgtgcagagatatgtgagggacaggaacgtcacagcttagaaacgcagtttatgagattctgcatttaaaacccaccttgactcaactgcactcagagagaccaaaaagcctctgcattctatatttcacatttagtgagaaggcccaggttagaaggaaacagtaagtctgatgtcgagcagcatggaaaacggaggatcagtggatcatgaaaaacaagccggaatgagaaggcgtgtcagtcaagacagccccgagccaccgcctggccgtatctgccaaaggggtttgtgatcttagacaagtatccgtttatgctgtttagaaaacaatctatagttgtattctattttctgcattcagctttttttgagtgccattatgataaaatgtcatgttattataaaatttgaagttataataaaatccaggttgagatgggcccaacaggtgcgacctgcattctgtacagaatgctacagaattcttggctgctcgggcccttcctggagtggtgctggcctgtcgcccacaggccatctggggaggaagaaatgtatgcaagaatgtcatgcttccagaggtttcggtggtggcaattctactgcaattattaaagatacattgttacactggctagttacaagtgggttatatttaaacaaaatttggagaaaaatgttaaataaaaaatgtttccaagcacaaaattgtttttggagaagatgaacatcctacgtcaccatgaaactggtgtattcaagattcaggccattaggaaacgccatgtgtcatgttacaagaaggaagcagcctgtgaaaagtgtcaaccgctcctttggcagaagaagaccagtgttgtggtatttaatgtcgctaaatttcacgatttgacattttctacattttcctttttctaagatctaaagatcacattattgaaattttatctctaaagaatggacctcttaaatagtcctcttttatgattatgcaaataactcacatactgttttgagaagaaaaaaaagacaactaaataatctgaggatagttcctctgttatcccagccaaaaagaatagggaatgcatagtgacaacaccttcctaactgcgacctttagaatcacggcacttcatcaagttcagcattgaacatgcttaaagggccgtctttctatgactcagcccggaggttctggagttgttgcccccatcacagtgggctttgggcccccgggcctgccccttggttctaatgatcagggaggtcctcccttatgtgcccactgaacttccagtctcaggctgactcacacaggacacactgtgaaaagctggagaggaaagggcccaagtgacacagtcacccgatggctctcagggacctgagggccggcaaaggtagaacaggtgtccactaagcctggagcgtagcctcaaacccactgtgccaacacaccctgacttcagccatagtcccgtgcatatccaaaggtctgaaggaaacttcagaggtgtccagtcttttggcttccctgggccaccctggaagaagcagcattgtcttgggccacacataaaatccgctaacactcatgatagctgatgagctttaagaaaagaaaggtgagtgcataaacctcataatgttttaagaaagtttacaaatttgtgttgggcgacattcaaagcccctgggccacgggttggacaagcttgctctggattgtacccagtccatgcctgtcattgtatgtgatcaaactaagcaaaaagacctgattttcagtctaccccacccccaacccctgaccccctcagtgggtccccagtgaggacggatgagaccagaagtcccaatgagcccagtgtgccttgtgtccctgggggaaccagacccgattggacacggactggattttcatgcgtagggggcggaggaaagggaggacattaaatctttaagtggttaaagacacaaaacccacaggaatgatttctaatgaacagaaaaagggctgaggaatttttcttttcttttcttttctttttttgagacgaagtctcattctgttgcccaggctggaatgcagtggcgcaatctcggctcactgcaacctctgcctcccaggttcaagcgattctcctgcctcagcttcccaagtagctgggactacagacacaccaccacgcccagctaatttttgtaatttttagtagataggggttttgccaggctggtctcgaactcctgacctcagatgatctgcccgcctcggcctcccaaagggctgggtttataggcttgagccactgtgtctggccagggctgaggaatttaatattgcacatacatattgtctatgattctttatgtgaaaatccactcaaacatccactctgcttttgacagcatcagcctttctcatgacaaaaccttcccctcagggcctatgcggagaatgccgacagcacctgggctccagcgccttctggggcctaggcctctctacacccacctggatgcgcaggtcaaagtgctttgcttctcagggagggaactgacgccccgctcagcccttccttctcctacgctccactgtcctgagggacttgatgtccaagtgctcaggtgggttcggcattttccacaaacccaaggaccaggcatggcagcctgttgaggccaccgagaggccggcttcgagtatgcggggcagtgggtgggtatttcgctgtgtccattttccttatattcactttctatttgaatgacagagaattatacccagaaacagactagtttagatttgaaagcccttggaaatcaccacttcaaatgaagacccaccctgggcgagatggggagggaacacccgctgggcaggagggcacggggagagggccggatggggtggaatgcccactgggcaggtgggctgggcaggagggcacaggaagagggtgagatggggtgggacgcccactcggcaggtgggctgggcaggagggcacggggagagggcgggatggggtggaatgcccactgggcaggtgggctgggcaggagggcacagggagagggtgagatagggtgggacgcccactgggcaggtgggctgggcaggagggcacagggagaggtgagatggggtgggacgtccactgggcaggtgggctgggcaggagggcccagggagagatgagatggggtgggacgcccactgggcaggtgggctgggcaggagggcccagggagaggtgagatggggtgggacgcccactgggcaggtgggctgggcaggagggcacagggagaggtgagatggggtgagatgcccatgggcaggtggggtgagcaggagggcacagagagggtgagcacagtggccactgaaagccgctgagccgtccatggagatctgaactgttgagctggcttccggtggcatgcactttttgaaataaagccttttcatttgaccatgaatgtgttcaacaaaaccaaacttcttgggagagtgaacatgtgttaaatgaccatatactaacccatcacgctgactgttcacagctgctcaccaccatgacctcattagttgggcggagatgaatatgcagccattttacgatcacaaattacattccacaactgaaatgtagcatggagctctgagagatttttcataaatcacaagttttatagtatgcaatgaatttttatcaaattcataacatagatgcatacatcttattttggaaaatgaaatggcatttattttctccacagaaaaagtgccaaaaaatgggcagtaataaaatttccattattcaagaggttagatatgatttccatcttgactgaaaaagccagaacgctttgaaagaacttcttttaggggttcttatgtaagaattgctattatgcatccaatgtgcagaggaagaaaaaacaaaacacaaaaaaacctcttgaataataaaagctatggaataaagcagtataataggttggttttaaaacttaaatatttttggtaacttgatgtggataataatttgaagatttaagaaaaataactcactatattttttaccttccacattttctcctactttaaaattcactcactttgtcttgacttggtcgttgactgcttttattcataattcacttgggataaacagacttgaagcatatacacgataattatttcaatatcaattctaataaagacaaagcagtttggtaagttttactcgcattcgcatacttttcaaggtatcatattacacataattagatcctagaaacaaccaaattgctacttgtgagctaaaagtgctgaattcttgcttgtttagaaagcacactgcctcatccaaggccctgatgtccagctcaccctagggtctagcactctgcaccctgtaggacttgcaccagagatcacggccttcttggggcaaaccacagcactgtcgctgtgatctgcggaaacggctccctccactttgcctcctgtgagtcttggtgattaaattgttgagcaacttcaaagcacagaggcgaaaaccaatgggaagaagcagctggtggtggagagcttaagcatcctgcgcaccttctctgagctctggccaggccgtgctgaaacactgcggaagtcatgtctacaccagggttccccacccactgtccagaggtgacaaaggagagacgctcctgataaatgtcttcacgtgacagtttgtcattaaaaaccgaagctaagcccactgaattcctgagtgcttattaaagcgccaatggccaaaagagacaagactcacaagactgtggctttctcctctggatggcagaagacgtatctcacttggcttgtttcagtccaggaggcatcacgccaaaggaagtactatgccacaggaagaaatgtgcaaactggctggttctcacgtttttctacagcattttacttccatgggttctatctaatggtaacataggttagagcaaaacacagtcaacacagttgctttagctcaagtaatttcatcaccttaccccatagtgatagtgaccctctaagggtcaacaaaaaggcgcatcttaaaatgtattttatagctctggtaggccaggtgtgcaacgaaacaaggttaataaatttaaaatgccttggtgtgttttgctcctttcttagtctgcctgagctgccataacaaagtactatggattgggtggcttacaaaacagacatttatttcccatagttctggaagctggaagtccaagaccaaggtgccagccatttggtcctggtgagggcccaattcctggctcacaggcagctgcttcttgcagcgccctttcgtggtggagcaagagctctggtctctcttcctcttcctctgaggacactactcccatcgaatcagggccccaggcttaggacctcacttcaccttcattacttccttacaggccctttctccacatagaatcacactgggggttggagcttccaaatgtgaacatggagggatacaattgagtccattaacattccatcccttatttgtagtaacagcatgaccatactcagtgatgacagggacactctaaatgtcaacatttacatcttacaacactttttatagctctattaggccagttatgtcatgacatcacaattaataaatgaaaaatgcctgggcattctggggatactcagcagctctccagatgttaaggaaactcagtataccccaatctggtcatttctatctgtgattgtgatcttttgcactttattttatagtaattttaactgaaatttttaacggaaacaaaggagctacgctgtcatgccaagttttcagtaaatacgttgaggagctgtgagctcagaaagcgttccaatagaattcatttctcatggagagaccatgattgatctatttgaaatgcaatattggtccagaaactcagaaacatttggtggaactcagggtttacaataacaacattagctaaagattcaatctggacctattttaagatcccgagggggtggcacattggtgtgtcattcccaagatgtctcaaaacacacagcagatttctgctgtagcaactagtgtgagaaaacccgagagcttcttggtcatctttgcacctctgagtgctgagcacacgtgtggtgacgatgttgctacaacgatgtggggtgcaggaagctcgagtttcaaaagaagatcataagtaacacatttttccttctagccagaatgccctgaaatacatgaaaaaagatgcagctctggctacgtgaaaaagaggtagtgagtgactcggggctgggaaacgaagccgtcctcgctgggatggactttcagtctcacatcttcagcaactttagcttcttcattatgactttttttctcttgaagattaaggaatcgaggattgctgacatgtctgtattgattagttatggttctccactatgtttactgccatcctaattacagaacctaattttcacatttacttataattgtgtgcaattgtccaggctgatcttttaaggttaaagagaaaatctcaaacatgacatcaaacaagtctttttttttttttttttttttccttattttacagctttattactgatttccctctaaaaagagactcaagtgtggagctgactcatctatagattaaggaatcacaaagtaccatagtcacttaacaaatgcaaaaaaaaaaaaaagcaattgttttacctttcaactgctgatgttatgtacaatctatcacaaaaagcatagctgtgcattcatgagctgattatatcaacctctagaattttagaaacgagcacatctaagcatatggatactctcttaccttacaaagtaaaagcattttctattttaaaatttttatttctgtgtaaaacaaagaattcctagaggtcaaataatataccaaacttaaagcactattaagtcatgaaacaaagaagattctgaggtagaagtcaagcaatataatccacagtttcaggtattcccagcaaccatcgcatttcgcaagtaagatctattttttttaaagtctcaacttccaaaaaatcaataatccattctgtaaaatcagatgtaaaactatgaccaacagaagacacccaaacttttctcatggtaacagagtaaatgcttttactaaaagctgccaacatttctatcagtagtaaccgtaaggaggccgctggttgtaaccataatgtccatattgctggggatagtaaggttcttgtctgtgttgcgggtagttgttaccccaggatcgtccatgccactgattggatcgattgtcacttggccacccccatctgttgtccctgcctctgaactgtctgttgtcttgcaaccgattgcctctgtttctttggttcccaccagctctgctattccattcctcaacaattggaggagactcaggagggcgtttcaggtattcctgatactccttgtcattttctgtgaatctactagcaaacatctcttcaaaatttggaacagcttcggcagtgtcagtcattctgaaaatcccaaaggtttgaggcagctgtattgcttaatgtttaggttgtttaaatccgccaagggctatgtctatccagctcaggccgaaccccgccggcgagacactgagaagcccaggagaggtggcctctggtccactacaccgtggaactccagaccactccagttctccaatgtaaccgagcgccttcctctccaaacaagtcttttaataaggcccatgaactagtccatatatataccagaggaggaaagaaaaagaatgaccacagtttattctgaagacatgacaaaggtaacacacatcagttatacacaaagtcaaatttcagcattacctccagggcagagggagccaacagctttcagaaatctctgctcctgccatagactggggctcccctcagctgcctcccagtggggactacattacccagccctccttgcaggcaggtgtggtcatgtgactagccctggccaatggagtgtgtctggatggtgtaccttaaagaagcaggtgcttctttcatagtctctttccccccacagctaactgcaggcccttagggctggtggagctacaaagaagaagcctgggtcccccaaatccccatgtggaagcaaagtggccagtcatcaggaaccctgacattagactaacacataaggaagaaataatttttcttttatgaactcagggaaatattttcctgaaacacaagagtgcacagtccagagaccctgggtcagagccctacaggcccaagaaaggcttggttggacactggcatgggacagagggaggcaagaaagatgagataagcacagactagagattcgtatctgcttttcataagtacaagagaaatgtaccatcaaaatcagttctaatcaccgtcactctaattgtgtggcatcagacaagctcctcacccgtccttggcctcagttccctcctatgtagaatgagggggtcctacctggattagtggttgtgagaaataaatgaacccacgcatgtaaaactcccagaacagtacctggcatagagtgggttctcaaaaataacactttagttcttcctgaatatctcatgcagtgatataacatctttcttgaacgagtctgccctttttgaagtctgccattggaaaaaaaaaagcaaaccagcataaaataaatattatatatatatatacacacacaaaaatgtaaaatatataagtggattcagaagtagaagatgaagggcccacgtctctgaaaagccacagctgaaggcgctgaaactagccgtctggcctcactagcacagtgggtagagtctgacttcctgctggctgctgtcattcatggcaggactttccgggactgtgcgctctctgccctgtggggaagaaccccgaggaggtgagagtgagaccctgcgccctcctcactcactcaggttccagccacaacagtgaatttattttgttttttatctgtttggcttatcacatctgaatgcaaaatatgcagcataaaatgaatgaaaattgagaccccagtgatggttagagaattctcgtatcatgaactaaaagtgaacttctttccaagaaacaggggaccttcgttttgctccccaatgtacacactgtgctggggtctgaagtaaacaaggcaggagctcagctccatcccagggccctcaccctccactgctccctgagtgtggtttaaaaagaggaacaaggacctccacaaagtcagcttcacattcagcaggtggacagcagaatcaaatctctgcaaagaaacagcctatgagtgtgtgcagctgctcacaggcctaaattataatttccaggtggggccagcgagttgctgcaggggtggctttctgcagaaaaaatgaggggtggctgaactggattccacaggccctagccacacagagcatcatgcacctgaactgggggtcttaggggactcctcttgggcacacgacatccctttgctgcctcctttccacagggaccctgcgctgggaacttgcagcacgtcgctgagacaccagaatctggggaaattctgcctgtccccaacctctcgctctggctgattttgccatctaatttgtagccttgcatgtacataattcctatttgtacagaaaaacaatcaaaggtggaactagatcgtctgatctcaactccagaatgtgggctttattgctgccctgtaacctggggctgctactctgccctgatgatggacacagggttcccggaagctcagggcccgaagagagtccagctgggcagtcgcacatgacagacagggtgcggcagccaatggccctccgtgctcactgtcaacccggccagcagaggccatgcataggtggccaggtgcgactacctgtgttccagcaagtagatggaaaaggaacactgtcgctttctcagggctgacttccaaattggggggaggaggagtgggtggttaagggcatctaggaggtgggtggcaagggagtgcccccgcagaaaaggaggaagaagctctaagcccttgatgagtcagagctgaaattagtaacattggggttgccactactctttcaaaatttaagtcttttataaaagagccccaggctttctggaaacaggtggtcagattgaaataaaaatgatggctatggggccagtctcctcctaccaccagcaaaagccaaaagtgaatttatgtttcacagccagtgtggagaaagcgtctgctcaacagctcaacaggaaaccacggtgcattccagggcccctcctggggttcctttgctcattttcacataaagaaagaaaaaggatgggaagtattaatctgcagcactaagtatgcacttttgtgagcacttgttctaaattattgccattacatatccacactggaattgaaaaataacccagctcaattcatcggccaaagacacccagcctccatggtcagagtatcttctatgcccgacaggagggactgtacccttagaattgaaatcagttgaaatcagtcatgcttcatggaaggctgcataaacaatgtcattctacccttaggtattttaccctcattaagtcgcagaaaataagagcctaaagggaaactgggaaattgaactttcagcttttactatcagctccaatagagactgttggtagaaatgggcgcacatcacctgtgtctccagcatctctgcatgaaaaacagagcgtggtctatcagtcttacagaagactctcacccagtgctttggcccaaacaaatcagatttgttggaaacattttcaaaatttctaactcctagatttgatatacaacataaactaaactgtggcatgaacagaatggagagagacttgggatcttaccgggagacaagatcatacccaccaacccaacaaatgaggccacaggcatgcaagtgagatacacagaaaacaagaacaggaagggccagaggaagaagggcccctgggcagcttgattggggtgctcagaggaggaggcaagggaactggggggaatacagacggtgctgtggagagggcattcaaggtgaaataaaacagctcaagcaaagacacaggggctggaattggcaagcatcatcgggatgataaagactaaatctatttgattagagcagccttctggttttgcttcttttgttgttttgcttatactttttgcttaaaacttggacatagtgggaaatagaatcagaacagtaaattactagttcctacatcagtaggctttgaggagcaagaacctactaaacgctgataagaatcagtcattagggtctggcagatacagcatccacgtaagattaagttcacagattcccagtgtgaactccgtgtcagactctgctttaggaggagacagatcctatttcagggctgggcacacctaaagatggagcctggcgaggagcatgacttagggtgagaaccatgccatcagcctgccccagaagaatccagacatgcagcagcacaattgaaatcctcattgaggacttcaggtcgttgcactgtactatacaggggattcgtgtggaatgagttgattgctgctgctcttgccccacaacacacacacgcacgtgcataactgaaagcacgtctatgttaatgggctttcctgcagtaaccttcttactatctctactcatttcccgttgcatcatgtataccttaaacatacacaataaaactcattttaaaaaattaaaaaaaaaacctcattgaggcagtgagtataatcaacactaacggataagtgatggccccaggcaaagagcataaataagggaacggaagagatcatcaaagacacgacttagagtaaggccttgctggatttaaaaacagattaaaaccaacccacacaaacctttgcaagtaaaatggatctgcctgccatgtcacagtcaatgaagagtcaaatctgagcattatttaattacaagcatcacaaaagcagaaaaacaggttgtctcggtctgactttagaattctcttctacatattaaatgccagaagatgccagagagcaatgttcactgagcatcaggtacaaaaaggttgcagcccaggcatttcacagtcgcccaggcactcttcatagatgcaggtgatggaaaaggccagcgtgcaaggactcagcaaacacaccctccacgggaggccctgggggcacctcggaaagatgttaccatcattcaacgcgaccaacagtgccacactggagtgccttctgggatgagcagaatgcctttagaccagtcacagtgtggctgcttccgtccaaatggcgctcggcatgggcatggtttgatgtgtgccccccacccctgaaaaaagacgtgttgcatgtcttgacttggaaacatgtgacttgacttggaaacaggatcactgcaaatgtgattagttaaaacgagatcacagaggaggcgagtggccctaatccaagatgactggatgaccacctaatccaagatgacttctaaaaaggccactggaaagcagacacacaccaagaaggcggccctgagatgatggaggcagccaaggagtgcctggggccaccagaaaccagaaggggcaaggaaggatcctcccagggcgttggagagagcttggtcttgcccaggtatagtctcggaaatccaccctccaggactgtgagagcataaactcctgtcggttaatcccacctgttcgaggtagtttcttacagtagccccagaaaactaacccagcatttagtttttactaaaatctcatcagtgtacccaccatggccaccttcaagcctgtgtgtattacacactgagttccacaagacagaaggctgtggacaacagcccccaaacccaagccggcccacactgatggcactggctgggcccactgtacctgcagaagacagaagcatctgcaatacagaaatcactcagagcttagacaatgagaaaatgatggacgttctgtttaaaaaataatcaccagccagggcgcagcagtgaaccagaaagttctcagaagtcctgaaaagtgggcaagagatgggcctggcttgtagagaaagtgacttcaccaaataccagcagaaagagaaagacttctcgagggaactagagagtcacatattataaatagtagcgagggtcatggagaaatcaacaggataatgaattctctgctctatgtggagtcctggcctgctgagagcttctgatgggtgcacctcagattaaaaccagggaactcacctgcggggaagagggccccggtgtggtgctgtgaggggctgacaagcccggcctgtcctctggatttacaggggactacttattcacccaatctatgggctaggcagaatctgtgaatctcactttacataagggaactaggaggtgagaacttactagttattcttataactaataagtgaggagctggaatgtgaacccagaagcccagagtcagtgttggtgaccattctgctgtaatgcctgatacgtgaggggaagaaatcagaatgtgaatcagcgcctgtccttatatcaggcccggattgatgagagggacagaagcacagaaagggacgggggagggcaggcagggcagccaccgcacagaactgtactacagcgcttcacttccaggagagcactcctacctgcccacctgcggtctgcccttacattctacagggcaacggctcttggctatgtctactgtgactcaaagaacaggccttcggggaaacagatcatgccagcgatctatcctaattatattcctaattatattccttatgaatcaataacaaaaggatcattagacatcggagaccaaaaacatcagcacaaaaggttgaaggaaagtatgtttgaaactcgaattcaacatcaagctgagacagttctcacaggaacaggacaaacagacgtgttagtcactcaagacctcagagctcaccactgatgcaacctcgacagacaccagtgagcaaaagagcagttcaggagaaaggcgcaggacacagcagaaagaagctttccgatgcagtgtgagcaccaaagaaggcggcatgaagtcaaaggagaattcaggggcccttaaatcccaatcaaatccccaacatatacttttggattctaagcgtttggaagaaaaattctttataggtaataccagagctaaaagagaaacagaacagaatacaacagaacaaaatagaatagaatgaaatagaagagaatggaatggaatggaatagaataaaacagaaaagaagactatataaaaacagaacatttgacaaaagtagtatttcagattgtgggtaaatagctagttctaaaaccatatgctggctcacactacagtcaactggaattattgtgatcaagtgttaacagagtaaaattataatatagccagcacagtacaggcaaccaggtccacaaatctcagaatggtatcgatttttcttatgcaggtacaacagcaaagagataatttataaaggaaataatttatagatttggttacattaaaattgacgtgcgtcaaaacattccattaaaaaatgtaaacacaaactggttttcggaaaaaaaaaacttgcaaaaggcaagagctcttaatatataaagagctcttacgaatcagtaaggaagacaaatagttcaattaaaatggcaaaagatctaaacaggtgattaacacaatcaataaacatatgaacaaacttcaaactcactaatacttaaaatgtatatttttaatgtgtcaaacttctataaatgataaaatgatatcaaaaattctgagaatataggagagtaaaaatctcagataactcaggtaacactatcacaaatgtaaatgcacagaactattctgttcatgccattgacctaacaattccattcccgacaatttaccctaagagaataaaagtgcacggacaattctgtgttcaagaccgttcatcataggggttttagtaatataaaaatcgaaatgaatttaatattaaaatatatgattaactaaatacagcttactttatttgatgtgtgaccattatacttgtatgtgtggaatatttaatggtggcggtaaaattctgaaaatgtcttggtaagtgatatgaaacagtttctagaaggtgattcaaatttttaaagaactgcacatatgtatacatgaagaaagaatcagaggaaatcaaaaatttaacaagggtcattctaaagtagaaaatgttaaataatttgagtttttaaaaatttatttccctcataattttcacaataaaatgtgttattttagtaagcagatcaaatatcttattaaaaaaattgtcacgtgaaaaaacaaaacaaaaaacttgtctgtccaaacacattttcttttttttttcttttttgagacggagtctcgctctgtcgcccaggctggagtgcagtggcgcaatctcggctcactgcaagctctgcctcccgggttcacgccattctcctgcctcagcctccccagtagctgggactacaggcgcctgccacgatgcccagctaattttttgtatttttagtagagacggagcttcactgtgttagccaggatggtctcgatctcctgacctcgtgatccgcccgcctcggcctcccaaagtgctgggattacaggcgtgagccactgcgcccagcccaaacacacagatttttcaaagatctgtcctaaactatcactttcatagtgcttttctgctataaggttctcagaacaccaaagttctttccatccagtatttactgagatgcaaagaaacaaaagaagtaaaaagataaaagaggcaaaataacataatggaaggagatctggaaactgggtctgggattctaacattagtcttgaaattaactggttctgtgacctaagccaaagttcttggtcttggttttctcacccaaataaacaaagaagttgaaatgaataatttttttttgtttttttttgagacagagtctcattctgtcatccaggctggagtgtgatggcaggatctcagctcactgcaacctctacctcccaagttcaagcgattttcatgtttcagcctcctgagtagctgggattacaggcacataccaccacgtccggctaatgttttgtattttagtagagactgggtttcgtcatgctggccacgctggtctcgaactcctgacctcaagtgatctgcctgcctcggcctcccaaagtgttgggattacaggcatgagccaccgtgcccagccaaaacgaataaactttgaatgcaattttgtaccctaaagctctatgatgctatttcataattcccaaaaagccaagttcaacgacagcaaagctgcccagggaagcggttgtatcctccacccgcacagactgcggctgtccactgggacttcaatccccagatatgcttgtgattggaagccctttttcctctctgaaatttcaaaaggtgctgcagtcacagctggttctattttgccactgacaggcagacacatatttttatgcattagtaaccttaggaatctcagcccctcagtgatgtgagtcaaacaaacacatttcatgtttctaaggagagaatccagtctaatgttaaatgatcttaaggaagtcattctgtccttacatgatctaccagtcaaggaagacaggcagaaagatataaaagaataaggatgggtacacataaaactacttggaggaaaactcccttcaatgtattaccaataaaggaatggggttccctcatcagtcagtcctgagccaagcaaatccaagcctggtcagaggccaagacctctgaaagagaatggcttttagaacttattgtaatagtatccaaccagttttttaaagcttaaaataagatacacaaggtttggatatggaaatctttgaagagtcattggtatcttatctcacagaaagggaaaggctttcaatgggtttaaaatatgtgacttgcactgtgatgccaggcaaactgcactcactagagttgatgtgcaggaggtttggaaggcggggcggcctccagacaggggtcacaggccatggggaagataggcggtaaggtccacgtgatgatcaaggaaggaggtcggtttgagtttatggtcaataatactctgtgtgatgattaatactgactgtcaactttactggattgaaggatgcaaagtattgttcctgggtgtgtctgtgagggtgctgccgaaggaggttaacattcaactcggtgaactgggagaggcagacccaccctcaatctgggtgggcaccatctcatcagctgccagtgaagctagaataaagcaggcaggagaagatggaagagcagacttgctgagtcttctggtcttcatctttctcctgtactagatgcctcctaccctcgatcatcagactccaagttcttcagtctttggaatctaagacttacaccagtggtttgccaggggctctcgggccttcgctcacagactgaaggctgcactgtagtcttccctaattttgaggttttgggactcagactgatccaccactggcttccttgctcctcaacttgcagatggcctatagtgggactttaccttgtgatggtgtgagtcaattctccttaataaactccctttcacatatacatctatcctattagtcctgtccctctacagaaccctgactaatacactctgtgaggaaacactgggcctgaatatgggagacaaacagggtggggggtttccaccactgaaatctttactgtgggaccagcagagctgtcccaccgtggatggacaagctatgtaggggtgagggggatttcgaggggactgtggtgattcaccacagatgcgccagttgggagctgcagagagaggcctgggtgatgggcacatgtgatgtcaggcacagtcatgggaacagatggagaaaggacacggggaggggccacagatgctgagaaccagcccatggtgttcacccacgaaaacgagaccaagtgagatggagagaaaggaaaagaaacaagatagtgcacgccatgggaggcaagagaggggcacaggtggctggggacataggctacgggataagtcgaaagaatggagtctctagagggcagagctggtggcgaggcaccccgtgaggccccaaaggacacagcccccgaggacgaatgggactcaacaggtggagacagctcatctctgaggaggtggcagtcactgaagggagaaaaaaaggacaagagacaaatgtgaagccaacacctggcagccaggccatgggggccatttgagcatctctacaggacacagagctggggaaaaggacggcagtggagcgggtgctgggctgcagggtggaggaggaactggcttcagaaggaggaagagcatctcttcttctgggaaaaaaggtaggaggattggaataaagatagaggagacatttaacacataaagaaaacgtaagccattttggaaacaatcgttctggaatgcaatgatcatggagctgataacatgcaagattgcagctctaatagacactgtaggcaagccaaaattttcatgaatttttcatggatttaactagtagcctcaaaatgaccatttcatattattaaacatcaagagacaagaaatatccaatgggtgacggcatcatcgagaagagaatagaaacagatttccggagtccacgggctggtgagatgctctagagagcaggactctgctctctggtgtgccagccccagccgggcaccgtgctattgttggttttcatcacccagttcctgtcagaaccactgcagtcatgccacagacagagcttttgtgcaaatggtattttcttccctattaaaatgttctactctgttcccatctaaatgggtccaggagcagtcccagagacacctgcaaattgcacagaggcatggtttgatttcacatgctcctgatgaccataattgttgctattattttccttactatttcacctctcaggcagaaagtaaacaaaacacttctcaggagagagcggggagaaaggaagagaagacattgtggggccaaattggagcacaggacggcatttgttgaaccgttctgatttcctttgatgctttccctccctgctgttcaggataatgccttgttctcctccctaacttggtgtggaaggaatccctccaaaaggcaatgggggcagacagaccacgcttttattttcttataggcatttatgttcttacaggaatggtttagagaggcttatggatgaattaaatggtttgcaaaattaagactggattctctaccaagtagataggcagggacaataaaggaataaaaagccacatttggagctaatggcattgcaaaaccaattctggatggagaagttggaatcagatgaccctctgaacttgaagacatttggtgaaacagcctggagtctgcccatcatgcactgagtcacgggtggttggtgtgggtagacgctctaaacattttggctctaagcgcctctgtttatacaacattctttcccgttgcgtcaggaataggaagcctgttttctctgagataatggagtcaggaagagaaatcatgtcccaactctggtagattttgtggcagtccaggaaacaacaaggcttttctttgtataagcacacagcaccgctctttcctacctcccttctttcctgcctccatccttgtattccacagctgatcaggactcagctcatccccatcagacacggctcactctcaagtggtcctccaggtggggttgaaacagtggggtgtccgatgcccaggcagggcccagcccggcctgtctcaggggttactgctgcttgtccaggtctgtaactattgtcccaggttcggtgatcaaaatctctccagataaatttcatcctaagaaataattaaagaatccagagcaggagtcacctggtgcgtgccatatgtaaacaaccactcttgaggatgtttgaagaagcactggattggtatcaaggactgaaagcaggtagaggtttttagaaaggtaaattctgctaactacagacagggagattggaaattagcttgacaacgtcttagggaggaagcagtgatcaacaataatcaggagagtcatatgaaatatgtgctgatttccttctctcctctgatgaggttaccagatgggtaggtgtggggaaaatggtaaacagtgtctctggttttcaggaagaatttaacaaggttttctcattatatacaccgaataaaatgaagaaatgatgactggcagattaatagctgcctcaaccaaagggaagtaattaagcaatccatgtcaaccaagaaggcagttctgagggcaccctcctggctagctccattcagccttctcattagcgccaggggaagcacgaagcttcatgacacggggaagacagcaggtcacttgcaggatgatgggatatgtatctctaaaaataccaaccaacagacgcatgaatttaagaacaaaataagagacataaatgcaacatcttactcttattaaacaaaaaacaaataagctgtagggggaggggccagattagcaggagtgttagcccaatatgcgctcagtaatgtgaggatcgtgttaagtgctgggagaaacgacacaggcttctgtgtgcatcttcccaaggcaggtctccttcccactccatctccatcctccatgcgtcactctcaaggcctagagcagaagccaccatctccctgagccctgcctgatcacctccctagagtagctccttccgtcatgatccaagggacacccagcctcccctcctccgtatatgggtgagggtggtaagtttgtttgtttgtttgtttgtttgttttgagacagagtcttgctccatagctgaggctggagtgcagtggtgccatcatagctcactgcagcctcgaactcttgggcccaaacaatcctcctgcctcagcttcccaaataggtgcacctactataggtgcaccaccacgcctggctaatttatttttgtttttagtacagacaaggtctcactatgtttcccagaccagtctcaggagctcacgtgatcttctggcctcagcctcccaacatgctgggatgacaggcacgagccatcatgcctggccaaggttactgtttggcatctggcttcccaagtggaccatgggctccaagggcagagacgatgtctgtcttattctcagatgtttagccaggcaatgcctggcaccttgtagaaactcaatcaaggcttgctcagtgaagataaatgaatgagtcaccaccatcagatgtgattttcttccgatctaaattcacctggtttccctgtttgacacactgtcttgggaatttggaaatatcccttattcctgatgggttttgagatcctttagtgcaggaagtccacctgattatctttgaataagaacctacgagagtctaaaaactggttgcataaacaaatgggagaagaaaacactaattcttttaacatacaagttgttgcacttgccctattttcaggactaaataatatagctgcatgtagcgtatttgaagtaaaatgaaatttcagatgtgtagaaatcagtgaaagaagctcattgcacaaagtgaatagaaatggaaaatggaatatgcatgcattttgaaattggtcttatcaaaatcagtaggaaattaaattttaaactcagtcattcttattatattatccctattgaaattcatcttgcttttgcctgtaggcagggagcaatttattaaaatactctgcatatccaatatttcttaaacaaacaaacaaaatctcttatactcagctcaaaaagatggtgacagatgaaggaagaattagaagtgttaaaaaaagaagaaaaagaaaaaacaactaaccacgtggcctatcttagaacctgactgatgattccattcagataatatttcttgggcacccacaggccacaagccacatgacattagatagagaaaatgatagaaatcaagccatatttctctacttgcaagcaagttatatactagcagatacatacaatacacaaaatgctcttaaatccaaataaatcacattttcatgatgcaaatactgacagcttaaatcgacatagcactccattggttacaaagcacttctacctaaaacatcttatttaatttgaaagtaagttaatctagttaggttaaagagttgtgtcaatcgcaagttgtctccaaaagctacctggagcataaagaaccaagaagagctacgacaatattgagaaaacccgataagataaaggtaggagagacttgctgtattagctatcaagacttcttttaaactgatggttaataggacagtgtggttttgacataggttagacacatgaaacagaatagagccagaaatactccatccttatagggaattgtgtgaattcagaagtgcttgcaggtaaatggagaaaggatgaacaacacaataaggggcactaaaaaaattggttatcttatttaaaaagcagaaaacaaaactagttccattctttacactacacaaagaatgcaagtcattaaagaccaaagcgttaaaattaaaactttaaaaattttagataacagatcacttttacaacttcagagtgaggatagacttcttaattaagacacagaaagcatataatgtaaagaaaaggatgaatcaattcagctgcataaaaatttaaaacttctgtataaaaaagtttaaaagattggccacaaacttgatagcatttacaatgcatgtaactgatgaagagttattatacagaatatgtaaagaactcttataaattaactaaaagaggcagagaaaaggagaacaggaacactgtatagatggggaacgcaaagagaactatcaatgcccctgacatgtgaagggagtctgaccacactggccatcgggcagtgcgtgttccggccacggtgggacaccatctcacacacagccgatgggctgcgactcagtgcctgatgtcctaccaacagcaaggagggagagaatgagaactcacatctactgttggtgggaatgcatcttatacgacgactttggaggaaatttggtaacatttactatagttgaagatcgtgtgctccatgacccagcaatctcactcccaggtatatacccgagagaacctcccccaacacctgcccctacggtgctcaagggatggatgcacaagatcattcatggcagcactgctctcagaaacaccagaaggaaacaacaagcatccagccccagggcaactgacacaggactgttggcacagtcagatgaaataccacgcagaagcaaacataggaaccaagcgctacccatcagcatggatacagctcatgaatgcaacctggaacaagacgcattcatgcatacacgagatgactccatttatatgacacgtaaactgcaaaaaacaatacagtgtttaggatacacacaataaaacaggaagaaatatacaggagtggtagacctcaaatccagggaaatcgtagcctccaggtgggagggagaaggatgagactgggggaccataaatggtgttcaactgtatcgataacttcttgatttcttaagctgaatttatgggtgcaaaggtgtttcttaacagtattttgattcctaaatatgtctgaaatatttcctaagacaaatttgaaaagggctcaagtcaatatttctgttcactgagtagaggaagttttctgcaagccaatggtctatccacagtgagaatctggagagagagagaggtgttggtcaggggcacctaggaacccattctgctttcaccctctggatgagttcattcaaagactaagagacctaaacatttggaaatgtaaacattcacttacatctgcatctgttaagtgttaagttctgacatgagcttagtctaaaagggatctgggcgggatatcaagaaccaaacatcacagatccagaaagagccttccctctgctacttccctgtctgcggtctctgcgtgacacaagttatggtttctaagggacagggaagcttggctgagatcactgcacctgctctcggcttgtgtgggccatggctctttcaaaaaagatcgtgctgcttagcataattaaaccaggaactcagcgcagcctcagagtgcgtggggtggggcagagctctgggaggccgagtggtgacttcctccagtccagcatccaccagccacacgggagatggtgtgggatgtgggatctgaaaggcttcatttggcctcataaatgggattagcatgggggcagctaccgaccagtcaccttctggagtcgagggcgcccaggtaaagggctttggcatggaagtgcaggttgctgaaggagtcatgggaggggacatgacagaagatgcttccacctgggcaacacctgtcattgggagggcatcgtgaacatggctggcacattccgggtgatctaaggctcaagttagacaaagttaacaggcacaggaaggatactgaatattgcgaggttgcagaagggaggccagggaatggctgtggcccaggtgtatcaaataaatgcccccgtactgttgtttgcgataacaagtcaggggtgttagaggagccaaagaccccctcagcacccaccaaacgggcaatcgaggttgttttaggcagaaactggattgccgcaaagctgacatgttggaaggggtgagatgagagctaagaacttctccaactcgtcctaacgtgtccctcctagaagtcacgaagagaaaagggcgagactatgaaacaaagtgtgtaaaggtggaaagaagtaaaaataaaattaagaagagttccatcctgattaaccctccatggaaaagctccagagaaggtgcctctgccaattgaaagtttttcactgtgagcaactctacgtaaaatgcatctggaccagcacattcccctgtggacagctctgcatggagatgtgacggggacaaatgatctgggaaatcattgttttcgtatcagtgtttgtaagtttcagagtttacttgaatgggaacataacagctcactaataaaaaatgaggaatgtcttactttttttaaaaaacgtttccccaaataggtttgcttatatgatctatttgggggtttggaatgagtatgtggaaaactgaaaaaaaaaaaattcagaaattaataaagacataaactccatgttttataatgcccagagtggtgcgtgcttccccgctggggtaactgaagttgccggagctgggttcactggggatcgtaagggagcttcccgggcggggccatccccagctgggggaggtggcatccaggcacctcatatgccgtgcctcgggccttacctgagcatcagagtttttaaaagtccttctgtcatgggcttgctgtaagaagtcaacataaatatggacagtgctcagaacatggggcgcctgatgtctggagcagcaaactgtgatcaaacactcatatttccacagcaaaataatgatccacactaatggaggtaaagaaggagaagactacgagccttcctcacccaacgcagacctaccagggctctgtgcgccagtgccacaggcatcccttgggtggtcacgtagcctaaaatacgaatgagactaaatatagggatgtgaaagttctgcttgacacttaaatgtgcttattaagacttaatccaattatattatcgggattgatatctataagtctctaatagacattcctatttaagttttaaaatatcatgcttcccacagctggcccctcaggccctcccgttccagggcttcactgcgaccacgtggcactcttcactgggaatatccctcttgcctctcctagaactgcctccaaccagattctggcgggagatgatgcaacctgcaaccaagtcacctgcacaggggccctggcccccaagggccttgggtgttgccagtagatccatgttcattttatcaacgacattctacccctctaaagccacattgtgtttgcaatctacaacaggtagatgacatcaagtcttacagcatttacaataatttcaagacaatgactcttatctccttaattagattacgagctccttaaaaggcatcccttgggtggtcacgtagcctaaaatacgaatgagactaaatatagggatgtgaaagttctgcttgatgcttaaatgtgcttattaagacttaatccaattatgttatcgggattgatatctataagtctctaatagacattcctatttaagttttaaaatatcatgcttcctatctaggcacgtaaaatgccatgtgacattagaacaaaaaattagcatgtagaatgattagcatgtgaaatatgatattagaacaataaattaacatgtagagtatgatttaatgtgaaagggccacgtgaggtggcattttagatagaaatgcactcacgcacacacacaagcacagatacacctccctccacacattcaactgagatctttcaaaggtgacatcaaaataaaaatagcacacaaattttatggaaaagagcaaatcaaaagattgttttctgtagtgataagacctgaaatgaaaacacatgaccagtggtggagacataaaggcattacgctgcccagaggcgcagcaaccaaaatagaaagctctttactttgcaggttgatgtgatttagcctaaggcactaaatcagcacctgttatcagatcacggtccttgggtcctgatttccttctgccagcaaagcaccttgatgagtgtctacaagagggcaaaggcagcataatgccgcccatggtaggactgcggggctgcacacattaggctctttgacgcttttattacagctacagcccaaggatgcagttccaactcctgcccttatgaaaataaaatggtgcacaccatacaagactatttaaatagaccagacttcagccatctgcaccccacttcttttgagacccacaaggtcggagtgcttgcacgagaggtaaaatgatttccctggaaacacgctcacctgtgcaccatgagagacccaaagctgaatagccctcttgccttccttgctcgattacacaagaaaagcaaaagcaaaaagcacctggcatggtgaatttaattctgcaaaaatatatcctgaatacaactccctattggaaatgtgaatatctaagcagcgttgtgtaggcctttcaaagcgactgcaaattatggtggaataatatggttaacacagaagttatggcatttttgctgtaaacaataccatcaagaaaatgaaaatacaacccactacggggaaaagtatttgcaaataatatgcctgagaaggcacttgtatctagaatatatacataattcttataactcaacaataaaaagataaatcacccaatttttaaaaatgggctagtgacctgatgtgacatttctccaaaaacatacagccaataaaaacatgagaagatgctctacatcatttgtcatcagaggaatgcaaatcaaaaccataaggaggcaccacttcatacccaccaggatggctgtattcaaaaggtgaacaataacaagtggggaaaaaatggatctcggctgggcatggtggctcacgcctgtaatcccagtactttgggaggccaagatgggcagatcacctgaggtcaggagtttgagaccagccttgaccaacagggtgaaatcctgtctctactaaaaatgcaaaaagtagctgggtgtgctggcaggtgcctataatcccagctactagggagactgaggcagaagaattgcttgaacccgggatgcagaggttgcagtgagccgagattgtgccattgcactccagcctgggcaacaagaggaaaactccgtcaaaaaaaaaaaaaaaaaaagctccatctatcactgctgggtgggaatgtacaatgttgcaatcactttggaaaatggtctagaagttcctcaaaagctcagacatagagttgccatcccagatccagcaattccactcccaggtataaacccaggagaaataaaaacatatgtccacacaaaaacctgtacaaaaatgttcacagcaccattagtcacaacagccaaaaagtagggacaacccaaatgtctatcaacttactaatggattaaaaaaatgtagtatatccatgcagtggaatattacttggcaatagagagaaatacctgctacaacacgaacgaaccttgaatacatgaggctaagtgaaagaagccagccacaaaaccccacattgtatgattccgtttatatgaaatacccagaataggcaactctacggagacagaaagtggatgtagggctgcagggggtcgtggaggggaaaagggggacagggttctgttctgaaggacgaaaacattacagatgtggtaacagttgcacaaccttgtgaatacacttaaaacatggaattgtacattttaaatgggtgaattgtatggtatgtgaattagatctcaaagctgtatgcaaaaacagaaacaaaatgttatggcattcagggcaatttgaagcaaaacaaatactgagatggttcttcagaagggactttcctttagccgggcaccaggtggcatgtacctgtggtcccagctattcaggaggctgaggcaggaggatcacttaagcccaggaggtggaagcagcagtgagccatgatcgtgcccctgcacttctgccagagcgagaaggcaaaaccttgtctcagaaagaaaaaaaaaaaaaagagagagagagactgtcttggtgccttttattatagtgcatcttgaagaatggaggggagtgccttcttccacacatctagctttcattctgagtccatactcaggacagatttggaatttttcacaaagactcccaggaggcaatggcttagtgtatgataagtaatttcctcaggatatttgcttcctggcaacaaaataaaatttagaatgcaaacaatatggtatattttgaaacagagtcccccagagggtagacaacgcttctcttagccactgtatagaacagtctagaagttggataaccttatttgtatggtagtaaccaatatctctatattcatgtgaattcaatccaatttggtgctacaaaaattaaaaatgcttgactcaaaattcttacatctaacctgactcaacaatccatcggcgcatgaaaaaaaaaattcccctttaagaatttctagttattgaattcaggattgtttatctctgagagggagacaaaatcagaagtaagtttggagtctcagggaaaacataacaagttgattattgtttaagtctaaaaggcaccaaagcacttgtccctgggtaccactcagatgcaggcaacattcagttaaagtgcctcatggctttttttcctatgaggcctacagaatggtccctcacaagttttctatttctgttctgcttcaaagaaagactttctcaacttttttagggctccagtcctggcccatcgtggatggtgagatattctttagatgtttgttctgtttttttttaagttgatatatatttaggcccaaagtcatgtttattcacaaatccaaacaaccggcaagctaaggctaattttttcatgtagaatatttatgaaagaaaacaatgaataaacaacttaagattggggatttactctgaagggcactttccggaacatgtcataggctcagccccagttcaaccccatctccactgcggtttggaaaattgtcaggcctgagagagagcaaggggttctgtttactccactctaggattaaggaatggaaatatagggagagccaagtaaggaggttgtgactcagttcctccccctggataaatgtctgcacagactttagacttctggttttcaaactggggttcaataggaccctgagttcagtggagtgggaggtactacagagatgaagcagatgcccctaaaaagtggctctttctgcataagatgtttaaaaaactgggttccgggtgtgagataaatggcagaaccttgatttagatctactttcggggttgttacagaaagatctgttgggctgtctggggtgagattagatgattctcattatttttctatggttaaaattgctatagctaccatggtgtattgcaaagtttggtacttatatcaatgactcaggagcactgagacactgatatactgaattatcaaaagtttaattttttttttttttttttgagacagagttttgctcttgttgcccaggctggagtgcagtcttggctcaccgtaatctccgcctcctgggttcaagcaattctcctgactcggcctcctgagtagctgggattacaggcgcatgccaccactcccagctaatttttgtatttttagtagagacggggcttcaccatgttggtcaggctggtctcgaactcctgacctcagctgatctgcccgcctcgtcctcctaaagtgctgagattacaggcgtgagccaccgtgcctggcgtaaaagtttaattttatttagacaagttttagtgtcaagtatattttattaatctgtaattactcgaaaatgggaaatttacaaactggaatactcaggcaattggaaaacatctccctacacttatttgaagatttaaaaaatgtattagcttcggactagttattcttgttctcttttacatatttttctaatcattcctactcattttctcatcttgatttttttctctcctcctatctcctcattatatctcttgctatttagttcaacatgagatcttttacaaccaaatagcttgctagaaacagcaatgcttcatggtaaacagcgtgagggaaagatgttctgaaatggttatataagcacgtgtggcatcaactacaacgtgaggcacgtcatttgatcaatgtataaatagcaagtcgtaaatgattctttccactcctgagcagcctggcagtagcacagaaggtaaatgcaaatggccttccgctcctttcccgtgaataaggagataatcccaccaacataggccttggcagcaggaagcgcagcaggaaattcatgtgaatttctgaattctgagagaactagttacccatcggctgtagcaaaaatcaagaacaaaattcaaaggaaagaattcatgatggttaatacagataaaacctatgcaactgggttacacacttcatgaggccaaacacttaaatatgcatttagcataaaatgtgtttctgccgagggccatggaggcctccaaaaatgctactttcacccagggcccctcaggagtctttaccttctccgttgtttcctatattaataacaaattccttctactaatttatcaaaacataatcactgcagttaaaaggcagcgctgccaaatatttgaccataaaatcatatggaaagtagtggtaaagaaataatgttaccatgttttcataaaattcatcctaccaacaaatatatgcatatacaattattacatttattatagagttataacagaatagtttttaaaactggaaagccacatgtaataaataatatacctttcctaaaatcagtacttatttctgtctttcttttttgaatcctcacttctttaaattactatctgcatattctggattttagcctgggagagtattatgagaatgagaagtacaaagaaaaagaacaaaagtatccttaaacctactaaataccctgaaaggataaaaagaatgattgcagacagataatatatttatttttttcaacgaatgaaataaatttaatcctatttatcccagtttactatctcaaatagactggtaaaactgaaaaagcatttctactatgttttgaagcaaatttaaaagtattattatattttccaaatatacatcctattaagacatgcccatatttttcacatatagccatttagcataatttcaacaagtccaaagctgctaaatataccatatgtgcccatttattctaatgaaccaataacacaaatacattaccagattcatgcccctctgctcagaaagtatcactagcctgtagctgctgaaaagctgttccatctcagtcacccactccaccatcatccgacatgacctatcctgctcctggccagaggaccttttcaacattggattccaattcctcatctaggcaaaaggtatataacatacttatcctcaggcaagcttcttgtacagagtgaatgagataaaatatgtgtgtcacaacgcctttatctgtgtcagagaaaatccaaatcaaactggcttaaacaatgaaagaaattgcttggctcatataactgaaatatctcaaggtaatgtggacttcaagctcaggctgatcagggctccaatctcatttctctgtggatttcccagctctttcctctcgtgtgttggcaccatccttaagctgggtaacttatggtcacagatggctgcaaaaccgcaagtcaggactccacgtttccatgtttctccacagccactgggcagggatctcaggttacatcctatttgaccatcttgggccacattctcaaccctgagctcatccctgtgaccaggaaagtgccatgggtagggcacacacgcccaggatgcagatctccctggggccaaacaaacttaaaaacaaaaagtttctctaaaaacaaggtaggcttggctttctccaactgcctcatcctctaattgcacagaagaaatactgtgaatgaataaggcatccaacccattctccaacacccctttcccaggcctgtttgttctttttcctcttatttttcctccgtcgtccaacatcaagatgcaagggccgcaatctgagtgtgagggccagggaactcactgaccatctgggggggctctaggaaaagcctggaagagactctctgtgggaagctcaggggagtcaagccccttgacgaggtgtgtgatgtgggcaggtgtgatggaagaaaagagactgggacttgtcctttctggcttctcagtggtctgctcagagacgtttatcctccttgcagctggtgcatgagtgaaactctgaatttgtagttttccttaggagaaagatggcatgcacccctgggtcacctggcaaagctataacacacggtggctcctgcagacccctggctcccctcgcgggcttgcaaccaggcactcttcctctctccctccatgacagaccagggcgaggaaaggagaaatgatgagctctgagctggggccttgctgcccgactgcctccactaatcctgctcatctgaccgaggtcagacactgctttgcagagcccgtgggctgtgctccatttatcactctgtccgggcgtctgttgttacccatgctcgggtaggaaaatgctgagtgaaggtaacaggactgtgcagttgggaagctcatctcctcttacatttggatgttttcccaagtggccactgccaaatttactccacatcagcctctctctctccatgcccttgacctgtcctcctccctctggccctgcgcactacgtcccacttgtttcttgactcttctccactcttccccttctcttgtctttcttcttcctgcctcttctctcccctctcctcctgccctttaattattgtttaaaagacagatgcttgagcagtgtttcccggacctcccagagaaagctgacccagaggacacggagctatccatttgggtggacttttcagggcctttccctgtatttcaagtccttagttaaaagcacgtgtctgaattttctaagttaaggggggaggtttgatttagtgatcagaaaaatttccagtcctgaaacatgcctgcttttacctggaatccttcactttcagtggcatttgcagtttgacatgaatgcttccggtgctgcatttcatagacctgctgatttgtagctcagcctgtcgccaccattcaggcggctggggtgcaagagctaggagcagtgctgctgaaagtctttaagacttcagtgaagcaaacagattgcagtataacgagaaacatggagttttttcaaaacaattttgtctactgctgaaatttgcaaaacacgtcaccgaaggagtctcaggttgatcctgtacagaggagagctctgacctgcctcactaacccacaccctgagctactcaccctgcttcacggtcacgcctgtttctaaaaggtagctcaggctgaagatctaggagtcatctttgatttttctgtcatgtatagtgtgtccaggctatctgcaaggcctgtccaccctggtgtcggatggcagctccgagagcttgctagctcagtttcttctctgccagccttcaatctaattgcacgcatcacccaaaggatccttttaaattgagatatgatcccatcactcccttatgtgaaacattagggctttccacggccttcaggacacagtcgggctttccacggccttcaggacacagtcgggcttttcacggccttcaggacacagtcgggctttccacggccttcaggacacagtcgggctttccacggccttcaggacacagtcgggctttccatggccttcaggacacagattcctccccaaggccccaagagctttgggctctcacagcccaccccatcttccccgtctttctggggacactgacttctggcaggtgccagatgaggccaaagcccagtcagctcaggaaccaggcttgagccacatctcccccagaaactctgccccacaccctctaggggccaatcacctctttcattcagccctgcggagatgtctccctggactgccctctcaaacactgtcctcctctgccactcatggctccctgccatgccttacaatttgtgtatgtttgagatcagtacatttttctatgtagacttgatttgtagacagatatagatgcagccgagcttcctacgcctgtcggaggctgaacatctggctctggaatgccatgtggacatctagtgaacacctcgagccctctatcgtaatacctcgagcccccattcccagaaggacactgggacacagctgtgctgcccggcccgcttcctacccaggccccgagggcaggtgttcaccttctgtgaccaggccctgccctgccctggcccctgcccgtgtccctcccacactgaggccacagccctgcctgcgtcctgtctgctgcatcttctacaacatgctatcttcctcaaagctgaactgaccagaatattcgctttgtcttgctgctgtgacaaattccacaaattcagtggtttgaaacacagggttttccctcccagttgtggagatcggaagttcgggatccattttgctggtgttggcaaggccggtccctccggtgactccatgtccagccctgggggccacctgcgttccttgctcctgacccttcctccacccctgtaacctctgcctccctgtcacaccctttcccgcttctgcaatcagacctcctctgcctcctctcacgaggactcttgtgattacatttagggcctccccagattatccaggaacatcacgccatctccaggtccttaacttgatcgcacctacaaagcccattttgccacatatgggaacagctccaggttccaggcttaggctgtggctttctcgaggagacattatccagccttccacacccaccaagaacaccaggggtctacacctgagcacctgcgtcagggctggatgtggggctcagccggatgaagcccaggtcccgactagtcctactttatttcctgccattgaaatcccagcaggatgtggccgcattgttcattagcaccttttttcagaagttcagttctgataattaacattccctctcagctgactcatctgactgggaaacaagcatagatagatgttccactgggggctgagccatgcgactcccgcaccacacaccagaaagaacatcgtgtctcacactcccaggctggccttccagccaccgtggactccctgtgcacagtattttggtcacaggtcacaaaagcaaaaaggaaacgtagaggaagaagatgtagaataaagggaggagtaagaaaagcatttctgaagatgattgaagatatcggaggggatgcctttttctttttaatgaaaggaagcagtggacaaaggccaggctgacctgcccagtcacatcggaaggacctgctgaccccctggggccccagagatgcccggcctttcccgcttgaaacacaaacctgcggcgcacaggccaacggtgcccacacaccgtgtgctcgctccgctcataccaggtaggaaacagcaaaagcaagagctgggtgcaggtgctggaatgagataccgatggtctccgggacctctctccttatccccgctctatcctgtcctggaccatcttgaacatcagagagggagagcacacccccccaggatgggcgctctgtcccctgtgctgcctgtggggtctagacaccattgaggacttgcccactcagcgcaggactcccgcccactctttgccctttgtgaacaaggggatggatctgctgcatttgggagacatctccctgcatacacaggcctcactgcagtcattctcattcaatggaattcagcctaaatgacgacgctttttagacacccaatccctgtaacagcagtccctgcgctaggcctctaccgtgtctcttgccgtaccctgccacccactgtgtgtgggtgcagggacgcagcctcagtggggagaaggtgccagtcagaccacaccccggctgacctgccatgccacctgagagccccccagcactctggagtttcatttattacgggtcagaccctgtaaggcagatgttatactaattttacagagaagaaaattgagcctcaagaagttcccattggtgaccttgccaaagtcatatgagtgccacatagcagagccagaattcacaacatgggggctacctccaaagccccaaccccgacgcatggatcacaggcaacagctcccctcaccagctgcaggagaaatcaccaccaccactaacgggacccgccctgctcaccagcagcagctctcatgcctgcctgaggccatgtcaaccgagtcgctcctgtccagcaacacgtgttcacatacatgacggtacagttgcggacagctccggtaggtgcatggcgcaccttctacagcctagggacagccaggctcaagagagggagatgaacatgcagaacccccgaccctgactccggaaaatggctccaaaggctctcagctgcaggtccatccttcccatccatcctccctctgccaggccagagcccaggcccacagctctgagctgcatgtgggtgtcaggccagctggggagcagggcctgatggccacatgtgggtgtggcaggatttttgccctagagacctgggctcacacaggggcagtgagcccactgtggtgcccatggggggctgcccagcaggagccacagtgctgacctagcccagagccaccaaggcccctgacaacaggtgcctgactctcctaatctaaggtgcgccaaggcccctaacacccaagaggaagaggaacaaatgaatgtgggagaaagaactgagcccagaaggttcatgggtccaggtacaggagagcccttgacagaagcccggctctgcctgacagaaggtgccgggcgcccgctccatcgtgggccgaaggcagtcacaggctggaatgtgcagagggaagtcattcatcacagaaactcagcgtcaggagtcaaagactttaaatctcactataaatctctatcagcaatgtcacgaaggccatcttcctagaataaaacctattctagaagcaacagcttttaaaacaaacatccttattgacttttcctgtttttctatttcttaaaaattaccagcattaatacatgtggaaatctgtgcattttaaaaaatgttgatagtttctcaatcttttaagatattttgttgcttttaaaaatttttaagtaatcaaagttgttcggggattttttcccaaaaatgttattgtaagataacactagatcagctatattgtgagcctagattagacattttttctacagaaaatttttcaaggccaaacagtagttagtaagaaacccaatgccagcaccacctcatgctgttatgtggttctctcgtggcttctgagtaatttgacttacgcgacggttttaatgacctcctcctccattggcgtcaggtaagcaccactttttgtctgcattttaaccctctacacccaagtcctactgataatttaggcacgtagtgaatagtcagtccatggctaattcctaagataaaatgtcctaaatgacctccaaggactttgtacatattaacctagaagctgcgaattacatggagaatggccacgcatggctcgggggcaacggtcccgcaacagccacagctgtctgtggctgccgagcaaacgccaagtccagcctgcggcaccttccttctgcacaagcttcaccagcatttttagcggcacagaccacaaatcagcccgaggttttctgtaaattcacacacagcaaagaagtattatggggtccaggctgatgacaccattggggagaacccgtgtgctctgtcccggatggctgagagaacgtgaagctctgcagactcggagcctggccatgcaaggggacctgtgattcaggacacttcttaaaactccagaatataccactgtgggtgaccaagccttgaaactccagaatgttcccaccatgggtggccaagccacatcacagggaagaaaccttcaatgtgctttctgtgcagcacactcctctcttctgtgatctgaacacgaaccaccacctctaggctaggactcagatgcagtgagctccactatacccacagtcacatacggacagtaacttctcttcccgaatcctgtctggatccaagtgtccctgggccagagtctccctaagagacagccctgagtccaagcccctgagaagctcagggccatgcaaagcaggaggcctgggtgtggaaggggtatgggtagggcctgagaatggactgaggggcagacagttcagggaagggaagatcactggggtagagaggtgacctggagggaggtcagcgtgggcaggggtgagaccaaggaaaagattgaccatcactagaagatcaggctcacaggcagtgagaggccttggctgagtgggaggtggagatagtaaaatgaaaacacgggcactactctataactcccatggcaattcgggcaaatgcccatcacctccgttacatccaagcttcgggagggtaggacgagcgtctcagacgtacatctcttctcctgcctcacgcacacagagtgattgtggccagctcattttagcaggtcacactcccttccctccatcagttgttgttctgctgtcatgagccttgacaccgcagtacgacgcgctcaggaagacatcaggacagaggtctagacgcttacaaccctgagagacacactggacgctgcgcgcaagagccctgtgcatatggactccgattgacgccatcagattcgcccacaagccctgtgcgtatgggctccaatcgatgccatcagattcgcgcaccagccctgtgcatatgggctcccatcgatgccatcagattcgcgcacgagccctgtgcgtatgggctcccatcgatgccatcagcaaagttttttcacttctttgttgggttgtactctacaaggacttgactgagtcacacatcatgatccatgcgttttctttgttaagatctagaaataagagacagacccaacctcatgctgtgtctcgggttctctggaatgaaggcagtcagctatagtcaccactttgattcccgcagcccgtctgttcagtccctgaagtgatgagaaaccaagaagaattcaagaagtcaaaggtgttctaaaaataaatgctcttttgaaagttgttttgtttgtctgtgtttctttccttcgctatgttcaaagtcaaccaatcaacagagttgctttaacaagttacaggcaagagggcttctcgtagcacctttgcaagcatagtgtagaacgcagcagtctctccagggcttgaccctgtgacagagagcccagggccccaggtgcctgcaggagctgacggccatgtggcctgaagtcttaaggctcgtggagggcctgcagagccccctgggcttcctgcctcctcccagccttgcccggctcccagcttttctcacacagagtcctctcaaagccatcttctctgctcctcttgtgttttacccacagttcagaacaagaggcttccttggtttttcaccctcagaaagattgtccacatgatattatggatgtaaaactatttggaagctaatatgatatctgaccttagttctagagaactagttgcaattatcctgggctgagagcattaaaattgggacctgtgcgagcttcttaagtagtcgctagggcatttctaccataaccattccaaaacaaagtcattcaaagtaaaatccccccactcctcctgttataaatttggcctcacagtttaatgagtaaaagctgcaagcccacaggcccttggcaggatgtgtggccaagatgtcttggtgcaaagaatgttaccgtgcacttcgagtgcagagactgctctccacagcaggccccaggcttgcattctggctaatgtccatctgaaaattcagattgtgaaactacagcatacgaatcattccacaggtatgaggcctgtttttcttatttgtcaatctcattcaagcctttcttttctttggcaacaggaggaaatacactggccaatacctaagtactaatctttgattcattttttaaaaatcttgctaatttcatacagaagacagaataactgaaagaagaaacaattcttttctctaaaaggctagataatttctaccagtgccttctcctttctcccaacagtccccactcagccattccttgtgggctgatgccagaaacagcgtggaaaacaagtctgttttccaagaggggctattaccacgaattatgtttaaaatgacagcatcaaagattaaaccatcattgtatataaacttaacatagctataacctaggaaaagctagtttcatggtgataatactaattagaaacagatgtgtattcaaaggggcaaggaaagaggctggcaggagagaaaaaacatttttcccccataatgtagtgcaagaacctttacagatatggtctcaccaaagtcagctttgtgcaacaccacggatgccaagtgcaagctgtcctgacaaggcacatttcactgatgaagcatttaataaattgcagataacccttattacagggttacccctattttgtagctggggagacaggtgctcagaaggattcagtggtttggcaagggagacagcaagaacactagggcagtgtgaggtggctgggagaaggggcagccggcaaggtcaggcacttcccacggcaggagactggcaccgagcaggggcaggagggaaacagggacaccacctgctccatgcctgcagaatcctacctccacggggcaaggcaagggcaaaccacccagcctggggagctttgcacaccaaggctcatagaggaagactggctagggagcattcgccgaatggaatcaggtagggctctcatatcagtagcattcttgggaacaccctctgactgatctccaggaacgcatgcaaatgactgcataacatatgcaaatgactgcataacaacaggtacacatcttggctggtcggaaacactgcttctggcctgcttggtaataaatcctaggtgtatggttacgcacatttgtcctccacgccctgatatgcaggtgcctccggcttccttgtagctgcaccattattttcccctagctaagcagttagcaggcaaggcttctcacgcagctgcaagtcagatgtgattaacagtatttcatatggaatatatttgtgtctgatccatttgcttgattaaatcacactgtagcttaacagcctatttgttgataatttttacttatttgaattcaatgtaatagcttttactagtgaaaatatatcagcaaacataaaacgctgagaaaatgcaacacaacctaattcagtgtaatcagaaataaaagcagagcattctagagaatgctgctagtcttagaccagctctgcttatttaataagcacagatccttggagcaaaaaaggtagagtatttctggctaagttactggttaccaactccacgtcatacaaagtaaactcatcctggtcccccatatcaaaggagcactctcctggcagctccctgaaggtccccaaggccgcacacatctctggttgacccgaacgttgccttcatcctgaagctacagccctaaagcctctttcctccccttccccttcacagccagcagccctggaagctgcctcagagagttcatacttctcccacccactattaaattgccacttctgagaaactatttgccccacatgtgagaaacagaatgaaattccaggtaaatggtaagtcagaggatgtgaacatagttccttttttatttaatgggcttccacttcattcttctacttctgaatgcatgaaaaatagtctgaacagtctttgctgtgctgggtgtggccaaagacagtcagcacgtgggtttacggaaaaggacgggcaaagcaaaaggggcaaaatctcactacgtttagttgtcttttcacatcgtttaaaaaaacaacaacactatttcggggatttttcctgaacgtaaagagagaaagtatgtaatgaaattccaagcataaggcatatcacagaaattgtgaccacaaataaggaattaagcttaatgtctttaaaatgagtatataaaggagcaaaaagaagaacaaattccaattcagtattcactaatatggactatttattgtggtttttttttggctgtcagaaaatccaataaaattaagataaacataatttctttgggagcatttattgagagtacctgaaaattatcttaattagaaatggttttcttggaaaccacccaagatctagaagaagagctcacctatcatgccccaagaataagccttagtggtaaactttccaggaagctttctttttatccatgactggagccaatattgttcctgatgcttgctaagagtcccttcacacttcctttattaggataccatgttttccttaaaagggatgagcaattaaaatgtctttatatgtacagatagatgaattctgatgatctgtgaccaccagaaatagaaataaattgacaattgatctaatcagaccatttaaatccaaagctgccaataatttcacagcacttataccctgatagcaagcttcttttgacttgtttgcctctattgttagacattaagctcactgagggcagggatcctatttttatgtcccagttgcttagcacaatgcacacagtatgtgctaaaatcttttgagtgtatgaacaattgagcaaatagataaataaaacgaaattctccttccactcagcagttcatcactagcaatatcccaggtagagtctcgcattttgtcttcctcattcactccctactgtctttcaggagaaatgccagttacagctgaaatagctcaaataataggtcaccaaagagaaccctctggctttggtaactccaaactaataactgcttcctaaatgaaatgactttgcatattgacacctttagcaagttggtggaagtcttgagttaataatctcacttttaattagtttaaatgtacattccctgttggaagaaatacaaactaagctttggaggttccacatcccatcttctgaggctctactggcgtgtggaaaggttgagtggggagaagattcctttcagctcagtggacctatggttctgctaagttaggacggtgagggtggtgcatttccttgctctcaaagccaccttagctcattaggcaactggcatgggtaacgtattttgtagataagtgcagtgactcataggccagacactcagagggtatcctatcccagccaggtgacggtaactccagcttagcaaatgggccagtgtcccctttcctcatctatgaagtggactgttgaatgagatgcaggttactctgcccagcaatgtgtcgtggttcttaggcaatactgtcaatgccctgaaagcagagctctcttggggatgagggtcttgcggtcactgagacctgacacctttctggggcacacccatggaagtctatggaagatacccagttttcctctagaaacccccaaaattatagttgccagagtcaacaacttggccatctcacttggttctatgctgatagaggacaaaaatattcagtgaatttcattttaatctgtaattaataaactgtttccaaatatgattaagtaacctgacttctctgtcacttagggtttagcaaatgttgggttatggacgtaaaatttattttaaaatcaagtatgttcagagaagttttgccaagcataaatgtaaaagagaggaaaaaaaagaaggaactttagaaatttctcattatttaaaaaaataaaaaatgaaaataaataaaatcaagtatgaaaacattaggactgagtctctctctgaaagccttttaaatgaagatattgttttcaacttaaagtaactacattaatttcctgtttatgtcactagactttgaatttcaaataacaaaaattttcaaagtctttgtatatttcaaaatataaatttcacagaaacaattttaaaatgtttcctattataaaacaagttatctttctcattcatccacacagaggaaatacacatctgtgttcagtactttgtgtcctatttctcaacctcaatccattgacagacctcccctgctcagttttacattttttgatgagtgcttcttggcctataaccagctgtgaacacacaaacgaacaggcagccttctcaagtatgggtagggcgcagaagaggaacttactggactggggcacaaagtcagctgcttgtgagactcatcactgggtggaagtgccctgaggccaggacttctatgtctcgtgtctttttggacacagtatccagaaaaagaccagcccaagacccggtcctccataaacacttgcagaatgaattccttggaaagcttttaacaagactctcaaactctcagggtttcttccccttagcaatagaatgaggaaagttacatatgctaccccgattttcacaagtatcaaataatagaaagctggggaatgcatttgtaaaaaagagagcattgtattagcattgacctttttttttttgagacaagtctcgctctctcgccaggctggagtgcagtggcgcaatctcggctcactgcaacctctgactccctggttcaagcgattctcctgcctcagcctcctgagcagctgggattacaggcacgcgccaccatgcccagctaatttttgtatatttagtagagatggggtttctccatgttggccagaatggtctcgatctcctgacctcataatccgcccgccttaggctcccaaagggctggcattacaggcatgagccactgcgcccggccattattgaccatcttagtgagacctccagcacctagtacgggatctggcacacaggaagcactaattgactacttgctcttagactacatgtattttcagcccatttgacctcctacatcgctgatggtttatgtatgacttctagaaattttatttctacatggaagaaacctcgtttcctattcccaccacccccccacccccccccccgcttgtttcccactgtattctttccggaggcacgcctgcagcccagccctccttgcagaaccctgtgacaccagaggcgtgtgtatccagaatcaggcagattcctgaactcccactggtcagccagtgtctagtgctgctcttcataaacaatgcctggagtgtgctcacacgtgtacctcttcttggcaaagacagtaaatggaaggagacaaggagttgtctaataaacttggcattgagatgaaacaggaaacaaagacatgtatccggataaagataaatactgttctgagtttctgatcttgtcaacttcagattttttaagtgcctgtgtcccaggaaaatgatttgcctcactggtgtgcttcatttctttcaatattagacttaaaagcaagccctcctccagtactggattaacagttttgtttgaaagatgtgttttaccctcgggaaccggccatactgatcctatctagtacttccaattctgatttagggatgccataagagaaactttttaaacaagtaattctcttctacttttttgtctattcctcaggtctctcaatggttacagaacccatgtctgtgtctaatatcatggcagctgggacaaagaaaaccaagatgaaacatttgagattgttccagctgaaacaaaccaaccaaaaccccacaggtgccagccttgaggcaaaggcgggacagtgtcaggcgaaatctttgggtcccagcctcagtctccccatcaccatgtctttttcacttaaacacgtttcactgttttgtcatctatagattcaacaatgtgatttggacactgggaataagagaataagatttgatggttgaaataaaacacaccacgagagaaccgtccacaaggaaactctaagatgccaagatgcgggacaggtagaaaggacagggctttgggagtactctgggttttcaggacgaatctgtatcagcctcggcgctgcgaggatattgcatcaggctctttactcctgaacgccgttttagacgcctaagcagattgtgctgctgcctgttcttccccgttctgtgaattctacactgacttcaagtgcacgaatgagctacaagataaggtggaacctgccggccgggcacggcagacagcacctgatcagcgcctcggagggcggagctggggggcttctccactcgggactttgagggacccccgcggagcgctccgcgccactcggcggtctagctgcagagaaagcccctcctcacccggggctccctgtggcccacaggggaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttccagtaacttgaactccctgacgggtctcggggtccacccaggggtggcgaggcgggctcgggcgaccacggcccgctcagtgcccggcacctgcgcgccccgagggcggccgcattacctcgagccggctcaggctggagctcttggagcgcgacttcctgcgcaggtacacagagaagaacctgcgcacggcgaacttcttcatgctcaggtccatcgccccgcgcccagcccggagcagccgcagggccgggggacgcgcatccccggcatcccaggcgcggggctcaggtccgcgggcgggcacgcgtggccagggagcccggcacggcggccatgggcgcggggcgtggggcgcgagctgcggtcacaaagggcaggccgcgccggccaccgcggccggggccacaatcgctccctccgcctccttctccgc

SEQ ID NO: 1388 - DNA, 87292 bp, Homo sapiens
tcaaaagataaataaggtccatgtttattcttcaatataatacatatacatgattgttatacatctttagaaagcaaagaaaaacagctaaatgaaagtacgttcagaaatttaaaatatacatgatagacacaatcaccacgttatgaatcctttttttaatttcttatcaacaccaataaacctagtcagaaagactcactgacatctatcagctgagacgacagcaaaatacacattaggtaacatatgaacgctcacacagcagatgctttctgctcttctgaatgggtagtagtggttgagttataagccttcatggaaggtgaaactgcccatagaaagaccacttatacaaagcacagcgcactaaaatggagcaaaaagaaatatagaacacttctaactgagaaactgcagactccaagctatgtgaggaagtcatcttaatccaggaacccaatatctaataaatccagcacccacttccctttaggacagacggaaagttgcctcctggtaagaaaatttcttaatctcaaaaaggctttcagggagcatggtgatggataagaagacaaacttggatccgaacttaagaaaaaggaaagaagtaaaaaaatgtaaaagagagtgcaaaagcaaaggcgaagctttgtggatattgggaagtaggccgtggtgatgctgcagcacacagggatgacaggacggccaggggacaggaaagaaccgagtccgaggaccacagccctccaggggcctgatgctgcctctcacttgtgcttttacaagcggactttcaaccggggttctgtcatttggcccccagcacacgcatgcacactggcacccgtgctgcgtggctgggggaggggcagaggaagcagaagagacaaaaaaggaatgaaataaagagcagattctgttcctagtatcaaatccatattttgattcttaaaagagaaaaaaaaattgctaagctaatttccataaaatggataaaaattaagtattcacacatctttccaaacatacatcaaagcaagccacaacaatggcaacatgcctacttacatttttgaggaaagaaagcaaattaatatcaagttagaggaaataactgaaaacaaacttatggcactcaacagacatgagtgttaccagcttcaacctagaaattgtttccccaagttagttcagatgagagtctcgtccaaagtttgtaatgtagcaaatggggacatgtgccctcctctccctgatttttaaatagcaacagattctgggtaagtgttggtgtcttccaaattaccaatgaggcatgccttctccttaataacttgcgaggtttatttctctccaggcagtgggaagtgctacatcggtgcttaatttcctccatttgctaaagaaagtgggaactgcctagtgagtgagcaaagccataccatccattaagagggtggaggagaaatacagcctcccaaatcctaatgacctgttggaaaaattgatctccatagccctggtctagccagactcagcttttctgagtccatgctcgcatctggcttgattcctcggctttgcaaagccccctttccccattagagcagcagtctacctagttaccagctctcgctggagcagccacacaaggacatggagcaggggcgggatgaacactagactgataatctcccatttcaagtaactctagactgtaatcatgaactctgcaatgcaaactaccctcagcactcatataaaaggcaccctgctggcatggagatgccttcccattccaaatgtggaaatttaactacagaatcaaacaagatccattttcaaagtacagtctcctttctaaacctcaaaacaaaacaaaaatcacacccactcactgcagggtcatcagtgcattaacttggcaaagaaatcatgcctgtatttggcctgagctgtctcttccatgtgtggcagggtctggggacagtttatctgccaacctgagtcagaagggaaggtggatgcaaattgcacgtcgtgcaaaagatctcctgcttgatttggtagagaatgcacaccacaggacagaaaacgccctgccacgaggggcttcaaatcagacccctgtgtcctgtttagcatttgagtgaatgccagctctctgcggtctaactaagtattaatgcatgcactggcttgtatttttccaggctcaatgaatatcatcagctaaagatagcatagtaatataacactccagtcacagggttttgtgtgtgtgtgtgtgtgtggtgtgtgtgttttaagcaaactaaattaaacacttaagcatagtcacatcacaggaacataagaaaccaacctcggataaatgcaaggccaaaggagaaaaagaaacgcatcataatgtaagagcaaaggctggaaaggagtcagttttataactaacacgaccacaaaattcgcatgtggccttcaccaaatcacgtatttccttctatctctacttcctccttaccttaaagatgagaataaggatgttgcacacattcacggcatgctgtaaggattccttaagtggatctgagagataatgggggaaagctgatgcaaagtgaaactgccatccctcatgaggccaccaagtaattcttatgcctttcattgctattgcgacaacagtaattgagaccattctggccaacatggagaaaccccatctctactaaaaatgcaaaaatcagccgtgcgtggtggcgtgcgcctgtaatcccagctactcgggaggctgcaggagaatcgcttgaacctgggaggcggaggttgcagtgagccgagatggggccactgcactccagcctcgtgacagagcgagactccgtctaaaaaaaaaaaacaaagaataaaggcattaacacagctgattcaacacaacagttatttggaaatggaaaatgtgagaaagctcatgaatctggttggtgagcttggagttcagcgggtaacaggaattttgtggggcttttccttgcctctccttcatgtggaaatgacacactcatttcgctctttaaagcccagtgcctttctgggccccataagctgtctacagtagggccatttcctttcttacatatctgccatgaaatggcacacaggctaggcataggaaccttccaactggaacgttccaacattctcacgtccagcaggtgagcttgcagagttgcccccacctctggtgtccgattgagatttcttcaccaccattgagtcccatgagacagcacaggcgagagactgtacttggtctttgccactgtttgtatgtgtttacccagaagcttgaatgttatttcccaagtcacttcaatgttgaaagctcagtgctatcttgctccaggaggtgcagatccgtctcttttagttgacaaatggggcttgaggaaacctgttgtgactgttgacattatttcaaaggtcagaatttcaaagtccaaccataaacagatactttttgcatcacctctcaaaaccaatgtgttttgtggggatgaactgtcagtcagaagggtgcagggagtatagatgtgaaaaacagaatcagctacatggaagaaaacgcacgctggggacaattcagaataaatgaaagacacagtggctgatgcctcttgttggagaattcaaagacggcttctgttccagcaaacaaattatttatccattgtagtcacgtgaccacagaccaaatcaaaatgacagagtctgtgaaactaagtctccaagggtgcatgggagtcagaattctttctggccatctaattgccccttccaaaggcatagtctaatggctggaagtagctttctccctctaaatgcatcctccagttttaaaatctccaatcaatcttaagtgtcacagctgtagtcatttgagaaatggcagacataatgcaccccctgccccagtgactaagatcaaaaaatttttttaaaaaagtaaaaaatctcaagatggcagggaaacatcttcccaacatcaccaccaccgggtgcagggatgtgtttgcgccctgagaccagaccgcagcgctgggtgttcctctgagcgcagcagaggcactccagttcaagttcacattcagggtcgagggctccccctgctaagactaccaggtcatcacaggggtcaaggcatcagaactgctgatttttcaaaaaattttctcgaagcagcagcaaccacagcagttttcctgcaaagcaaacaaaatatgaatcttgttaattcagcagggtttttaaaattataattagttggttgtgccccttaggaaaaccacagatgattttttttaataacatatgtgtgtatatgagcgggggaaaaaaaaaagaaacctcttgatggattccaccaccaaccagagttgggctttttatttttcagtttgtgcaagacattttttttttctttccaacttttattttaggttcaaggggtacatgtgcaggtttgttacatggggacatgtgtgcaagatattttagtactatttgcaatattgaaggacaaggcctctttgtttcgtctgaagtacagccactccgtccatctggtcagcttgatcccagcatcaaagtgagaatgtggcctcaggtgtggggaggtttccatgtgctttatgaccacgtctgacctggggcccgcacacggctacctgccatcattcctgtggctctgaggagtaccctaaatttatatcccataagttggcaaaagatataacagaggtaaccagaaacaaaatgccaccaggttgattttgggaatgtttcctctaacaaattgtaggagacatatatgcctcagttgacattgtgaattatgccttatttatcggcctggaactctttcttttacaacaggaataatcttcagccaccagatttttaaaatcaatattatctcaaatttggtttccatcataatacatcctgccataaacccatctcatcctggcagggaatattatcgtgaagaataatcttttttttcctaacttctcaaatgaggctgctcccagagttaaaatcttatgttaagttttatttatttatttatttttttaagtaagaaggtaggcagggaatggtggcttattcctgtaatctcagtgctttgggaggcagaggcaggaggatcacttgagctcaggagttcaaggccagcctgggcaacatagtgagacccccatctctacaaatttaaaaattagccaggcgtggtggtgaaagccttttctcccagctactcaggaggctgaggtaggaggatcacttgagtccaggagtttgaggctgcagtgagctatgctgatgacactgcactccagcctgggtaacacagcaagaccctgtctctaattaaaaaaaaaacaaaaacaaaacagaaagcaaactaggaagcatccagattgtgtgtatctgaaatgattcttccttggcctgtagtgtgactcaggtgaatttctgaggccaaatggggctgaagagtgcaggaaaggaaggcagccagctccatggctgtcagcagccctcctcaagcagttccagcagaggctgtgtccagctgccccagcgtggccagcccaaatgctgctgtctgcgtcctctgcacagccatcgcttcgtaggctgctgtggtcttccatcacattgggttcgaggcacccatgtctgtgtggaaggactctaccccctcccatcaccatttcctcctcattcctcccccaccagaccctggcagcaggcccgccttggaatgcaaccctggcacccagtgaattcattcccaccaggcctccagagtggctccggtccttatggtgggaaggtggtttgtggcaaaccctcggggtttgtggtcgctagggacaaaactgcttctgggggtgagggtgaaggcgagggagagaaggagtggacacagcctggttgtctgtggatccaggaactgacggtgcaggactggggcacctcgctgagtgccataacctaggcctgggggcacgagggtcctttcttgctccaggttgtcctcacaagaaacaactctctcctaccttattgagactttcatgtccttgctgtttttaacaaagaagaatggtctttgtaaatggaatgcacaagccttcctgttcactttttgtggatttctaaataagtgacagggcacatgtaagcgtcccttcctccgaaggccaagtgttttcctagcactgatgtgtggcctttactatgaggtactgattcatttctaccccatcttattccacaaaaaattcaaggcagcttacaataatatgtacaatcaaaaagacatgcaaaaacctcaggcccagaaacatacctatcagaagaaaggattaagaccaggccaggcccggtggctcacgcctgtaatcctagcactttgggaggctgaggcgggcagatcaccttaggtcaggagtttgagaccagcctggctaacatggtgaaaccccatctctactaaaaatacaaaacttagcctggcgtggtggcaggtgcctgtaatcccagctactcaggatgctgaggcaggagaatcgcttgaacctgggaggtgggggttgcagtgagccaagatcgcaccattgcactccagcctgggtgacagagcaagactctatctcaaaaaacaaacaaacaaacaaacaaacaacagtgagcagcaagaactcactcacaagtcgtcaacgctgtgcagttacatgcatggagctgtgaaaatggctgtggactccccacccaagattagggagctgacttgctgcagggtctaggcccccggcaaggacatgaatgttgggttttcttagagtccttcataagtacatgtgcctcttagtcttctcctttagggctacattgggctagattattgatatcaaagaaggtattcatgtgtaaacccatctctcaataattccaaaaacacctgagctaggtggaggtccgcatgtgtcagggtgtatgggaggtggtattctttgggctcgtagagcaggccaagatcaggaagcagctcaggggattaaaaaacatgggcttcagcttcagaaacacccgagggaaccacactccaccctttacaagctgcatggccgtgggggtgtctctgagtctctgagactctgagactcaatttccctatctgtacagaagagggtgtcacttcctctgatctcacacattgtcgtaaggactacccctagacggttaccagcaccccctgggctggttattgatccctcccacgcaccaggctctggtctcggggctttgcttgaatgatctcgtgggagccactcaacaagcttaggaagtgagactctccccaacccgtaagtcaggcactgagcttcctccagtaagaaagagcagaggcagggtgcaaacacagcagtctgatttcagggccctccacgccagccaaaacgctgctcttcttcctgcatagtctgtgagcaaatgctccatttatttcttattcctatctcttaaggccttcacagacacctcttcaggagacccaagactaaccttccaaatggctgcctcctgtagactatttggtcacaaagtcctgggcatcagagccacgattcttcttcttctagggaaagcagaaggcatatgggaaggattaggactgtttccttcaggtcctgacttatgagctcacatgaaaagacaatcacttgctactgaggagaaggtgctcttcaagagaagttcttgaagcctacattcccgacaaccccctggcagacacaccggccaacctcagagtccatctcagagtccactctcccctgaggcccctgtcacacgacccttccttctcacttagagtcagggccaaacagctcagcacctcatcacactcaggtatgttttgcaaaaactcacgcgtgtatagcacaagaatgctctatcacttgcgatactggggctacgatgactgcaaagatgagtcagacacagaaatggcttcttccaaaagttttcaaattgagtagacaacggtaatgtgaattccacaaagagattcaagaagacagagaaagagtctccagtttgaggattggaaaagctggggcatttaatacaggccttagacaagtactgacttgtgggctgctctagaggcagcagtgaagacgagactcaaaagaagagctgggggtgtcctggagcaggccctgactgcaaccgggttgggtctagtgtggacaatgggaaacgcgtgaagattttttcagtcaaggtctgagctgtaattaaggaactaatgatttgatagattagggaagagggtgagtagaggttggatatcagctcatgggttgttttattagttcactgagagggcatgagccgaggtcacaacactgagaatgggaaggaagggtcagaggcttcttagctctgggggaaagaaaacatgtcaaatttgtgtcgtgttccttcctctggccccagaaccctggctaattctgcagtaggtgctgagttctagtagattcctaatttgggagtgctttgccccaccccagctgagagctgcttctgatggaaacaggttatacacagagggttggggacgtaagaaaggctgcaaaccatcgcatgtcaccttgagcataatacagagggcagagaactctcggatgttaacttctaagaaaaaaaaatccttcttaaatttagtgacagtcaatatgctactcaagtggttacaaaatagtaagtgcttttaagcttgaagcaaaagagacaaataaaaatatacgaaagactcaaaaatagaatttagattgaaatggtaaacagttttggatcagaattaaattttcaacttaaaagtaaattctgattttgtagaaccaatattaatctaaaaataagccttctggaaaactttcgtctcaatatttccttgaaaagtaagatatactaagtttgaatattgattttcagtaacactaaaactgtatggtacaagaaaggctctggaagcatcgctcaggtcccctgtacccagcagcccatcaccggcaggagagcagagcagtgaggctctgcccggactccagagctcagccctgtcctgagtgttctcagctacagacactaatgtgcccattttgtgcgttgctatgaggagtcagtgagttattttttgtaaagcagttagaagagtacctccacaatactgtataattatagctgtaataactagatttataaaatgaaatttatttttcattaaaaaaaacccatcatcactcttgaactatctattcacctcaggtaccagcagatggatggatacaaaaggtgattttacttgttgttatatggtttaaaaaatattcttaaacactttttaaactgtacaatgtcattaattatctgctgtggtttctatactatcctgccatgtcaaagtgtatttggacaccaataagcttggataaaaatacatcggtggaaaattggctcaaaataggttagtaaccctaataagcagtttatgtagtctgggtgaggtacccactaggtaataagtctatttttacttgacatcagtaccaattatcaaggaaaggtatattcagacacaaataaaacttagtgccgatgctgaatttagaagtaaagttaatttcaataaaaactggatgtggaaaaagtgagtacctaaggcatagtcattccaaggtttgttggtcagtgaaaaagttccattccaaaacctcaggaaatggagaggatgaggagcaaaggtggaagaaacaaaaacgtatcaaacccatgctataccagggcagggcaccagccaccctaactgataggtacatcagacaggtcctggtgggcccaaaggttggcatggcgtcttgcctgtatatgcatcttgccagttgaacatcctagatgttcagtaaagttacttgggcattacacatctgtttctgtgttaattatataatccacaattatttggatggagacaacatgaaggaggcagagaagccagttaggaggctgcagtcactcaggggaggcatgtcccaggccacggtcaccatgggaatggagagaaacagacagcttccagaggtaattaggggatatcatgtacacaacatggaggtaaattaaacatgagatgggggctcgagggagaggaaggaagcaaagaagatgtacgggggctggctggggccgctccatgggcatccttccctaagaggatcactgatggtgaggcaaggggcagggagatgagattagtttagggatgggaagatcctggtggaaacatctagtacacagatggacatatggatctgcagcttaggaaagatatctgtgccaaagagacagatgaggaagtcggaatataaacatctggtaattaaggcaatgagagtaggtgaagatttcattgtaagaagttattacagagagtgggctaggttattcacaatactcagtctgtagtctaagagtctcccacacatagacttgtatagatacccggactaagctgagtattagagttaagatttggtgcccagagcagatcaagccaggtgagcacagaatttagaattctgaattctgttttaaggaggcatatttctcctgaatgaacattactatatattctccagaactttatatgtttataggttatatgtgtgtatgtatgtgcacataagacaatgaagtaattcattttataatggatacaataatttaataataaacagttatgctgaaaatactctgttaaacaacaaatacattatttttaaaatgtaaactgctcaaaaaagcattttaaggccgggtgcagtggctcaggcctgtaatcccagcactatgggaggccaaggtgggtggatcacgaggtcaggggtttgagaccagcctgaccaacatggtgaaactctgtttccactaaaactacaaaattagccaggcatggtggcacacgcctgtaatcccagctacctgtgagactgaggcaggagaatcgcttgaaccagggaggtggacgttgcagtgagctgagatcgtgccattgcactctagtttgggcaacgagagtgaaattttgcctcaaaaaaaattttttttaaaaaagcattttaagtaatttaatactgcacaagatttgcagtctgtgagaaaaagaatgagaaagaatcttatttaaggttaagatgactccagcatctgatcttcaaaagacaggcagacaggagaaaaagaggaagagcaagaagccgtggtcacctgggcattgagtctggagtggagcttgtggtctgacaaccaggggtgcttgagagcttcgcttgcacttattcgccaactagaaggaaattcagaaggtgattagtagaaacacaccgaagaaggcctgtatctgctgttcaatctcaactccagcttctgccttcgggagaccagatggccgaatgtcaactcatggtcaattctgccttctcttgaattgtgtgctatcaatgatggcataggtgactatcgaatccaatcaggataacattagtaaagacaaacaaggcaaataataaaaattcttgttaataactgaacatttactttcaaatataagtaaccatttctgtagtataacatctgagcttagtaaagtggattcctatcagtcagttgaaaaataaatatatatttattattgtaagaacaaaatgctacaatgattcttgatgattgccaaagcaatttgtgtattaaaacttttgaataataaatattactaacttttgaattgagaagttttgagttaaataggtagggaaatagagtcgatgtaattattaagagagggaccattagatacttttatgaagaaacaatatccttttggagccagcaaaggtttataagattttgggaaataatatgaggaagaataatatagatttaccatatttaaattctaagttctatacatttgtttgatgtgctaacatttatcacattaaaacaaataacctttcaaaataaaaactgtaggccaggtgcaatggctcatgcctgtaatcccagcactttgggaggccgaggcgggtggatcacgaaatcaggagttcaagaccagtctggccaaaatagtgaaaccccgtctctactaaaaatacaaaaaattagctgggtgtggtggggcacacctgtaatcccagctactcaggaggctgaggaaggagaatcacgtgaacccaggaggtggaggttgcattgagccaagatcgtgccattgcacaccagcctaggtgacagtgtgagattctgtctcaaaaaaaaaaaaaaaaatgaaaaaacaaacaaacaaacaaaaaacctgtaagtgaatgtaacaatctgaagtcaaagaggcagtttcaagcagtaatgaagcttcagtttgtaggattgcttcaatgcaatcgcttcatcagataccaaaatatttaagtataagatttgaagaggagataagtctttattacatcaatgaacttggtgacaacatcaccattatagtgccaaaaacaggcagaggtaatttttaaaaacctcgtgacctccatcaacctcagttggaagtgtggttctgcttagtgtcataaattttcagtactggatctccagagcattccaatggctgaccaaggtgaaaaatgatgattctgtactctagtgtcgaacttcttaaatctggctattaaaaagttaacaataacattgtactaataattaaacttaataacatttcaagtttatttctgtaccccagaaatttattctatgatagtggtgtttggcttttggctttagtttcatccaagcattgactggaattctaagccagttgccatcggcccaaatgggcatctgatgctccttgggcattcatgaagccctcagactgaaggagtgagcggcactggagcccactgggcccacctctgcatctgctctgagatagccgtgtgactgcagcactgctctcagcctcagtttccccatgtgtaaaatgatggtctccacagaccacaggattatccagaagccaaataagataacacatgaaagtacacatgtaaaacaggttcacagtaaatgtggacttctcgtcctccaaagatttgaaagggttgacagtttccatctgttcactgccttgggtagagtaatgtgctcataataataaccttggctgttattgtgcctttccatcaaggcacaatactagccaaggttattattattattaatccattatttgtgaattgtccctcctgtcggactgatacccctagcctggctaggttctcttcatcctctaaggatggccttatctttgtgttaaccacattttattacatctttttaaaaaatatctatcccttttattagatggtgagttactataggcagggactggatttgtgcctctattcttagcacatgacacatttcctggcacacagtaggtgatcaacacttgaatgaaagcatctcctgccaagctgtgtgccagacccactgcccacactgtttccccactccctgtgacacccttctacctgttgatccacagccatgtgtattagtgactttaaagccataaagataataaaacgataaggcaagtgctattgaccctgaaaaccttaactacttcaatcattatacggctcaggtataaagccatctgaaacagcgtgtttgatgggttaatcacaatgcccttccccttctatgattctaaaatgcaaatccctatatttcaatgtcactctttttcattcactgaattttgaattaatgtggttttagcataacagaaaatagagggccatgtaataaataacagccaagtgtgcggccgttggggaaggagaactatctgtttgagcctctgttctgccaattactggcggtatgatgatgggcaaaccacgtgggatcttctacccgatttctgcctcatggagttggggtcaggggtggtagttaaaagagataatgtctacaaagcacttggcatgatctggcccacagtagtttcccaaatgaaatggtagttaaagattcagctacacggaaccatatacagcttagtagaggtgaaaggaatcctagaaatacttctcccaagccttccattttgacagtgagtcaactaaggcccagcaggagtccatggctggtatggccatatgataaatggcaggaagagaaaggtttgtgtagcttcatgaccaaagcagtcccagatctcagtagactgggtcaagaggctcaaacctcattctatccatgactttgcgcaagcatcacagatgttagtaagagaataaattcgaacagccctggtggtaggccctgcttccttatcatccctactgcgcccggagcacaggacgaacttgcgttacctcttctccttaatcagaagcttagagatgaactccttggcctcctccgagatgtcctgaaattcttcatcctctaagtcccacctgcaggccaggatgttgttcagcgtctcagcatcattgtcacccaggaaaggcgacaaaccgctaagtctggaggacacggggtccagagtgagtattttttaaacagcctcaacccctttccatacagattgcttttctggttgtgccatttaaaggtgagagaaggaaaataacctaatcctgaagcataattttataacatattattgtaatcaagaaaatgcttgccgcccccacccaactcctaactgaacaactgcagcaataacagaatatgaatatgaatatcagcttcctttttaaagcacttttcagcttgcaaagtgctactacatgctcagatggcaaacgctaggcatgtcacctctgaggggtgaggctagcctgagtcatttaggagatcagttttttttttttttttttgagacggagtctcgctgtgtcaccaggctggagtgcagtggcgtgatctcgtttcactgcaacctccacctcctggaagcaattctcctgcagcctcccgagtagctgggattacaggtgcatgccaccacgcacggctgatttttgtatttttagtagagatggggtttcaccatgttggccaggatggtctcaatctcttgacctcgtgatccgcccacctcagcctcccaaagtgctgggattacaggcttgagccaccgcgccaggccatgtgagctttttaaattaatttttggcttttaggttgtgtcctaggagttaaagtgattaatgaagaggacacacatttacttttccaaatgatgtgcagggaaagaattcactcctttcacccacaggagtcaacaaaacctagaaggcaactgaggatgggacagtgttatttattttttaaataccccaattggggcttttatttaaaacggcaaaacctcagaaaatatgcatggagttggagaagggtcagagacagaggagagctactcacagcatataggcgatgacccccacactccacatgtcagtgggaaatgaaacaaaatcatagttcacaacttcaggggcgagaaattctggggttccaaagttcaccttcagcttctctctgggtttgtatctgcaatttaagagacaaagtggaaggatggacgtgtcgatcaaaaatcgtgaacactgaaatgatgtagtctatgagacaaaatgacttcagccatacagcaaacttcagacaaacaaacattgaaggaaatcaaacaatcaagcaagaggctcaaaaacttgtaaagaggccccagaaaatttaaaagtcaaaattcatactaggaaaccttaaaagctgaaccagttgttggagaagctgctgtgaataatgagaacatctgaattacagaagatgacaagaggaaaactgatatagtcattgacatggggatgatgtgaataagcctgtaaaatgaataaacacagtactgcaataatttacaacatccattttatatgtgtcgttaatgtgctgaattgttaatgtgtccacgtaaactctttgttccctgaagaatcttttatgtgccagaaccctttgcaaacttgcttacgttgttaatatttttaaagtaaatcttctctgtacagatggatcaaatatgaaagaggggacaaactcttgcaaatgctaaattaatggcttctaatttaataaacttcactgtattaggttttaattttttatactttttactgcatgcattatagaaacttctaaacactcaagtctcaaatttagcaagttaaggccaaacataatttttgttaaattaattataaatgagatcatgaaaccaaagagcagatcagatatatgtttgcaaaggaagggcaaccatcatgtcccccagctccattcgtacacctatgtccaaatagacataccttctggccaatccaaaatcaataatttttatttgcttagcatcccgattcacacacaggatattctcaggctgccaggagaaagagacacattagcaatgaaaacaaccatcattcactcaaattgtccttgaaccacaactaaaaatacaacgatgctcagaaaaaacatatcaggcctttcacttcggggcgggcttgtccgtgtgggtactttctcctttaattatgtggtggatgaggttgcgggtatcctgccaaccctgcattatccagcctgtcctctgcacggcttcacagttcaccataatgcctgagttcaggcagaggccttgaggggagcaagaaaaggaggttgcttcagtccttcccaaatgtgctgtggaggcccgctcaggcctgacatctgcccctctaaattattcagtatgaatttccccttcttggagaaatatttttcccaagattgatgagttccaagggaattgacctgctccattcaaacagccacactgaacatgcactgtcacgtgaacgttccggcctccagagcttccctttgctcaacgcctatgggaaagtcgcacggcagaggagggcttttctctccagtcgttcttcagtctcagcagttccaaggttttgctgagtttggtctcaatgcctaaaacccctgactaagtgttcccttggagctaggccctggtaagaccttagcctgctgacctgacagtcttggggtgcagggggagaaaatggggtgtagtgcagccactcagtgttcacagaatgccttacaagtgcacctaatgtttactggggtagaaaaacagaggtcttgggaaagtaagagatttgatttaaagtcaaggccatttataaaagagaaaaaaagttttcagagttaagaaccctcagtcccaattctttacaagctggagggcaccatcccagaagccaaatgcccaggatcccgttcctcagcctttagtgggatcaggctcccctccccaacctgtccaggtggagaagaggttccaatgagatcagaaattcagaaacacattatgaaatgacataatgtctccttatcaatattcaatagtacatttggttgggcagaatatctttggaagcccttttctaaactatctctaaaacagatgtttgtgagtaaaagtcattatagagaagggggtgctacgtgaaccatttggtttcatgcttaaatcactgatggatcatgtataaagctgtccaattgtgaaggagtactgtggcatcaaaaagtttgcaggatatagagaaaccgttttgagggcatttcaataagttagcctttttatgacgataaaattaaacaatgttcattggataaattttgcaaaacagaaaaatataaaacagactgtttgtaagtcacctataatctccccccacatactgacaatcactcaatatttttggcccttttccttccaaggagctttcagaaaagcagctccttaaggacccatccagctgtcacctttatgatgatctctgcatccaagccataactaaaactgcccactgcaggtcctcaatcaatgttatgaagcctcatatggagtcatttgacttacaataggtttgctcctagttccagttgccaatcaaatccctgtagggatatctgcagaatatctacattcaatgaaaatgctccatgaaagcatgcattatcaaactcagttcatagtgagggttttgctaatgatttttagcctctgactttgtcattttataaaccacttcctcctgctctcctcctgctcaaaagtgaatgggaaaggcaaggcacataaatcaagacagtgagggaagccaagttataggaagagaggcccatggaaacctatttcaggaggctaaatttatttagctatgcaatccctagtgaatgcaatagatgggatgttatatagattgtatattttatgttactgtcacgctgtgcaaacagggaaatgagaaaatgaccaagccacacaagacgtactttatgatacttagtcccaatatgggacttgatcagggttgttgggcctaggtcttttattggttgtaactaagactacatacagtccgattctaggaacttcataatgagacatgagagaggtaaagagggaaggggcaatcaataggaggagaaagaaaggcggcttggcttctgtgtgctttccaccattggcagtggggtgcccaccccaccctctcttctccttagcactttggccccatccttccgactgtcctctgctgcattctccataggattctattccacagggcagcaaacccacagaaaaacaagtcccaaagtctggagcttcctgagtgactcgaggagctgccggcgattcttggagacctggaaaggttgactactacttagggaattctgagttagctaaaatcctctcacctacttgtcctgatgagagggctaccacgtggataccgctgtggtggtggtgactgttttcattctaaacttttagggaaaccattgccatatagatttccttaacgcaggcaagttacaagaatctgaatatcacccctgaagatggaacatgcaaatattagggagtgacagaagctgagaataaggagatgagggtaacaattcagatgtttattcatttctgaaatgactgtaccaatttccccagctggcatataatagcagacagggcccactgtgcaagagctgggaagggcttacgtctcacaggatacaaaacacccttaccttcaggtccaagtggagaatgtacatctgatgcatgtgccttatcccctcacatatctgcttcatgaacaggatggtatcaagctccgtcaaattgtagctctcatcgatgatgcggtcaaacagctccccaccatccacactgcagagggaagaggactgaaaccctcagtcccgatttccttaccaccatgtgcttttctcgtagtgacttgtcgtgcaagttctgctacctcttctgaaaggtgtatgtgcagttatttctctgccttctttactatcttacttagatgattcttatcttgaaggcctgtattttatatacctttaatctcacaaatggaaatcctcaagccaactccccacctttttgtgtgtgtgtgtgtgtgtgtgtgtgtgtgtgtgtgtgtgtgttttgagatggagtctcgctgtgtcgctcaggctagagggcagtggcaggatcttggctcactgcaatctccgcctcccagattcaagcgattctcatgcctcagtctcccaagtagctgggattagaggcatgcgccaccatgcccggctaatttttgtatttttagtagagatgggtttcactgtgttggccaggctggtttcgaactcctgaccccaagtgatccaccagcctcggcctcccaaagtgctgggattacaggtgggagccaccacaccggccctcaaagcccctttattcagtgtcttcagctctggggtgagcccacatgtatcatgttctaaagatgttgaagagaaagaggatcctaagaactccaggaggggaactccaagccctgactgaaggtagtcagggtctcagccctctaagtctccagactgaattcagggataaagtgcttctctgtggctggtgctagacacagtaatttcccttatccttggggacaccttccaagaccctccgtggatgcctgaaactgtggatagtactgaacctgtatatactatgttatttcctatagacatataactccgatacagtttaattcataaattaagcacagtaagggattaacaacaataactacgagtaaaatagaacaattataacaacacgccagctgcactactcttgtgtcttggggccattatgaagtcaaatgatagttccgtgaacacaagcatggcgatgcctccacagtcaatctgatgacccggtcggctactaagtgactaaccgcagggagtggtggagacgctggacaaagggatgattcacgtcctgggtgggaccgagcgggacggtgggagatttcatcaggctactcagaacagtgtgcaatttaaaacctgttgattgtttacttctggaattttccacttaatattttggggccttgggtaactgagaccatggaaagtgaaagtgtgggcaagggaggaccacgatactatactttttattcaaaatgccttattgaggaatgaaaaacaaaacggaatcacaatatcgattcagtgttggaattgcagtcggccctccctattcgtgggttctgtttccacaggttcaaacaatcgtaaatcaaaatgtttgaccaaaaaacaataaaaattgacaatacaacaacaaaaataatacaaatttttaaaaaatacagtataacaactgtatatgtggcatttacagtttatcaggtattgtaagtagtctagagattatttaaagtactcggggggataggcataagttatatgcaaaagactatgccattttatgtcaggaacttgagtgtcctccggttttggtatttgcagggatcctgggaccaatccctctccgataccaagtaatgactgtactcggtttctaactaaccagtccttatgtttttataaaggtgagtttaaatggaagcttcttagccctaatcatcaccagttgttgacatgacctttgtattagtgaatatgttgaaagtaagatgtagctcaaaaaccactttcctccaggttgccctggctaatatttaagcttgatttttgacaaacagcgtagatacaaagctagatctacttggtcccactacttcttagcaataaaatcccatatggagatttgtaaccccaagtgtttcccttctagaactgatgtgattgtgtgatccgcgcgaatcagagtctgcgggggcgagcttggttctggtcccgctacagcaggacggagctactgaggcacggtcacggtcatgagtgcccttggggaggtcagggagggggcggaggggatacgtactactccatgaccaggacaatgtcgttcttagactcgaaggcatcgtacagctggatgaggttcgcgtggtccagctggttcatgacgctgatctcgttcttcacctcctcctgagaagcaggaaacagtgcattagtgtggtcaagatggggcggggagggaggggaccacctcccacaggctgtaccttgtccttcatgcctctggtcttgatgattttggctgccagcttcagacctgtggccgtctcctcacacttgtgaacctggccgaaacgccctctgccaaaaagaggaagcggcgtagcatgaggccctgtggtcagctgccgagtggacagcgcacagtggccccagtatttctcctgctgagtctggatgagcagccctctgaggagttctttcagtaaacttctagagcagtatttgtcaacatgtggtgtgtggatcacttgcatcagaatcacctgggagctgttaagaaagcaggtctcggccgggcacggtggctcacacctgtaatcccagcactttgggaggccgaggcgggaggatcacgaggtcaggaccagtctggccaacatagtgaaaccccatctctgctaaaaatacaaatacaaaaaattagccagatgtgatggcatgtgtctgtagtcccagctactcgggaggctgaggcaggagaacggcgtgaacccaggaggcggaggttgcagtgggccgagatcgcgccattgcactccagcctgggcgacagtgcaagaatccatctcaaaaaaaaaaaaaaagaagaaagaaagaaagaaaaaaaaaaagaatccaggattctgggccctaccccagacctcctgaggcaggaatccaggggtaggccccagaatctgcatttcagcacatttcttgggtgattcatatgcaccctcacatttgagaaccacctttacagacaatgcagaatccttctgaatacatatgaatgttatgagctgggctttgccagcatatgaacaagagagcccaccttcagatatataaaattatttttggaaactgcatatgtaacaatactgcatatacatccatatagtcaagactgcatattgccaagtcacctatgagcttgaatataaacacaagacagcttcttacctacgtaatcacatacagatgtgcacacttgtgagcagttttaaatttaatttgcttagtttgatttcttatttagtaaaataagctagaacacgtgtccctgctctgcaatggtggatgtcacagtagggagtgaggaacagcttccctagcaacacagtgaacccgaggcaagccctatgacaaggcagaggacttcagcgatgaaagtcatggcaacgctgggcagatgcaggggcactggcggccgctgcatcctactgtggggctgcacacccagcacagaggcagatgaatcttggagaatgacacaggattaccataaacgtagccacggcgtgacttcaattccaacctctgctccagatagagtctctatgggaacacacggacacagccccagccacctcttaattggttgttatggaaatggtttctccccttcactagcaatggccgcagaacctcctgagccagcagtggtgcccatcactgtctgacttcccggctccctcaaccttctgactctttcccctgatttattgtgcaagggccctgaaggttgaggccaactcccaggattcatgctggttcaacacagtgataaccttatgctcattgaacatggcaagcagggatgatggataccctcaaggccacagggcaggagacgaactcccaggaaaattcaggggcctgcccctgtgggcagggtttttgggatccagtggtccttggcatgttgcaatatttctgccaaaagtaaaagataagttgctacatcttgaacctgctaccacttaaaaggaggtgcagcacttggtgatgtctgcattttgaaggcatccacgcacatttgatcatgctcctctcacttatttgctgagtgaattacggctgccaattttggtgaagcccataacgagagctgacgggcagctggtctagactgcagtaccaaagagaagatcccatggtgcccaaacagacagaaaggaagtttcaaaggagcaattgacaaaccttgaccagaaaaacagcacaaaccctgggaattctttcaaagcttcttctgcaaataactattctcggttagagaaatagttgctggcttgccactgatgtccctgaaggcccaaatacctcaggcttccatggagccagttcatgctgtggaattcctgtttctccctcagcccatccccgcagtctcatggggcattctatgagatcagccagatcaggaagggaaagtccaggtggttccattcggcacagggcaaagaaatacggagtgggaagaggaggaagggacttcacaaatatcaaggactccctgaagaccacttgcagacgcctgaactgcagtagcgatgcgtgctttccttgtgttggtgagtacattttgtatgtatacgtgcagatgttctgctttcctcttcctattttacacagacatgccgatggcagcaaacgttataatttagactttgagttacaagatatcacggggggttgtgaaagaagtaaacgaagaagaacaccctctccccacccccagcaggaagcgggtccctgatggactttaattttccttctggttttttttcttttctttttttttctttttttttgagacagagtcttactctgtcaccaggctggagtgtaggggcctgatctcggctcactgcagcctccaactccctggttcaagcgattctcctgcctcagcctcccgagtagctgggattacaggcatgcgccaccacgcccagctaatttttgtatttttaatagagacggggtttcaccatgttggccaggatggtctcgaactcctgacctcaagtgatctgcccgcctcagtttcccaaagtgctgggattacaggcgtgagccaccgcgcaaggcctttaatcttccttctttagggagaatgtgtgtttaaatgtccctaaaataagttatttgctgagcaaagtaatcaattgaaatgaataatagtaattaatatagtaacaacataaatgaaaaaccagcagcaatgacagaaagacctaatacaggccacaaaaactacacgctgttgactcatttctatcttctgtctcctggaggctgcactatggctttggacagctggtcaaccttctggtgactcacaatgggtttttctttcttttagacattacaacatgggaagtaaagcagataataaatgtggagtttagtcaccacattaacctttctggcatcagtgacaattttcagaaatggttactgtttcttaaaatgtttgtttctaatgtttctagttctcaggtcaagacaggcagacatttacgaagtcatttgcacgctctcttcttttgttgagagaatattaacattcagccttactcaccctcctaggatttctgtcttgctcacagtatagaagctgttgaccgctccttgcttggctgtcacaatacgatgatcaaatggggccggaggagccgggatgtcaactagaaggtgagagaaacagaagggcaatctgtcaagaagtctgacctcgttaaggcagcaagcctgggcctcatagtaaaaatgtgctcatttaataataaaatacaaggagccatctgtttgattcctaatgatccagggatatagatttccacttgagattatgagctgtgactcataaaggtgatcctgacacctctgagaaagagtgtcagggcggctcaatggttgtccataccatcttcaggatcacttttagaaatgtcaaaatagttgaaaatttccaacccaacacagtccaaacaggtaatacttccaagcctgagaccattcaaattcaaacatgagaaattgtttgattcatttttaaaatgcattactgatataatccattattttaattatatcagagacaaaaaagaaaaatgaaacatttcttcatgttgttgaaatgcttgatattatatattactttccaaaatgtcttagactttatttaagacacatttaaggcacaaagatgaatttttcctggctggctggaaataaaacacccaataaaaccaggtaagtgtgtattcaacagagatcaaatttctcccactttctccccttccaccttaagtgtttaaacgctcgtccacatcagcaccagctctaacatacagaattactcagggatattcctcccagtattctttcacctttccatgactactgctgttgaaattggcttgccatgaacctgctcattcttcgttaattcatttactaagcagcgactgcatgcatacaataagaatacaaagggaggtaagtaaataacagctttgctttcaaaacactctacatttatttgacatatgtttcttgagcatttaccttgttccaggcactctgccaagtgttaatatttttaaaaattcagataatataaatctctgggaatctgatttgatatggacatcacctctcagagcctaaatatgctgaaaactgaagtcaccagagaagcatcttgataacattcactgtttcagattaatagagggagttaaatacacaagcggcatcgaaatggcattatatctcctgcaggctgttagactaaatgaaatttagtctgtaatgcttgctggagaaggttaaaaagccttaaaaggcccatacaaaagccatttcctacccagtggggtcaggccgtcttgccctcgggaggtcttcatcccagcagactccctgagtcggccccgggagctcctcagcttgcctggctgcctgtgtcttctgacacgtgtgttcttcccctgtgccgactatgtctactctgcgccttttgctgtcctcgttgacgaggcgctcctctgccactccacgcttactgctgcccgggcactctgtctggtcagcattccagaaaatggatcctactgctgaacttccagggattcgtgggggtagaaatggcccttatgctgctgacacacctgggaagtaaagtccagttgcagctctcaaagtttcaagaagaaaacattcagatggtggaaattctttaagaaggttttcttaaaacagtgttttggtgacgaggacgtgagctccgtgatagaggtgaccatttcggggcttggggaggaaatggagcagcacgctccccatcaagtctatgggtgtagagaaccagggtcccagggaatctcaccactggccaaatcgtgaccccaagttattccactggaacttaacaaaagccgtcattttatgaatacctaactaatttgatcttcattttttcacttcctttccttagagagaaattattaaattatagcatgataaaagaagcaataatctctctgaatcttttttttttttttttttttttttgagaccgagtctcgctctgtcgcccaggctggagtgcagtggcgcgatctcggctcactgcaagctccgcctcccggattcaagcaattctctgcctcagcctcccgagtagctgggactacaggcgcccgccaccacgcccggctaatttttttgtatttttaaatagagacggggtttcaccgtgttagccaggatggtctccatctcctgacctcgtgatccaactgcctcagcctcctaaagtgctgggattacaggcgtgagccaccgcacccagccaatctctctgaatcttaacggcagtgagactaaacctttatcagtggaagaattgacctaatttccatttctcagcagctctcgaccttactgaacacatctggcagtgttgaagtttctttcttagcaatcattaatatttatgcttaattcttggaaaattaaatttctccaagatgaggtttcagatacattattaaaaaatgaactaagaattatgttttaaatccctaaaaaagaccacacaagtggtttgatacttttggttccaaatagatactgtgatatgtgattactcataacttagagtagttcattttaattggctataatattacctgaatctataagtgaaactgtgtagttgagaaagaaagtcattcaataatctatgtcttacttcatcctcacaatatttgggaaaataggcaatttattatttataatggagtaggtaagctttttcagatttaggtttttaacttacggataaatctagtcattatttaattcttgtccttaggaaggatatgttctgtattgctaaaaatgaaactgttttacttcatctttaaaaaatactgattcctgtgggcactattaatcatcatctttgtctaccagttggtagaaaacatagaaaataacaaaatgcctgaaaatatcacaggcaagaagaaaaaataatggctagaaaatgtggccatgaaaaattcatataagctggaaaaccaagttataaatcattgcttcaaactctcttcatttatcctttcaataaggccttaaaccgcaatggcacatagctctagagaaaacattgctgtggatacgcaatgctgtaaccctacctttcgtgaaattggtcaccattagtttgatacacgtattgatttttattttgacattggtccagcactgtctcatgtgcagttgccagttctcttttctcctcagcttcttatccactagtatcttccttagaatgaaacccgtttctctcttcttcaaacactgggtgttcatttttatctgcagtgtcttgctgttcattcccagcactatcactttcctgtgtattcaggctctctgtgcatgaaatgtctgttccatctatattctctcttggatttatagaatttcttggagcaaaatcttctactttgtcttgtctttttgtgtgaaatatggcaaaacttctatgaactagagaggcattggtcttctcagcatttttcttgttgagtttattaaccttttctttctcagaggagagctgattcttctgggtagatctctctagaagccaccataggacacaaaatattttaatggagaatgcaggtgatcagtataattttggctttctataatggcatctttatccaggtttctttttatcagcagatataagcttttaaaagctaagtagaaggaaatatgaccaattgggttccaaaagattttcttgtttgtaactagtaagacccaaacacaagcaaaaaaaaaaaaaggggggggggggcatttttttataaacatcacttcttcctgcacagggctttatgaatgtgcaacttcctctgaataacaacaggacttttataacggaactttcttcatccataactatctacttttctaaagatgttacctgcgagggctgatgtccttttgcttttgacgggcatcctttccgtcaggtcggcgtttgaccacacctccttcgcctgtggaggcacaattgagtaattgaagttacatatcacatctgggcttttcaacctcagcactcctgacacttgcgctggatgattccgtgtggtggggaatgtcacgagcattacaggacagcagcatcactggcctctatccaccagatgccagtagcaccctccctcccagttgtgatgaccaaaaaggtctccagagatctataaatggggagcaaaatcacccgtcaccccaggctgaaaactactatattatatgattcaaacatagaaaaaagcccagtaaaattaatagtaatgtagagggcagaacagtctgaattaatgaaagcctgtatagactacagtatctgaaatgagctcactattttcaaagaaattctgtaaaactgtcattatgggaaaaagcccatcttcatgaatagatgaaaggatgttaataatgtgtgcatcacccttgacctctgtgtaagttgtcttgatatggttgacatataaatcaaatagaaatgagaggatacatgtgaatgggctctgtaaaccagagagtaggagatgaaagtcagctttataaatggaacctttacagtgcttagaacagatggcccttttcctaagtggataaacattcttctcacagtcctggagtatctgaattagttgagcaaaccgttagctaatgtaccccatataaaagggaaacattagcccaatccacccaaattatcacaacttctaaagttttgcattataaattaatgacattgtgtggatgtccaaaaaaagtatttatttcccctttgaaacacaacataatctgccttcagctgatttgcaagcatgaaacaccatgtaagttcagagcacagatatcaagacaaattgcaaatgtgcttttttttttttttttttgagatggagtttcgctcttgttgcccaggctggagtgcaatggcgcaatctcagctcactgcaacctccaactcccgggttcaggcgattctcctgcctcagcctcctgagtagctgggactacaggcatgtaccaccatgcctggctaattttttgtattttcagtagagacggggttttgccacatttgccagactggtcttggactcctgacctcagttgatccgcctgccccggcctcccaaagtgctgggattacaggtgtgagccaacatgtccggctgcaaatgtgcttttacacaatgcagggggcagctccatggattcagagtatttccgttttttagatggtgaacttaaaacataaaggcatgtttagtaaatctgtggaaagccaaggctggaagtgagagcttcagagtttctctttaagtgaaagtccagagacggcacttgcctacttttccctctgcagggacaatgggctgccgcctcttcaaacaaagctgattgctccctcctctgtgcttgcacagaactcagcacatatccccacccctggtgtcccttataacactttaagccttttttcctgtcaatttcccactagactgtggacttccagtgggcaaaaagactggttcatctttgactccctggtgattacttcagagaccagtacgtagtgatgatgatgatgatgatggtagtggtcatggtggtggtggtggtggtggcggtggtggtggtggtggtagtagtgttggttgtggtggtagtcgtggtggtagtggtagtgctgctggtggtggtggtggtggtggtggtgatgattgtagtggtgatggcggttgtagtggtgatggtgacggtcatggtgatgatggtggtagtggtgacagctaccatgtattgtgcacacacattatgtaccactcttctaagcactttgtttaactggttgctcctgctaacagccctttaagatagatactattagccccatcgtacaaatgaagttgggtaatttcccaaggttataaagtttagaaatggtagagctaggattctgacccagctgtctacttcagccagtgcacctaactaccaccctatactgtctttctggggaaaaaaaaagatagaaagactatagccaagttacatgattcctatttattgagatctactacatagttggcaccacaggagataagaaaaatgattaagagagaaggtcataaatcaaaaacaaattagcagagtgaagagataaatatttgtcgaaagattacaattaacatggaagagaagcaaaaaaaggagagaatttaagtccaattttgaaagcatatatccaaattagtcgaataagacagtttaacaaattgtgtttaaggtgttttataactgtctttcagttcttcccttttgaaatgaaaacttctggtgtatcaatagacattgtgcttctgggtttattctgtgtggcatgaatgcaatgatataagcatacgtggatttaataatgaaaactggtatgtatcagtcaatttctactcataaaagtatataaaattgagcagctggctgtaagactccatggagcactgatagatccacgtttgcccctgaggccatctgagtatcaggtggaaaagtccacatgctaacccaatattctttgggttcggagttggacttgaccaacaggagaagctgtcagtattgaggaatataagaagccagcttccaagagaggttgcttttttctttagtaattatatatcacatatgtttttccatttaaataatgtaagaaggcctttattcattgccaaaggctgttatagtttcatttccctatgtaatactgacatctagaggaactttgaaccgaagagtttccaacaaacagaagttgtattctcctgtcctttccaggacagacgctgtatttctccttttcttttcaggactgcaaccaaaaatatgaaacatttttactttgtatttctaagttatgcctagaagttgctaaaatagaaagctcaagtttgtagatacaccttgtttattgtccaaaaatgaaacatgtcttctaccgattaaagagcacaggaccagtgctcttaagcattaagtttctgacccaatcctgaccatccccagttaatgggatgaaaaccatgtcagtgactatattcctctgctgaattcacatcgatggctgggatgaacctaaggacctctttcatgcaaattcacttaaaaatatttctatatttgcatatggatttctttggaactatttaccaattccttttataataatttatcagtggatgtagaatgacacagggaagaaaggctaagtggtccagatgtccaagtattcaaaacacagcttagctctctccactctgtctggcttcctagactggtctcgtaagtgggatatacgtacccagggagtgtccatagtagtcctttggagggtatcaaggacatgctagaactcatttcaatttattccattccttatggattgaatgtatcccccccgacgatatacgcacacaaattcatatattaaaatcctaaccctcatggtgatgctattaaaaggtagggccttcgaaggtgactaggtcatgattggagagtcctcatgaatgggattagtgcccttataagaaccaaaatgaaagtttgctcactctttatggggagaagcccactacacactagtaacggggccctcgccaggccctggatctgccagcagcctgatttgggacttctcagcccccagaactgtgagaaataaatgtttgttgtttaaaccacccagtccagaataatttgctatagcagcccaagctaagacaccattcttttaacatttatattttacatatgtttttaaaaatatattgatacaattggacacatataaaagtatctctgacatattaaatgttatttataaaaataaaagtgcagccaggcgcagtggctcacacctgtaatctcaacactttgggaggccgaggtgggcagatcatgtggtcaggagtttgagaccagcccggccaacatagtgaaactccatctctactaaaaatacaaaaattagctgggcctggtggtgcacacctgtagtcccagctatcaggaggctgaggcaagagaattgcttgaaccctggaggcggaggttgccgtgagtcaagattacgccactgcactccagccttggcaacagagagagactccgtctcaaaaataaaataaaatgaaataaaataaaataaaatgcatgtagtggttatcaatgtatataattataaataaatatatcgcggagtgctttaaaatattttactgatggcagcacaaaatcaaaataatttggagacaattgtagataacaccgtgcttcacactctgattttctgaagtgtgttttggagcaggatcattctaattagtcggtttgagtgcaagaacataattagaactatcagctcaattcttgcaaactctttttctccttctgcaaagtactgcttttaagagttcagtattcatcgcttgcgtgccagttttgattatttaagcaatttcaagtcagcactttatcctcttttctccgttaaccattacatttactgccataggatccagatttgaacagcagggcggcatcggtccacaggcgtgtgccggctacctgggcatgagtgcgctctcgccctgcgtcacagacctgtcccagtactacatcaaaaccctacttttcctgagagtggcggaatagctgaaagggaaattcattcaactgaacaacatcgtctaatccttctttcattcccattcaataaaaatcatttaaaaaatcaatggtaaaacggatttgtccttgaaagaacataaaggctgagataagggctgctcctctggacctcaacaatgccaccatcgttttccgtgttactgcagcgttctcaatgtgtctgtctgcccgctggcatacggacccttctcttccccttcgtttccccagcaccgaacagagggtaaagttctgaagtgcttggtgaagcaatgcgtgatgaagaaaacagtgctttctggaatggcacgttcactgtgagaacactctgtcatcaggctgcacccctgaaaagccaggctgccctgggggccatctcagatgcatccctgccacggtggctcatatccacagccctgaatttacatagccgatggccagcaatatcaacggccatgcattttgggattacagttgctgcagaaaattgtgttcataacataacatatagagaattcctggttctttttaaaactgttgcaaacaggccagatagaagaatggaggagaacaaatatttgtaataatttgtagctgtgacccacagcctggactctgatggtggcaggtagatgttagaggtcggccaccctgtcctacagctctgtcctctactgccaggctcaagtgttggtcttttcaaacctcctcagctctgaacgtatcacccacatggcctttctacaacaagggggttatcaggataagaaaactcggaagtgtatttaaattctaaaagttcagtgtgaaaaaggaatagcctaatggaataaatctgaccagtcctgggctccgcagagtcttttcttgctagcagaggacgctgggtcatgtaccctgaataacagttttgcatattactgtttgtggaaatgccaagatgaacaatttttggccattttacctaagttctagaaatatctaaacaaaagtataacaatttataatgactttattaaacttggattagattcctaatgggggagagaacaataaataaatcctacaagaatacaaagagatgaattttcagaagaaatatgaaaacattttcttgcctgagcatagaagatacttctagagattgtttgtaaagcaaatctatttcccttcaacctcagcacacactcaaactctccatgtatgaagcgagaaaaccctgaagtcctgggtgataaaaggaattctcactaagcaaagcctgtttcatggtctgtggggactggcatggctcaaggcaggacagaaactgactgaccaaatccagaaagggaaagtgttcacctgttctcagaactcagtaagtggatcctccccaggctgctgatgacatcaggtggagtcagtcacctgagaaaataaccccgccaggaaaattaaagcctttccatgcacccacaattatgtgcacagtgcttcactcggaagccaagtaaatgggaccctccaagtacatagaccaagaaagagcctgaagttaaaggtgtggatttaggaaagcctaactggatcatccactgaatgaagatgcacggataattttactttattttattataatatacattgagctgtatcataagagaaagcatgctaccacttttcttttcttttcttttttttttttttttttttttgatatggagtctctctctgtcgcccaggctggagtgcagtggcgcaatctcggttccctgcaacctccatctcccgagttcaagcaattctctgcctcagcttctccagtagctgggattacaggtgccccctaccacacctggctaatttttttttttttgtatttttagtagagacagggtttcaccatcttggccaggctggtcttgaactcctgacctcgtgatccacctgcctcggcctcccaaagtgctgggattacagctgtcagccaccatgcccagctgctaccatatttaacagcctctgctagcaagaaaagaccgtgtggagcccaggatggtcaaatttactccatcaggctattccttattgacatcaaaactttttataaatatacttccaagttttcttatcctgataactcccttgttgtagaaagggttatatgttcggagctgaggaggtttgaaaagatcagcgcttgagcctggtggtagaggacagaactgtaagatggggtggccaacccctaacatctactggccaccatgggggtccaggctgtgggtcacagctacaaattattacaaatattctctctcctccattcttctatccagcctgtctgtgtaaattttaaaaacaaccacttaaaatgaacaaattaagaatcttcacctacctatgtggccacagtgagtagttcgataacacagattttattttcccccatcttatacccattggatgtgctgacaccttataatgagtctgatattgttattttcttcccactgccaccttacctgtcctccccacagagaaaacgctgagtcctctgacttgaggccgctctttctttccctctcaaactcgcattgctcaccctgccgccccaccaccccacctgtttttgttatccaaactgttctaagttctaatatgtggctctcaaccatctggggatgttggacactattaatgcctgggtcctcccctgaagattctgataaactgggtcttgagtggggccagaacaccagtgttttttaacccacccacaccccagggattgtaaagtactaaaagggaggggacccacttcctctgtcgcctccggtcactctggcctttgttctgaggccttcttaccagccaggctccctctggtcacagattggagcaattataacaacactggaatccctcttcctccccccgataagcaaggtctttgatcctatccaggatggactatctagcaaaccactgcctcctccttatcctccacccagggatacgtgtgtggaaatgaggccaaggtaaacggccctgagacccataaaacctccctccaaaaatgatctatggggcatcctgggagggcaacaaataaaaaatccaacgttgccaaccatgcctctggtcctctgcctgaaagctttctgccttgcttcttggccaaaatttagtaattgaaagtgatttaattcctccattaaaatggaggtaagcagaagagaggaggactcaggctgaggtggagaaatatcacctttcagggcatagaagtatttatagcactttgcgtaaaagtatatctaaaaactatacatcaagggatgctttgccttcttgggattccgtcaccagaatagcacctgagcacttcaaaaactgtgcagtgaggctactaagaaattgagagcgtgagtgcatgtgtgtgtcaaccgacttcaaatggaatcacagctcctcatgttcatttcattaaaatgagtcttactttgtaaaatttccctttcataacgcaagtccaaaccttggaatgttttcgcatgaagtttacagtgtttcttcatcacccaataaaactctttgatttcttcccgccgcagacagttttaagagccttcatttcacatggggttctcggtatgctttttaatttttattttaagatcattttttatcacttcatctcctgtctcccactctgagcctaagttcagttcggcctccccgagccccactgcctccctgcagtggggcacgccggccgaggctcagaggggcttggtgtttcctaatgtgaggcgaggtgtggtcccctggactgcaggaatatttagagatctgcgcttagactcaaggagtaaaatgcttaacctcctaatggtttacctttctgcatcttcccctacacaggaaacacacactgcaaagcaaagtgacttttgaaaagctacctctgaaaagcaaagagatactacaaagctcttcaaaaatgtctctgaatgaatgaatttgtctgtaatacaaactgcgtaggtaaaaaactaatcagttatgactgtccccaacatttagtcgcctggtccagtctatgcaaagtgggctggtgaatccgcagcagcagcatctcctgggaacctgctagcaatgcagaacctcagaacctcagcctctccccaccacccacccaatcaaaatctgctctttaaccaatggccaggtggttcccatacatgttagaatttcagaagcgttgacctagttaatatacgtcatgaattggtgcgaagaatcattttacaaaatatgtgtcccagcctcgtgtgtctatttacatcttgcctccatccacaaggcgtctgaagagctaatctcgtacttgggtaaactcagagggaagccagtgaggagcggggagggagtcgagacagcattcactgggggccgcatgccgctggccttgctggcagcagttggtggagacccagcactgtgtggaacatccgtgagctgctcaggaggcccaggactcccgctggagctcagggaagagcatgcataactaggtatcatgtgcctggaactttccactaatctctggggttgacagattgcccaaactcaggcctcagagaagagcaacattaaggcccaaagacaggatgaaaaccaaggcaaaccaagctctggagaattaggaatgtattctgatgggccccaaaatgcaaattaggcagtcaggattaatgcaaagaatacagttagaattaatacaagtgctgtaacctggctacaataaaggtgactatcaacttgaaagaaaataaaagtattgtgtctagcatagttcttacaaatcaaaatttagaggttgaagggtggggtggggaaggaaggcggaaagatgagctgttgattaaagggtacaaagtctcagactggagggataagttttagtgaactattgcacggcttggtgaccacagttgttaataacatactgtacatatttaaaaattgctaaaggaatagatttttaacatcctcaccacaaaacagtgttaagttggggaggtggtagatgtgtgaattagcttgattgaccctttctacaatgtatacatagatcaaaacttcacaccgtgccccaggaatatacacaactgttatttgtcaattagaaataaattaattaaaaatgttaagtacacagctagtacataccctccaacacccccgatcggtctgtgttttactcctaagatatgcttaagccctcaatatatgaagaacatgaacaccaagctgaactcttcgggttcttgtctcattgtcctttgtttgattgtggacgtgggggaaatattcagctggtatgctggtaccatcctagttattaaaacatggaaatacctccatgctggctggtaaataggggattttctgagactcccaggagctcctccaacctcccgacctcgcctcctctcagcctcaggaccatcctaagaccagtaactatagggtcaatatctagcatggagggggcccccaggaccctggtccaatgcagtacaccttgatacgtgagcaactgtggactcccagttattagtgtacagaccagggaaaaagagtatcatatgaaggcatgtggccacaacaacaggctgttggccatgtaatatttaatatttaaataagaagtttttaaaaatatttacgctatccctgcaagttcattattaggtacggaatcaaagtgtgctttgaaagtcaaggagagagcaatggacaacagtgaagagaggtaaaagagttactaccagcaatgcctttacctaccttaggccctgggacggtggccctgaaattattaaagttccttccccagaaattcttaatctatgggtctgggttgaagcccaaggacatttttcatgagctctgggagtgattctgatgcacatggtccagtgaccctactttgagaaaacaggtagaactcctacccattattcaagacccaattcaggaaggtttccctttgtgaattcttttttttttttttttttttttttgagacggagtcttgctgtgtcgccaggctggagtgcagtagcacgatttcggctcactgcaaactccgcctccggggttcaagcgattctcctgcctcagcctcccaagtagctgggactataggcgtgtgccaccacgcccacctaatttttgtatttttagtagcgatggggtttcaccatgctggccaggatggtctccatctcttgacctcgtgatctgcctgcctcggcctcccaaagtgctgggattacaggcgaattctttcttaaacactcccctcccatatgttctacctaaagaggagtccaccttctctctgcctctgttggccacacatcttcgtggatttatcacactgtgttgaatgatttgtttgcatttctgactccctcaaggcatctcagtatctctagaatctaactcagtgtcagctcatgacaaacactgattgattgactgatttgttgattagaaggtcgggttgggggaactgatgccaggctgtatttactgatcatctcaaccacctgtatgaagatttttgtcaagggctgccattacatgccctttattacatcctcctcagcatcacactttgatgtccagctcccagactcctgtggtacctacaagtcccacgtccatgcagcgcaatctgttgtcctggacctctggaagaaaagctaagtcttctcagacctttgtagaaattcaaatgtttgtgtcaccagcagcatctgaaactctatcctcagtatggtttttgaagtaatttaccatttgatcaccttctcaaatttcttagacctactaaaaatcagaacatgtactataaacattcatttgcttagtgtatatatttaagatctattattcatatttctgcattggccgtaacttctttagcatgctttaacatgtttgcccagagagatacttcatgaatacttttgatcatgggaaatgaggttagagttagggattgttgctgccacattttactttattatgattatggaaactaatttttccagaaggcaagagcagggagtagctctttcctttgaaatgtctggttaaatttctttgcacatctcctagcccaacatcaaatcaagtgctaaataatgtctttgcattttactattaaagtcctttacaatatatttctaatggcaactaagtagccagtccaattatacatcatatccatcactctaatgtcccctcagctttaaagttctaggatgtcacaggagctagaagaaagcttagcacagcgaaggagcatcctcagaaactttatatggttgcaagacaccgattctcgggtgcttttccaaatatctccacccttggaatctgtcttctgttgtgattatgatttagtggtaaccagattgctaagcaaaaatgtctttataacagatcgcagaagaaagcaagatgcttgtttgggtggctgtgtgcttcttattgatttatttagtgtttttagttcttccccatttctcagcaggtgaggccttcacttgggttcagttcttaggttctcctcactgcattaggaactgtcaacatggaaatcgttctactgaggactttctcaacaaagtttcccattcccctttctacaaagggaagggagggtgatgggagtagtctcaaggttcttctcaagtttcttctcaagcattgcttggaggtagtaatgagtgaagcgggatgggggtatacagagtctgagtttgtaacacatgcccctccaggtccttttcaaattcctggtcccagtcatccatggcaatgagcctgtgttccctgtttaagcagggagcttgatttgctgattcaaataagaataacaatctcttattctccaaggcaggaaattgctgttttggtgaatgaaaccaaaacaaatccaaaaagcagcactttttgttgttgtgtaaatcagccatttattttccatgttggctgaaggcagaacaagaagaaatctgaaaaaacaacttagatttaacatcacatttaaattttatattacaaagaaattacgggaatggaaggagtttgcctcccagtccattgggttagaaaggtaactgttttgtattcccaaccatacaatttaccacaaaagaacatagtattttagaagctcaaaataagacaaagaaagggaaaatttctcaaattatgtaatccatttgaattcgggggaaaaaaaaaaaaaaccttaaagagcattgtagcccaatcagctcaacttgaaatgagattctacccaatttcacctagttacaggaaattttaataatgtttaaaatgtttttgccaaaagggatgaccgtcgataacactgaataatattgatgatcttttcccacactttcatctttaaaaatgtcataggacattgcaatatatgatcttttctctcattaaacatccagccatcacaatgcatttttcaaagacacacagctctgaatattctatctgttattgtatactgttttctgtgatgtttagaagagtaggcaactatagattaatttgtgttaggtatttgtataagcataagaattaatttatgttttggtatcaggtcgctatagtgagaagcacgttattcgtcactctaaagtgactttttttttttccagaaaaaaaaccccacaaaagaacaaaaggacatttttggaggtgatggataagtttagtaacttgatggtggtgatggtatcacaggtgtatgcatttgtccaaactcatcaaaacgtgtatattaaatacgtgtaattttttgtatataaatttatacctcagtgaagctttttttaatatagatataataatggacaagattatgaaaactgtattagcacctgtggtatcgaaagagaaactttagctttggactacacagcgtgtgggagccaggaggggctggcttacttccttgattggcagagggccccacttgaaattcttcgaggaggagagaggtacagtatcacccagggcgtgcatttccataggaagccacagcaatgcagactggctcttcctccttcacggagaacatgctaaactacactcagagcagtaataagtaaatcaatgcctacgacgaggtgacagctggcctctgcagcagaaacacatgatcacagatggaaagctcaattatgggtattccaagaacagaattaaagtctgttttcagttagaagccccatataaaatggggctccatctgtatttactacatgcagctgcgtctttctcaaagtgcttaatgaactttttcttctttgtgaacgtccacttgcacataaaggtagcaacctgaagtaaatatcacaggaacatacctgcacaaagcaacacgggacagtatacgtttttcttcctctgttaactgagagacattacatactccatactcaggtcctaagctatttcaaccaactgcagaaaatagatctaaactgtgaaataaaaaaaactgctttaagaatagtaactttttccaactattatggccatatctcattattttcatgtattaaaatttagtccacagtataaatatacttgaatttcacatttaatgagatcagttcaatttggcatttaacaatcactgtaaaatttttcattttgatttaattcagttatacagcaatatattttcaaaccgatctcattattggtggcgcacatttacacgcacacacaacttactacagcaacatcagtcaaatcgcaacatgaaaagttcgcatgctattactttgctgttgttcattttctattcacccccacaaaattaatcatactggcatgaacttctcctaatagagaagtagtgttatttaaaataagtaagttcagttcccaggtagatgctataaaaagtgttaagcacattttatgaattcgactttcagttagtatcacccccaaatttttctccactaaaagttgtgacaataaatgtcaaagtcaaatgtgttttttcttttgaattttaaagaaaacgaaccaaataaggattacaacacctaagaaaatctgcattctataaaattgagacttcagatgcaaaaaaaatcaacaaatcaaaatcctaaaatctactttttttcaagtgattaagtaactaagactagtttgttataaaatatggatatgtatttttagtgaaatagcataccattcataagcatcatatttttattaaaatattgctcccatcaatactcatttaaccatattcacattcacagagtgtatataatcttttcccctggatgatttaatatctttattaaaactcaaaaatagaaattttgatggtattaatctcaaccttatatggaaacacactttctcaaaacaatgttttattttaataattaataatgttaaagtcagtttcattactaagttcaagtaataatcaaagaacaccaactccaaaataaaagttgggaaagttgacactgaatctacaaacatattcatactcagaaataaaaatgtgtgcttctgagtactattccctgatgaaaacctcagttttaaaaatttgcctttgagcattacattttgttacattctcctctactgggtttgggaatgatttttcagagaataccaaagtgctgatctttgttcatcaaagttcatcttcacagatttgccatacaatgtaaccttcatcatcattttggctatgggagaaaaaaaaatcgtggctcacctttccatttcctctgctaacaaagtagagaaattatccaatctcaaaaaactatatttactttgacttaaactgttagtctcaggcagccccaaagtaaatcggctattctagtatgcttagggattctggcagctctcaactctcacaaaggttgttgttttggttacacccaggactatatgttctagtctacttaatcttttggcctatcactttgtactctgactcataactaaaagtcctagttcccatgaagaaacatcgtttcttcaaggcagaagtcaacattataggaaagcctgggttcatcttctgccttttgcgtctccgtatattctctcatagccttgaacacagtatctgatttctttctaaataagctactatttttaaaatttgaaaaagtttaacctcccttctcaagccatgtacctataaaatttcagattgtccccattcttttagaagatattttgccttcttcagcatgataataacagaatgatcatggttgctatggcctttatcctgttagtggtactcatcatttatgtttaatcagaacaactcactgctatttgacatttcttcccactttggccatcataaccctctatcggtcatctcatctactgtctactagtcatctatgaacagtgaactgagattttttcctcttggaaaactcatgagccctttctattcaactctgcaccaatcattccaaaattcggtctttatttctatcacacaacgatgagcagatcttaacatctggtcatgctgtaaggatctcaaactttacatatcaaaaagaaaacatcattttacatcaacatcttaacactccatattagcttgccttcccgttgtttcagtttctgtcagtggtgccatgagacttgcgtcttacttgtggatctgcccgtgaggcatggtgtcccactcaaagccagacacagacagatctgtgccttgcaccttcccactgggcatagctcacaaaggaggttcaccaccttagaattcagggccacagcaagccccaggactgaggttcatgaatggcaccaggaattcaacaaacaagcaagtacagcacatggcaacccagagaaacgctgtttgcaattccatttgaactagtgttctgcatgtttttctttggcaacctatgtgattccaacattcagtcacagattgaattgagttgagaacaattgccctagggttagcttgctaatgtacgatctctctaatttgtaaagcttgtgctaaatggaaagtgaattctgtagccccagccaagatttccctttcaggtttggttaatgatggtttaattcaccaaactttaagagtaggtgttgggaggtgctaggatttgacagcagagaaataaacccaaaatactgtctctgtccccaagaaactaacagtcaggagctgaaataaaataaaatcttccatacttgaatatatattttattaaaacaagaaatcatttctttaaaatataaaaatatttaagtagtaattggctatgttgacatttctacttatgagagatgtccatttggaataaaacataaataaaacccttttacatggaggcatcaaaaatatattcttaaaaattaatagcttttaagtactaatataaaccttctctcacttgtaagttttctgacattgaatgctgcttccggttttcaatgatgcctcactcctgcaggctgcgttgaataaacatagaaattgatcccccaacattggtattaaagctctcaagccatgtggttccttaggagattgaaataggcccagttgtcccacagaactgatgttcatagtgtcttattagaaatttacagcccccactccctccccaagtcttaaaacttaaaaaagttacatttttcttctctgagttcctttctcaggaaaccaaccatcaggtctcccagacagtatcaaagaactaaaactcaccaggtcaccacatctggacaatgaaatgccagactccttatccatcatgattgcttaaacaactacctcctttctgttgaccagctctgcttccttacccctccctaattcctgttttacatttcttcactgctataaaaacccctaatttcagctggttgaggagatggatttgaaacagatctcccatctccttggctgcagcacccaaataaagccttcttccctggcaagactcaaaatctcagtgacaggctttctgtgctgcaagaaacaagacctagaccaaacccctggtgttccagcaataaaattagacacatggctttcagtgttctttaaagttggtgtttaaaagcctgaacaggatgaagggctgtgtcatagcacagactgtcttacagtagcttatactatcaccaataatttgttatcagcaatgtccgaggtaataaaatttgccagcctttcttttttcaaatcagtggtttcaagtttattccttataataacatttcttgcactcacttgtctccaggagtgttttcctgagtgggagacacaggggaggaactgtggccattctgctggcttacgcataaccacacacagctgtgtacatgagaccagggtgggaacatcctcctccgtgtgtgccacaacagaaaatggcaagaactgctgctcaggttcatatcagtccattaattaacacgtatcagtgccacagtttcacccagctgttgttatccagtttccatgcctctgaatttcccacaaggacatggtaagaaactcaattgcagaaattaatctaatcatggtattaccatcaacaactagtttagtaaccatggagaaaaggaagtaagatgactttagcatgatattttcttaatgaactcaagttacaaattattgttagtgttctggatgtgttagcatcctcctaccttcacactcaggtggttccatgttctaaatattcttagattccaattacttcagaatctcctcattaaatgttcttgcctatggctcaataaagataaaatgaaatggggggaagatgctccttgtattttcaaactttgcactactatgacataggaggacaattttctgtttatcctgcatgagctttgctatggggtgtcagctctatggaaggaccacgacctcacagcaacacactttaatggggcagcacttattcgataagctaagaagtgcaaagatgttttggaaaggcatctgagacacacatttagtatgtgacattatccatgaactgaaaacaacttttaacaatgctaaagttgggtatcttttttttttaaaggcaaattttaaggtatataactttaaagtaggctctaagcatttcatccaaaaaagcaacatacaaatgataaatgtttttcaaaataactaaagctctttcctccaaccatgatatccttgacaaaaggtgcttctgtaaagatgtaaatcatgaaaatacaagttatacattatgcaggtaaatatgtatcaggatatattcagagctggccatttgaagtagatttttctcatcttttgttttaaagcagaagacggactgctgttaactggtctattcaaaaaaagcaccaccatgtttccactaatgctcactgtaatctaaagtcctcaagcacggatgccactctcccttaacatcagcttcatcatgttccggggctcatgttcagcagaggccacctgagatgataaatgacctttgtggagagaagctataaatctaagctggctcccttttgtccatcaacggcagtcaccagctgtgttcagtagcactcacgtactctctctgacatgcaggtcctggctagcaaattccagaagataggccacatatgggtaggcttgcccagacccatgtgtctacttcaggccctttaaactcaagtagagagccaacaggcattcaaagtacatcgccagtgatgtaaaaggtcatctctgacttgcactaaacagaacaatggtgacaatgaaaacccagcaaattcactagtctatgacattcatgttttgagaaacagatttagtgatcacaaaagtcataagcaatagcttctaaacttaagctaagcagaatcaaacaaacagaacctccaacgattttgaggtacactaagtgggacccactgaggttcagaaggcccaaatgagacgtgcctctcttcacagagccagacggctgcatcgggctttcacacatcaagacttcatggagaaaaaactggacacaagctactctctgcccccactcaacagagtaccttgcttcaaaccctgaaaagtcctgaagaaagcaggccatttaaatccacaaaatgttaactcctggatgggatcctctctctcaaaaccaaggactgatctacagccaggatgctgggttctcatcccatttctgctaaccagacatgtgcccttgaggaaggcatttaacatctcaaagactatgcttctctgtcaaatgggcacagtttccattggatccaaagattattgtgaggccaagatacagtgacacatgtgaaagcgcttttggaaaaagaaaagcaacatagtcccggcatggtggctcatgcctacaatcccagaactttgggaggctgaggtgggtggatcccctgaggtcgggagttcgagaccagcttgaccaacacggagaaaccccatatctactaaaaacacaaaattagccaggcatggtggtgcatgcctgtaataccagctacctgggaggctgaggcaggagaatcgcttgaacccaggaggcagagattgccgtgagccaagatcgatcgcatcattggactccagcctgggcaacaagagtgaaactccgtctcaaaaaaaaaaaaagaaaaaaagaaaagaaaagcaacataaatactaacttgatttagtctttccttcagcaagcattttcaagttctgcacaaatggagcagtgcacagaatcctttctccatggccaaaagagaaggttctgtgtgtgtctcagtgtggagtctttgccactgcttggtgaaataggagtcgcatccatgcatggccctgatacttggaacaacgctctccctttacgtaacaggaggcacaaagctgccctggtattacgttaaagagaactcactccccatcccatgagtcagggcaggatttaactgttagcaatgccctggggaggtcattgaggaccagcagggccaggtggtacagccagtaccttttaaaggttgtatcccatatttaggcctacgcataggctggcaaagctgccctgagctcccattcagtagagaaaccggcttggtaaaaattcctcttcaaaacacaaataaatcatggccactcccactcaaacccaggatgaagaatgatttttcttgggtgaaaaataatacaagcccaaaccacaatgagataacaccttatacccattaggatgtctactgacaaagaaaatagcaagcgttggcaaggatgtggaaaaatgggaaccctagtgcacggttgtttggaatgtaaaatagtgcagctgctacagcaagcagtgtggaagttcctcaagagactgaacatggaattgaggtaggagaccagcaggacttgtttccaggacccggtcagaggaagtgaagaaaccagccaaaaccagcagatggcaaccaaaggaatccccagctggccccattgctcattagcataacacatctcaccagcccatgactccatgacagttcacaaatgcaatggcaacgtcccagaagttacccccgcttcttagaaagttctaagtaaactgcccctcaatttgcattaactcaccccttaatttgcatgtaattgaaagtgggtttgaatgagtgtaaatacagttgccaataccccacacattgcactctggatgcactgcctatgagtcagccctgctctgcaaagagcagtaccatttgattaaagattgctgactaacgtcactggctcatccttgaattctttcctgggcatagccccaatttgggggctcgcctgtcctgcatcagaattatcatatgacccagcaattccacttctgagtatagatccatgagaactgaaagcaaggatctcaagagctatttgtacacgtgtgttcatagcagcttactcacaatagccaaatggtggaaacaaaccaagtgtccgctgacagctgaatggataaacaagatgtggtatatacacacaatagaatatgattcagccttaaaaagaaaggaaattctgatccctgctacaacatggatgaaccttgaagactttatgctcagtgaaataagccagacacaaaaagataaatactgtgtcattccatttacagtagtcaaattcatagagacagaaagtagaacagtggttgccaggggctggggtcagggaatgggaagttggtctttaatgggtacagagttggctgggcgtggtggctcactcctataatcccagcactctgggaggccacggtgggcagatcacccgaggtcaggagttctagaccagcctgaccaacatggagaaaccccgtctctactaaaaatacaaaattggccaggtgtggtggcaggcgcctgtgatcccagctactcaggaagctgaggagaatcacttgaacctgggaggcggaggttgcggtaagctgagatcctgccattgtactctggcctgggcaacaagagcaagactccgtttcaaaaaaaaaaaaaatgggtacagagttgcagttttgtaggaagaaaagagttctggagatggatggtgctgacgggctgcacgacaatgtgaatgtacttagcatcattgaattggacacttaatggttaaaacggtattttatgttatgtgtcttttactacaatttttttaagtcataaaagccaatttcatctatgttgctgtttggaacctttctgagaagaaaattggctgatccaaacaatgttgggcagagaaaagcgtggtgttaacattacctgttgtatgagcaggaggtttttccctcctacctgagtacaggggacttgttggatctaggggaaaggagcatctccctacaagacatctaaatcaaagttgacttccaagaattagctagtcctgcttcacgtgtctggcttacaggtgagggtcaaaaccgctagcaaacatgcttgtctcaggttcatgaatgcagaaattcttgctgtctccccatttctgagagaggggcctatttgtagcatatggaatatgaaagggttttccctgccagaggagatgaaatgtttgcatagtcaaataactcagaacacgtgtgaaactccaggcccttggaaagtccaagatttatgggacctgttccgtgctgaccaggattccacggttcctcgtgcactgccaccacccaggctaccacgactgttgccccagggattccagaacctttgcactctggtcaaagctctctgctgcctattttttttttaaactctagtaaatgtttctttgtaaatacagagtaacagaaaatacaggaagaatcctttaatgagtctgaacattgtggacaagcacattggttaagacagataattatctctctttcctaatttctttccctcatcaccaaaggatttgaggttactaccatgtggtcaggacaactatttttatggacacaaaatcaaaggattttcaagtatcatagttaaccaaaacatcataaatcaccccttcatagggttttcactttgtcagaagttgaaaattatctttatacctgtatgtagtagctaggagcagaatgtgtttaagtgtgatcctgtttgggtaaatcctttaaggaaaatacatatatgctggtgtgtgcattaaaacatctcaaagaaatcacaagaagctattgactgtgtttgttatgcagatagaaacttaaatcgggggcatcgagtattctatttcagttattttctgtagtttgaatttgttaccacatgctagtatgtggtattcattcattcattcaagataagacctggctatgctcagaggagtaagacagagccctggcagaaaactccttacaacctagtaggggaaactgatccacacattatcagttaccatgtgtgtactgtaattggtcaagaacctaggttcaaatcctgacttggccatttcttagccatgtgatcttggacaagctatacctttctgtacctcaattttcacctgtaaaatgaggatagtagttcctatctgacagagtttttatgaatataaaatgaatgaaaatatgtaaagcagttaggatgtgcttggaacatagtgagctctcaataatgcctgatgttactatagtaaagataagagacaggcattacaccaatagaagaaggatttcttcagtctgggccctggggtatcaaggctctaaagtggagatgctgcttgagctaggccttaatggagaagtggtgttctgccaggtaagaggagggaaagggcattccaagagaaggggacagtatgagcagaaacaggttggtatgactgcctggttagcagccactgcaggcaaggtgaactcctgaactttccttccaggaacgtcttgaggaaatgagaaagaaagagcagctttgttcgttttgaaagtccagtacgtaatttgtgtaaagtctgacccttcctatgccatttcagactcacttgttaaatttcctttttacggtcttcttggtagaagttcacacctgatcaaacatctgtaaatgagctagtataaaaaatgaaaatctgaaatataaagcaggtccctaagcagacctccagagcagacatgcagaatgcagcaggcctcacacctctcgaaatccaattgacacctgcttctggggccagggaacgtacaatatggctgttgggcgttgggagatccagttcagcaccccctaagtggggctggtcctgaaggtcacatttccctggctctcccgagatttgggattagactgtaatcttgggcttctcaacctaaggtcacactgaataaacacctatatgtttgagatagtgcactaagacgccctcatccaatcctcagcagaagcttgtgggtagacattattttttcccttttataggagaaaaactgggcctctgagaagtccagaaatttgcctgagttcctgataatagttcaggatttagatccatgtcttctgactccacattcagtgctcttttcactgctacatgctgtctcctctgagaagtgctttaaactcagcattccaggatgtcggcttcatagaatcattgtgtgagagatataagaaatcctagacatcggccgggtgcagtggctcatgcctgtaatcccagcactttgggcggccgaggcaggcggatcacctgaggttgggagttcgagatcagcctgaccaacatggagaaaccccgtctctaccaaaaatacaaaattagctgggagtggtggcgcatgcctgtaattccagctactacggaggctgaggcaggagaatcatttgaacctgggaggtggagattgcagtgagccgagatcacaccattgcactccagtctggtcaacagagtgaaactctgtctcaaaaaaaaaaaaaaaaaaaaaagaaaaagagaaagaaaagaaaatcctagacatctagtgctgcggtctccaaacctacaccaagaatccccaccatgctcatgattccagatgtacttccaacattgtctacagactgagtgagtcatagattgctagtagcctagccaatatccttctcccttcttctattctaacagatacctggataatgtgctctccaaaaaaactacatcctttagcctcttttgaagaaggggtagccattggtaaataagcataaaaattataaaaacctttcaaggaaaactctttgcccttccatcatccttccttcttcaagctgcaggaaaagcagatatggtaggagctccagcagccactttgggaccatgaagaaaaggtcagagaatttcagagacattggctataaaccaacacctctggacttctttattgtgagggccgatatctttatgtataatatttaatccaccaggcatagagctctgtttctagaagctgcatacaatttctaactaaatattagcactactgaatgtattaccattgttcagatgtttgtttatactggtgtggttagtaagaatcaaatttattcaaaagaacaactgaataaaaatagctactagtcatgtaatttctcaacaggaaataacagaagtatggctgctatgataaggaagtctgtgaatgtttttcttttacattaagaacgcctttagatatggctagaagtcacgagtctcctttgatccataaagtaactttctaaggccagttatctggactcacgatgtggtcctctttccaccatcccactgacattactttggactgttcttgcagacagaccatattagcaaggaatgagggaaaacggggcgctcattttgaacaaaagtcctagggcttcttagggaaagctagaactctctacaaaaggctcttcaaagggcaggacatgcagctaaatcttgggttacattcctggatcacatccacccacatacacgaaaaaacactcccgtcagcttcactcataaagaccagtacattgaatttttatcagtgagaaaggtggggaggggaggaggaccagaccaatggtattaaaaagaaacaaaccagcagcatttctgtaaactggaagggtaaggcataatccccccaacacatgcacacaaacatctcatgttttataatagttcttgaaagagtcaaaagagggccacccttccacaggtaaaattacgagtttgaaagcaactaaatacagtaacttcctacccagctacagaagggtctgtgccaaataatttactattaactgtctgtgaaaatgtgtggcattttatagcccttgaagtttgtgcctctgtttggtgatttattaattataaatggcatgatatatctcacagtttgtctttctgttattttcattagcgtaaaccctcaacaaattcaagttcaggtagattacaagtccattaaaaaaaaagtatgaaatttatttaaaaagaagcacaaattgtattccaggcctgtaaattcagtaacacaaattaatagctaacaaagtgaggctcaagtgtgtgccatatcagaattcacatcaacaagcagcatttgtcatcagaaaaattagtctgggctggatgtggtggctcacacctgtaatcccaacactttgggaggctgaggcgggtggatcacctgaggtcaggagttcgagaccagcctggtgaacatggcaaaaccccgtctctactaaaaatacaaaaatcagtcctattcccagagattataatttaatttacctggtccttagaatttttaaagatttcccaggtgattctaatacacagacaagtttagggaccactgtcctaacattttttttaaaaaagcagagactaggctgggcgcggtggctcacgcctataatcccagcactttgggaggctgaggcgggtagatcacgaggtcaggagatcgagaccatcctggccaacatggtgaaaccccatctctactaaaaatacaaaaaattagccgggcgtgatggctggcacctgtagtcccagctactcgggaggctgaggcaggagaattgcttgaacccgggaggcagaggttgcagtgagccgagatcgcgccactacactccagcctggagacacagcaagattccatctaaaaacaaaaaaaaaaaagcagagactaaaactaatgaaacaaagcaagttggagacaacagagattatgcagggaaatgagaactttaaaaattactcattgatattaggctagtgcaaaggaaattgcagtttttgccattaaaagtcatgcaaaaactgcagttacctttgcaccaacctaatatcttcagggaaataagaaaatgtattaaatctatgtcacaagaataggattcgtgtaaaagaaacattcagagaataaaaagaaattattggaaattaagactatgatagtagataagaaaatttaaagaaagtttccacaatagagtaaagaagtctccctgaaagcagagccactagatatagaaaagaaaaataaaagcaaaaagacaggaaacgtaaaggactagactaagagatctaacatccaaatattaataataggagttccagaacaagaataagagaatgtgggctgggcgtggtggctcacacctataatctcagcactttgggaggttgaggtgggtggatcacgaggtcaggagttggagaccagcctgaccaacatggtgaaaccctgtctctactaaaaatacaaaaattagccgggcgtggtggcacctgcctgtagtcccagctactcgggaggccaaggcaggagaatcgcttgaacttggggggcagaggttgcagtgagccaagatcacaccaccgcactccagcctgggtgacagagcaagactctgtctcaaaaataaataaatacataaataaataaacaataagagaacatgaaactatccaagaaaggttcctagactgaaggatgtgagcacccagcaaatgtccagcacaatgaatgaaacactcatacaaagcctaccactgtgaaatttcagaaaatccagatgttatgaaaatgcattctgggtacgtgacctcaaagtgagttgcaggacacagtgactgggggaccaagataactgctgctgccaggaataactgcccctgctttaggagtgttgaccagattgtaggggatccaatttctttcagtagaaagtaaatagattaagaaagcaactggatggtttaacacaccgtctatgacttttattttctttcccttttctttttgtgttataaaaggttagagaggcatgcatcgcaagctcagagatctaccccttcttcctgctacccaagactgcctcatatgtaagttcctcctgaataaacctttgactacctaccaacctaaagtggttttgcctctttcttcagtctgaacttccctccacttacggacagtggttcttggttctggcagaaacttttcccaatacaaggacaaatagaaggtttcccaagttgctagagagagaaaatataggccacacacaaaagatcaggattctgaacttgtttggacttctcaacagctgcatgaaagctagaagacaatagaaaacaaagtcaaactatcaatgtgtacatataaaattaagacactttcagaaatgtaaggtctcaaaaatatacaatcctccatcattctcagaaaactactggaagatgtatgacatctaaacagggagtaaaataagaaaggaacgcaaaagatatctaacagaggtgatgcaacataaagagacagggtctttccagactgttggagagttgaaatcctcagataccagctgtgcttcagacttagacggcaactactgtggaacagaataaagcccagattggttagaagtctcttggagaaatttcttcaagaagataaaattgatagaatatttaataaatctgaaggcatgtagaaaggattttgacaattagtatacagtgtggtttagagtatgagatgcgtctttcaaaaataagcaagtttttaaaaatcaaggcaaccaataactccagggaaaagaaaaagctgagcaagaaataaaaatttatagtagtgctttacatagctttcagccatgaataataacattttcaaaatcacaatcattgaagcactttttatttaaccaaaaattataatataactatgttgagagaatgagagcaggaagtaggacataaaaggagtgtgtgtgtgtgtgtgtgtgtgtgtgtgtgtgtgtgtgtgtgttggaggtggaaaatagaagagacctaatcctcatctttctctctacagaagtcaattttcaaaacccaaatatgaaaagaaaaacgaacacatgcatattatttagacacatggaggtaaataacaaaagaatcagataaaggaaatgaaaatgtttacctctggtgagggggaatggagacagaatgggtaggaactgctgtgtcttagcaaaggctttgtaaaacattataactcttcaaattatgtaaatggataacgaatataaaaatacaaagatttttaagtaaaaatattttatacatcctatatataatgttttaattatgaatgaattgccccaattcttagcatgacaatttgagaacctattgtatcaccttaatatgcattttttcaataatataccagcttctcatatttttgcttttttaagtttttttaaaaagctgagtctgggcatggtggctcacaccttcgatcccagcactttgggaggctgaggggggaggattgcatgagctcaggaattcaagcccagcctgagcaacatagtgagatcccatctctacaaaaactcaaaaaaattagctgggcatggtagcgcatgcctgtagtcccagctaatcaggaggctgaggtgcagtgatcacttgagcctgggaagtcaaggctgcagtgagctgagatcacgtcaccgcactccagcctgggtgacggagtcagaccctgtctcaaaaataaagaaaagaaaaagttatgtgagtgctgataattattaagataattcagtaaggttctaactgaaaactttctgttctccatatttgtgaaacatggggaagagtttattttaaagctctaatttgaaacaaatttgctgaagcaattgagcattcaaatattggggaataaaacagatgcaaagatctctcaaaaaaactgctgacgtccctcacactgagttagcttgaggttctctcgccctcgctggcaccccagggtctgcgtttgctctttcacttagaatcaattttccatatttccttttcactcatggccccatcagagcaccttgtaaacttacggttttggctttttgcatcctcaataagagctcaggtagaagtggtcgggctgtgggtagctctgcctccagtcatctctggctaaagagacacccttcattaggttggcagcactttggagccccactatttctgggatctaagacaacttggttgtcttctacacagttattttgtcagtttctaatgcccttcacaacggctttggtgattgattattttattttattttattttattttttatttttgagacagggtctcactctgtcacccagactggagggcagtggcgtgatctcggctcacggcaacctccgcctcccaggctcaagtgattctcctgcctcagcctcccaagtaactgggattacaggtgcgtgccactaccactgggataatttttgtatttttagtagagacggggtttcaccatgttggccaggctggtcttgaactcctgacctcaaatgatccacccacctcagcctcccaaagtgccgtgattacaggcatgagccaccatgcctggctgattgattattttaaagatgaccttgttttccctcccttacccagcatctgctacagatgggcgatacacatagaggactttccagtgactgcttagtcattgtcaccaaaaacccatgtctcccagtgttcctgctcctgaggttccaaaaaggagttgtcctggataggggcacattaagaaatcccagagggttcagatctataggagctatgaaagggttcctccaactggatccggccagggagaaatcaatcactaacgcagggggaaaggtatgcagggacctttcgtcacttggtgctggagaaaggaagtgtgaagggtcggtaaaagccaaaagggaaatcatgaagggaaggataaagctttttactcccaagttaaaatcacactacagaaatccatccttcagacttttatgatcagttgctaaaaagtccaagacatttgagcctactccaaagtgcatttcttgcaggatattttgagggaattcattttgtaatgatgcggtgaacacagagcccagcccggtctgtctctgaatattgtacatagcacagcaacacacaaatagaaaattagcgaatgtcttgatgattaagatcatgtgacagggagacctcgtattctattaattcaagaagcacaattttctaagttaaagcccataacacaactcaagcatagtaaaactatatataattaagaataggctgggcattttgggaggccgaggtggacggatcacctgaggtcaggagtttaagaccagcctggccaacatgatgaaactccgtctctactaaaaatagaaaaattagctgggcatggtggcacacacctgtaattccagctgctcgagaggctgaggcagaagaatcacttgaacctgggaggcggaggtggcagtgagccgagatagccccactgcactccagcctgggcagcagagtgagactctgcctcaaaaacaaacaaaaatagaatatggggctaagcatggtggctcatgcctataatcccagcactttgggaggctaaagtgagaggattgcttgaggccaggatttcaagaccaacctgggcaagatagggagactccatctccacaaaaagaattaaaacaattatccaggcatggcatggtggtacacacctacagtctgagctacttgggaggccaaggtaggaggatcgcttgagctcagaagttcaaggctgcaatgagctatgattgcaatgattgcactactgcactccagcctgggtgacacagtaaggccccatctcaagaaagaaaggaagaaagagagggggagagagagagagacagagagagagaaaaagaaacaaagaaagaaacaaagaaacaaagaaagaaagaaagaaagaaaaagaaagagaaagaaagaaagaaagaaacaaacaaacaaacaaagaaggaaagaaagaaagaaggaaagagagagagagaaagaaagaaagaaaaattttaaaaagaatatcctgtagataagtagaatgtaaagcttatcttttaactatcgataggcagagcacttcttgaaataacctcatgtgttctgggagaatatacatcagaattcaaagtacgtccaaatttaacatttttaaaaatcaaagaatcctgcagtttggagggacacgtgagtgcctctcactcagccttctgtgatattaataatatacctgataaccgatcatccagccacgagctctctatttcataaggcgctctagcacggaacaagctcagtgtttggaaggtctgtttttatataacaaggtgagtaagataaccctggtctcttatctttaagacagactttgaggggttttccaaggagtaagcagtggccaacagcgctgagtcgtccctttgtctggctgacttctctcgttatcagttgcaaacatctcatggagttaaggcattaaaaagactgagaaataatctacatatccagtgtgtttggaaaacatatactgttattaaagtccaaagattaccttgagactctctaacagcaaaatcgcaaaaaaggaaaatgttttgggttatagaccaatgtaataaaaagcagaaagatgtagtaggtgagaggagagaaggagcccagggccagcagagtcgtagccattttgccaggaagtagctttaagggtttctggactgttaggcgagtagctggcctgaaaccagatctcagcgtgcaggggctgcttccgtaaattgcatcctttcagtcactgagaaaattactcactccaacttagaggagacaaaaaccatgcccagagttgttaggtcattaccaaatatgagaagtcaaagtgagaagccagggaactccaaactaaagtagctcccacatccttagctgtgtgcctactatacaattttttttttttttttttttttttgagacagagttttgctcttgttgcccaggctggagtgcagtggcgggatttcggctcactgcaacctctgcctcccggcttccagcaattctcctgcctcagcctcctgagtagctgggattacaggcgcccgccaccatgccaggctaatttttttatttttagtagagatggggtttcaccatgttggccaggctggtcttgaactcctgacctcaggtgatccaccacctcagcctcccaaagtgctgggattacaggcgtgagccaccgtgcccgggcacctactatataattaaccaaatgattacctgggctaaaacaaatttctgtgtaaatatcttaaaactgtattattatctcacagcgggagagatcagttttgtgacacaaaatactttgacattgtgaacgtgtcagattctgccatctgaaaggtggcctttttcagcccactgtgtggcttcagagatgtgggcagaacaggtggaatccaacttaggggatttgctctttctggtctcactgtcagttttcacagatcttaaagaagtggctgcattaactaagtcaatcaaagcctgctcccttttaaagcaaaatgaagccactgctcagccttcaacataaaaacctggattccactactgtaagattctgcccacaaggaaagagaagaccccggaaagcgctgcagtgctgtcagccttaaatggaagttgggagagctggaggaatgccacggaaagagctgcccagagctagaggccgaggcactgaaaaactctgccttctcctctagagtctcaggaggggccctgatccctgcccccatgcacaagtgagtgggaacccccccaaagacagccgctcttcatagaaaatgacagtcatacttcaaaattgtagagtgcctacaaaccgctcgaggttgcatctggacagaaggatcagaagttttaatttcataggcctggaacagggttctaaaataaaaactaataagacggttcatatctcatcatcatcattattattaataatagctatcattcacgcctgtaatcccagcactttgggaggccgaggtgggcggatcacgaggtcaagagatagagaccatcctggccaatgtggtaaaaccccgtttctactaaaaagacaaaaattagctgggtgtggtggcgcatgcctgtaatcccaactactcaggaggctgaggcaggagaatcgcttgaacccgggaggcagaggttgcagtgagccgagatcacgccactgcgctccagcctgggcgactgagcaggactccgtctcaaaaaaaaaaaaaaaaaaaaatgctatcatttacttagggcttacagtagccctggtatagcccttatttaatgctcacctcaaccttgtatgggctccattttcccccattctacacacaattaaactgaggcacggaaaggataagtaatgagtacaaggtcactgaggcagtaggtagcagagctgatatctctatttttaaaagtgatccaggtaccacagtttgaaaaacaaaggtcccaacaaatggcatcagacattgggcagcaaatactgctgcaggactttgtatatgtttctccttatttgtctttaggtgtttttcgtatgtaagacacaggcagtgcaggggaaccttactgttttctacagaatgagaggggtctgagtccccgtctctctgaagaaaccacttttgtgtcttttatttaactcatcatgtattgtctgaagagttttattaaaaaaaacaaaacagtctgatgatgcccagccctggagaggtgggagctcctttgccaggatctctgtgtcccgcagccgacctgccttggcatcctcatctcctgccacttcctgttttaccccatgtgcttgctggtccctgaattctcttccatctgtctttcctcatcctcctggccccagtggctccccagccatgcccagagaggttggcactccagctgaggctgcagctgggaggcccgtggaggccacagaatgtgttttccttctgtccttctgtcctagttatcacagtgaccaaaatttcaccaacctggaaaccaagcacatttacatctgctttgacttgatctgtcaaaccaatctgtcaagcacccacctcccaataacagggtccctggcatctctttcttcttccatccacacccaccccaagaagctatctctgctgctgacctcagaggaaagagagctgagaatctccacggtggatggcagatcctggctttctgtgtctctgccttctgttgctacctccccattttgctatcatagggcttggcaatagaatggagtctttgctggttgctatgtgtacacacatgccatggttcaaggagatacccactccctcctggctcactgtccaccaactgtgctcacgcttgggatcccaaggttccagctctttagctcacactcctgcaaagccacagttatgacacacacttcatgtgccagccccacttacaggccatgcccctattatcatgcaaataaaaatacaggatatgcagcaaatttcaaagactccattctattgctcagctatagtgccaacctctctgggcatggctggggagccactggggccaggaggatgaggaaagacagatggaagagaattcagggaccagcaagcacatggggtaaaacaggaagtggcaggagacgaggatgccaaggcaggtcggctgtgggacacagagatcgtggcaaaggagctcgcacctctccagatacgcaacaaataactttggtttgtgtactgattattacaaacttatactaaacacgatccaccattatctgatattccagtttcaccaaggggccctgtattttttcccttagttccccaaccctaaaccctgcctgccgcagggggccaggctccctcaaggagtgtttctcttctgcctctcaggatgctttccagactggactttagtggatcagatgtgttttagtgactttgaacctcactggggagggggtgaaggcctcatgctgtttctctcaaggaggcatttttcagcatttacccaccaagaccattgggagagaagtttctgacaacctacaaagaaccctgttaggacctatatgaaggcagtggcttctgtgatcttttttcatttatataagcaagaagggtggctggagcaatccctcccagctgggccactgggccgaaagcaacttcttccctccatccagacagaaacacagttggcggtcttcaaacgctggattttctccctaaagcacatcgccttactgaaaaactcactatacttcctttaaaacttcatgatctggggtctttcagataaaatgtcagtggttcgacaataatgaatggacaggtagctaagaacagcgtgctggggaagcgttccgcaggccatctgcctgcagcatgtagttcacaccctccatggagctgccctttggggaggtgaggggctgaaagcaagcgtgtgctcccttggccaaacccaaggaggggaagcgctgtcagctggccaagatgtgagccaacagggcacgtagaaggatatccctcccaatctactgcccccaagggagcccctcttttaattttgtgcctgctggcttggagtgatacattattcttggagaattgtccagcatagcgggaggaaggatgcagaaacaggggcaagtggttgaacctgaaaattcccagttttccttcattgcagcattgaatgaggggctgtaagtagccacaagagcaggtccccgtgtggttaaaggccctggcattcacttaacaggcgaatttccaggcaacattctcttactcagcacttttaatcaaaataatcagtccagtgtctgaggaggaatgaatagggcagtgtaggaatcccctgttgctaatgaaacatttaaaaatccaggacagtaatggcctgtgctatttaatacagaggagatgcttaccacagccccctcataccctgtttttttttcttatttgcaaaaggaaaaaaaatagaatttattcatcttaaaaaaatacgaagtgaaaaattatccattagcacagcaaagacctatttccaggaaacgagttttaaaaagaaaattcttgacatcctaaggttgaaagcgggaggtgtcatgactttgaacgtgaaggatgaaagggccactgtgtccaggtgcagttcagcctggcctcatttcatctgttacgggaggctgcttaaacccctggttgtggtccaaaaatatcctggcagttagcatcctgcattaaaatttataaaccacgaaagaccttttcttacagaaaagctaattcaggctggatagcctttttaaaaaaaagatttaaaaggggtagtcatcagaagaggttatatggaaaactagaggtaagtaatgcttttcagtcccccaaaacatactaaaaatacagcaacagtaatttcagaaggaagggaaatggtaccaagcataatttcgtttctaagaagtcccaggaatgaatcctggaactgctagaatgaacttttaggggtgacaaaaaaaatggttggaatattatcaggaaatgggaactgacaagaggatggaaacaggctgcaccttggtgtctcggctctggggctggataaggggccccagtttctctggactctaggtaggcaggtctgaaacctggtcactgagccatggctgctggaggtgcttctccctctgcctggccgcattccttcaccccatgctgagcctttgctgagcgcctcctatgtgccctggctttagtccctgctatccttcaggtgcagatgaaacttcacctgctcagagataccttccttaatccctacagattagataaaattcccctgctctggactcctatggcacctgctctggtcttaaccctgagcacacttttccactgctgaattctctctaaggttggtgggggaggggactgtttctttcattaatcattgtattcaacctcccttactcatccagcccacacccacccgttgggtgcttaatgaatactggtaaaatgaatcaatgctattttctgtgagtccagttttatatgcgtaggttatcttttattataaaaggacctggagatttggctccaaagttgacattttaaggagactggtgaggaagagcaagtggcagcaagtaggtgaccatggcatcattctttgagtagtggggaggccatccacaggcagtcagtctgaccatctccagggagcagagagtgcactccatttctgcacaaacttaagtgagagggaggaagcctaaacagacctggaaattgacctggaccagcctgctcatacacctgcaaaatgcacctggaggatcatagcctctaagacgtatgctggcctttggccagccttgttttcttcctgattcacgtaatcagacatgccagcttccacgaaatgataagcttctggagtgatggtaacaataccattaataatgattttagctaccttttagtgagtgctaaccttgagccaggcacagtccaagccttttatgcacagtatatatttacctgcacagcagcccagatgagaacaatggcgctaaccccatatttcaaatacccactcagcaagctgcagagatttacataggtccaacagctcatcgtgatgggcactggaaaccccatttctttggcctcttctatagatcctagtggatacctgagcactcaggaagcactcagtaaatcctctcaacttagccagagcagggtagaacaagtccttgtatttctgtttacagaagcttccacctgggtctacacatacagccacagagtcagcctgagtggatcctgggctgacagagtttatcggccagctctgcagtggccctaggaacatcacactgtgcctatcatgccaagtgacccccgagacccactggagctgagagagcctgaggagggtgtcagaccaacatcctgggtggttgctgtagtttcctctgatgccttaaaactgaaaatctagagggtttgcaggaacgaccaaagggactgcactgtgctttgtttctgctgggagtgaccctacatcacagagagtttgggcttcactccacctagccctggctgttccttccaaacattctttcactcacaaccttccttgaccctctgtccccatctgctcccttgatctatttgtggacgtgcttagagctaaataacactggagttggatttcattcaatttctcaagtcgattcaaggaaggttgactttattataactattcaggcagagaatggcccttctatctgctttcacacagaacaaaaatggtctcagctcttctttaaactgtcaaattatatccttcttctttttgaattatttataatctgttgtttttaccctgcaaaaatgggcttttgctacttcaaccacatattaggccttttatgcaaactgtaaaagaagccagccttctgtcagagaaaggcttctgacttcactaggtataagagaaccaaatttttatccccataaaatttttcccatttcagtcatagcacagctgatgcaaaggcagaagagttatggtggaaatggaaatacatgtgtaaaaactacagtccctacagttttctgtgaattcataatccccagagaccagcagacctcagaaaccaaccaagcaatgggaggagctagaaactcaatggtatcagccaaaatgagcatggagtgttcactcagaatgaggaaccaccgaggaggtgtgcgtcatcagcctcactcacagagaaggaagcctacgtggtcacaagactgagctgtaagagggaggggcaatgcgtagtcagcccagatagagctcaaatgttttaaaatttaatacgttttttattataaggtctaaccaatccctagcaatgacacaatatcactctctcagctctcagttggcacctcctggtagggtgagtttagaaggatgaaggaggaaagtgagaggatagcaatcaagtggattcccttcaacagcacgaaccacacttctcatgagacccctggagggttatccaaagcacagattcccaagcttcgcccgcggagacgctgctttggtggcactaggggaacctcgcaatctggatgctaacctagtaccccaggtgattcttatctacagtggttctcatccccgatacataaataataaatgtcagcgcatcccaaaacttgctcaaagtcaaggtcacttatctaacgtgagtgccaaagcccaaacggaccacagactccagacactagtgacctttccattcaaccctgggaacgtatgagccaaaaaacatgctaaaaccagcgacagtagaatgcaatggtattcagctgctccatgccacacgtactcatgtctgcaaacccttgctagcgggcacctgccagaagcaactctgttacaggatggaatctcacaggttgttcccctacccagcacatatgcggctttcgctaaaccatctgctgctttgctgacaaggacagaccaaggaatttccatgctgcggtctgtcagcgtctgtcacagggccaccaccctttgattgggcgaggaacttggaactgagacctgtcctccaggagaccaatgtgaccctcccagggcagagggagtgctgccacttcacacgtcctctcacccgggcttatctaactggccacaggacaagttctgtgttttgtcggcctgggaaatctaatggaaaggactattattagaaatatttatcttatcaaggaaaatatgctcttaaaatgttcaagaaaggatgctgcctggttcccaaggaatagcctgaaagactatatatatatataatatacactcatacacatatacatattatacacacacatacacatacatgtatatatgtgtgtgtatttaaatgtaatatgcatatgaatattacttaggtaagcatatattcacaactgcagtagtatgttacctttatttttctttcagcagttttttgaagtaaacttcatcatctgactgcaggggttaatgaatattctagtgcttctcacactctgatgtgcacatacatgagtcattcaggaaccctgatgatatgcagattcctattcagcaggttggatggggcccgagagcctgcatttgtagccagctcccagggaatgcttgaggcccaggcaggagccactctgagcaatcagattccagcttgtgatgatgtttgcatcacacataaaacagcacctgtcaaagcttagaatatgtaaaacaaacaaaactaagttcaaattaaggcactctttcttagatgattcagaaggaacttcagaatttgggcaatgcctcttagccatcattacaaacaattcttcccgtattagagccatttcagtaataacagacaagtcctgacatacaagaatcaggttgccttcttcttcataaagggacagaaagcacccagaactacaggtatttttctctcatttttgatactctgatctgaaggtaaatgaagaaagccagggcatgtcaggccactttgactgcttaaaattgattctgccagtctagaaatgattaaaattccaatcttggaagctcttgggaaaaatatacaaacgctatattattccaaatattctgctatatgaaggctggccctattcatcacattgtttaaatatttgaaataagtacattaatcattatcctcacttctaagacatcaaagacaaaattatgcctaaaatgtattggtaataactagtacacaattgagaatggacatgtctcatgtgaaggatacaaagaaatacagagaatgatccccatggggacggagctgcagcttttcaggaatggaggtccaaacccatgacatagtatttatcacacagggccccaaaactatgcacacacctggctcagcgtatgtagtcgatgcaaactggggaggtaaaattagaatcaactgtggtgggatttaaatctggccttgaaggatttcaaaaggcatagaagaggagagagaatgagagcaggtttggggagaaacaatgaagcggaacagaaattaaggttttggatcatgtctctaacagacaaattgctaatttaatcctcccaataatcctgcaaggttggcattattacaccaatttggtgaaccaagaactgaaactcagaaaagctaaatgactgaggtcacacagccggtaggtggtctccaaggggatttgaatttgggcctgtttgatatcaaagtccatcatcagtccaccctaaaccagcacgccccaaagcacatctcatagctccctaaaatgttaataatgagtcaggaaaaagaaaaggtcagaagtcaaataaattttgaaagctctcaggataaataataatactgttacagatataagttaacatttattacatgcttcccgtgtgcttgctttaaaatatttgttattattgctgttgctgttgttgtttttgagatggagtctcgctctgtcacccaggctgcagcgcaatggcgcgatctcggctcactgcaacctccgcctcccaggttcaagcaaatcacctgcctcggcctcccaagtagctgggactacaggcacctgccaccacacccagctaattttttaacagaaacctctcagggcctttaacactctaacctgcattgaaaatctctaatattatgtgttggaataatattaaaaatctcacataagagaatattgatcatgcaaaaacataatactgaaatagataatgggaagtagactctgatgggtttcaatgataagtcattatgttatggtgaactagcttcagagctagactgtatgcctggtggctttccattcttcctgacatccccagctaatttcatttaaaaatacactctaacagactgtggcaattctcaggggaaaaggacagaaactggaaggtggaaacacagcttctgctgtggtatctaacagctaggtaagtcaggtctggtggtttggcatttgacatattaagacacaaaggttctggacaagacaccaaaggaatctctcctgccccttttgttagtaactgctgtaatttcctaatttataaatctttgtacactgtctgcatcaggtgtaaagtagccatccatcacctggctctcatgacatactgagttgcgttcctccaataaaatagtctctgccttctctcatgttctacgaagcctatgttgctaagttcttatgcacatcaaataatacacctgtaatcccagcactttgggaggccgaggtgggcagatcacgaggtcaagagatcgagaccatcctggccaacatggtgaaaccccatctctaccagaaatacaaaaactagctgcgcgtggtggcgcccgcctgtagtcccagctactcgggaggcaaaggcaggagaatcgcttgaacccgggaggcggaggttgcagtgagccgagatcgtgccaccgcactccagcctggcgacagagcgagacgccatctcagaaaataacaaaaaataacaataaaacgatcctaccattatgccttgcttaatgcttttgattttccaaggcattttcacacctgtgaccttggtagtacatgggcatcttattcttgctggactggatgaagttccattctccttcttcagtctctgatggtaactcatctgttcacatccttagaggacagttggggtggggaggaacgaacacattctgcagtcataccagtaggaatgaaaaggagagatgtaagatacatttcaagaaatcatgtgcagaatttggtatctgacagaatatgacagggagggagggggagtccatagctccaggcaatgtggcatcaagatgctaggatcccaggccagtgcctgagaaacctgacagcatcacccacagaaagaaattaagtgtggaaagacatgaaagaagaaaatgtccttcaggaaactagatctgtaggactctgagcaggaaagatattgggtcacagacaatatgccctataaattactagaatggtagatggtgtaaagtttagctacattagtagtaagagtgtattgttttgttcatgtagcttttttttttttctctaagccaagcagtgtgttaactgctttatacaacaactctgctgggggtggggtgccgggggcgggtggggggggggtggtcaatgttattaaccccagatgaggaaatacttgagagaggctaaataatatccttgatgtcatagaagtagcaagaggcagaaacgaaattccagctggtggtcttatgtgaaactagattgcacagtaagaatgtgtcacattataacttctcattattaggcaaaacatgtgagtaggcaaccctgcaaaactagcaagtgggtgacactataaaaagctaaacaggataaattttggattacccaccttcctgatctatctttagtgaaatgtcagttccactctgtagtcaagacttatgactaacagagtactgagcataggaaacatcttaatacattgtttaatgaaacaaagtattttagagcatgctggcaaactgcatttagtttataatcttccagccttattctatatgcatgagggaatcattagttccagtgtagtctttcctagcagcttctgtgtctacgaacagagagctgagagtggcctgacattcgttccaacaattaggattagcttaaaatgctgggacttcactgcattgccgcagtaacttttgcagcttttccccactggaggtcactgtcaccttgcagttgcagagaagaacctcaatttgtggtggtaaagaaagtggacgttttcatctatctaggctggctgtagttgcttaaagaaatcaaccaaccaaccaaagcaacaatcattaaaacatacttcagatcatgtggcaaaaaactgtccttagaaaattcatcactgatagcgcttgttttcaaataatgtttcatcttgacactttttaatttttaggttactataacagtagatacatgttattatatatttgtccaaacccacagaatgtgcagcaacaagagtgaaccctaatgtgaaccatggactctgagtgataatgatatgttaatgtaagtttatccattgtaaaatatgtcccactctattgggattgttaatagttgataaatattttgaattcagttaaaatttctacaaagagacccaagcacctgtttcatatgttgggcaagcgaatgcattcaaagatcagatggtatatagcttcataactttgagccaattcctgacctcactaagcctcagtttgctcacctaaaaggtagagataagaattctaccaacttcggccaggcacagtggctcacacctggaatcccaacactttgggaggccaaggcaggcagatcactactggagagcctgaccagaaccaacacagtgtcttttgtgcagtggtggctcagtaatgatttgctgagtaaattaatacagaatctaggcataaatatttaaaggaaagctgagacactaaggaatcttgggtgagtccatctgacttttcccggactttcagtttctcttcagagaagggtttgaatgagctgacccccgaagttcctacgcattaaggtccctaatctttgagttacaacctgtgggtcagagcacagccttcagtgtcccattcactatggaaacgccatgacaacctgtgtgcatctgaaaccccaagtggaggcagccatgagtcatggattatgtttatactggtatccaattgagcacatagcatactatcaccctcaatggactggcaaatcagatacttttccccattaaaaatggcaaatgaggttttaaaaaatcattacaattaatacaaaatgccaggaggcactgtacaggttgtatctccatatttaagaagacctagggcctaaatatacttaagcacataagagaaatgtactgatagcagtactaacatacagcattttacattttacaaagaactttcacacatgcatggtactttatttggccctaagagcaaccctgtgcagtagagggggctgcagaaactgacctgcatatactgttgtgtaaagaacttaaagaactccactgggagggcagggccaggactggaagctgcatctcctgaccccagtgattcagcttgaacaggatgtttaactgtgaagcacgaagttgggtatagcaggacaatccttcatggtggcatagagtgcaagctaggtgcccaccatggggttcaaagcccagctcttttgcatgtgggttttgggcaggtcagtgagccttcctgggtctccactgtaaagtggaggaaatagtacctacctcatggctgacagtgagactttaaaggcatcagaataggtgcacctctccttgtcctccgcgcatgctctcccccacctctgctccagccagtactgtggcaaccagctccatagaggtctagtctgaaagtgcttcacctcaggccactgcattacgccttcttcccagggttctctggcattgctgcgggaccttcttgggaactggcatttatgcatatgcaactgaaaatgccagggggatagtcactccacaagacccccgatggtggagatggcgcccggggaatcagtgccaattgcctgcttcagtcctatgggcaggtggctctgaggtcatcctgtctgaagtagccagtttggcaactcaaccttgttggggcttctttccttccctgtttcatactcctccagcccccacacctattccctggagtcagttcacaaaacaagccaccctcacgcatgcttgggctctgctttctggtaggaactcaggaatgacatcgtagagacatggtgctgggcacataagaaatcctacataaactttacctgttcctcattttctatactaaacgctgcctacgatcagtcttctccatgtctgctctcttgaaggaagtggactttgttgttgtcaccatgtggtgggcagaaaatgacaaataagtgaaagggccaaataccacagggcaaagacctggaatagcttcctgagtcggatgtccagagactgactttgggccacttcattgcaagagactttaggtggttttagatcatacagtaacaaaccgtttttaaaacttatgtgtgtgttactgtgcattagaaatctataaataaaacatcaaaaccatgatttcactttatttttgctttggctaaaaatgttttaaatgactcatatgaaaaatattaataggaataaagatagcatgtaaatatagcaaaaatcatgatagtggtgtgtgaaaaaaagatctgggaaactaatagataaatgtgccttttataaccattatgttttaggtaagtggataggatcgtagtttgggcatctatatttaggaattttgttatcaagtatgctaaccattctcttacttaggtacacagacttgatttgccacatttgtatttttgacgacgttgttctaactttcagggagagcaaataaaggtctttttctcatattaaaacaacagaaatggcataaaactatcataattttaattactctaagaagctgaaacaacatacacataagttgactcatctgtgcatttggtcaaggacactcagaatttacatgggcaggtacctatacacagtacattggaaaacctttttactgctctctgtcttgaatggatatagagcacattcatatcataaataggattcactgatacctctagaaaagacagttcttaaaactgctgtgcttgtagatatttcaaagacaatagtttgctcacatttctaaatattcattagcaataagaaaagctatgaggacatgttgtacactctaatttaggagagattttcttcatggctaaaaagttgcaaaaacattctgaaatatacatccacaatactcctaattaactcacacaacttgttggccttttcactgggaaatgctctgagggctacaatctcatagcttgagtgagtaacacattcttttccacatggaagatgaaagcccttagtatttcccataggagaaatgtagtcctcttggcatctcccacaggagatacgataaacagcgaaaaatgattaacacttgggcaacagtgactgcctaaaaacacagacttaactatgatgttaggtcagacctaaagagaattataatgttttatgattgcttacttaaaaaaaaaactcttcctttcttccatctctttcactttgtcctcaactaagacagatcagatgattgacaagccattccaagattgggcaattcctcttcatatgaacttgatgctccagaaatatttgctgtggaaaggtccccgggaaaggcgcaggccatgcggaaaggctgactcctagagctctccgacttctgaacaccaacaagatgccgagttggtggcttcttgttgaataagaataaataaggcatttgacccagccatcccattactgggtatatacccaaaggattataaatcatgctgctataaagacacatgcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccgaacaccgcatgttctcactcatagatgggaattgaacaatgagaacacgtggacacaggaaggggaacatcacactctggggactgttgtggggtggggggaggggggagggatagcattaggagatatacctaatgctaaatgacgagttaatgggtgcagcacaccagcatggcacatgtatacatatgtaacaaacctgcacattgtgcacatgtaccctaaaacttaaagtataataataaaaataaataaataaggcatttatacacaggtgtagggatagattgtctaactcccctagagaaatttttttaactgcatgcattgtcaatggggcaatagcaccccaaaggaatgaaaattggttcttctgggggcatgtgaagaaaatcttactctttttacgtataaagcacagaggtacaaacaatgcatcaacagctatgcagtatacatgtggtattaaaatttaatgggaggagtcaactaaggggaaaaaaccctaaaaagtctaggagggggtggatgataatgaaaacaaggctgagaaacaccgccataaacccaccttcagacaggaacaatgattcagactgttttccatagtgctttctaaactgttgtatattgttttaaaaataatttatcatatgctaattgataagagagtcaaatatgtgcaaagagctgtcttccccaaaatgaataccctctcttgaaaagtgctaaaattcttagaataggaattatttgtcttcttccagaattctgctacgcttctgactgaattccattcctggaatagctatggtgttacatgaaatgcattatcaggcgacagctcaaaggagaaagcagagaaggctatgctcagaagggctgatcactgcaggtgctgtgtttgcaatcgatttcttagtaagagtagaagcacttttgcttctgttttattttcttttcataagtcatataagaagtaggagaaggaagagatacggacattatttttagctctcacaaacaaaaacagatcactaactttaatatgcacagggaatccctgcccgtgaggttccccaaaagttggtgcaagtgtttgaaatgtgccacatgccactattattacctcaactgcccctaagaccagggccctgggcaaagattcagccagggcatgcattccatttactttggcaagcgtcactcccaggttggaaacattcgaacaaaatgaatctgtcttagataaaggtgattttactacctgcacgtcctcaagagcaggagtctgccagtggcctccccgggtcatcacgaaccggatcaagcaccagagaactgaagacgagagaaggcacacgctacctacaacccagacgtcttttcttctgagtgtgaagtccattctttgggagcagctgtggatgttgcttggcttatatgttccttccctgccctgatctagcaccagcacttctcaagcagtgtcaccctttgctctgccctgaggagtgggtgtcaccgaattacagagggttcttgcagagtcctgcactggacgtctccagttacgtgatcagcaaataatctgcctctttaaaaggaaaaatacgatggccttgtgtgacagatctgaaacaggtgtaggggcattgggagactgctggcaataatttacgacgctgtgaatgcgtatttgttcccagttcaaggacaattagcaccactgtatctggcaactgctggctgccgaggctgggccactgccagggagctttctcctgcccttacagggtgaggagcacagggatggaggtggcgaaatgcaacttgaaaaatcacaaaacctctgccctcagccttgttattttgagatctaagttatagtcattacggatggtgctgatggtacaatttcacagcagatggtcaggaaatgccacctggtgttaaatccaccaactgcaatcaaaataggaaaatccacactttactccaacccactgtccctctgcacatcctgttaataaatattttgctttgcttggtcttgggagcatttgtaccgggcatttaaacactccagggacagtggggtcccgagtctgctggggccatgcttgtttctacccccacagctttgggataccccctggttgggatatggaagaacttaagccaggttttaaaaaggaattattccctatgaaggaaggctttcaaacacaaatcaacaagggttaggataaattcagaaatgatttgcttaggggtcttccaggcgcggatgtggaacggtgggctatgctgacatatttttgtagagtgagcattcacaacctgtgtcctacttttatacttgggaccatgccttttggatggaggatgagtaactaggggtgaacaggcaggtggggaaaaccaacggaggaggaggagagcacagacaaccccgggcctcaggagcagggatgggggtggtacaccgaggaaagcagtgagaagcacgcagggccgaatggttggctgagaatatcaccaggcacatttgtgtttcattaagcaaaggggtgtgggggtgtatatgagacagagatcctactaaatattcaagtaaatctgggggaaatacaacacgagggctatttactatatagataacagagaactgacaaaagaaaaaaaacccagattcaactgtacaaaaataatactaattatagttatgaaacctgttcatcatttataacttaatggtatggacacagtagctatcgagctcatcactcatatgagtcagaccaatttggtcttgtaaattttacttgatttcaacaccacaccgtgtacgtatgtttagatctagtttattatggcatatggttatctgctgaaaacttttaaaattttacacagtaggtagaatttaggtgattttgaacagcctttggaacataatagaataagaaaagtcattagaaaacagaataaaaaggaaagtaggaaaaataggccacacacagcagctcatgcctgtaattccagcactctgggaggccaaggtgggaggatcacttcagcacaggagttcaagaccagtctgagcaacacatggagacccctgtctctacaaaaaaatacagaaagtagccatgggtggtggtgcatgcctagtcccagctacttgggaggctgaggcaggagaatcacttgagccagggaggtcaaagctgcagtgagctgagatcacaccactgcaatccagcctgggcgacagagtgagaagctgtctcaaaaaaaaaaaaagaaacaaacaaacaagaaaaattaaaagaacaaggccgggcacggtggctcacgcctgtaatctcagcactttgggaggccaaggcaggtggatcatgaggtcaggagtttgagaccagcctgaccaatgtggtgaaaccccgtctctactaaaaatacaaaaaaaaatataaaaaaaaatgagtcaggcgtggttgcgtgcgcctgtaatcccggctactcaggaggctaaggcaggagaattgcttcaacctgggagacggaggttgcagtgagctgagatcgcaccactgcactccagcctgggtgacagagcaagactccgtctcaaaaaaagaaaaaaagaaaaaaagaaagaaagaaaaattaaaagaacaagaactacttaagtagaaggaagaaaagaaggctatgaagtgtttcataaactcagtaaaacatagaggaaagaaggaagatggctaaaaatgaattcagtagaagaaaaataaaagaaatagaaaaatctgattaagagcaggaaaacaaaaagaatctgagttttatcaaactattttaacaaatataagttgttaaatctatataaaattcttcccctattgggactggagagtagttccagactctaaagaaactgcactgcaagcttccagaacaaagctttcatgtcaccagagtctgaaattcagagtacattctttccagtgcaccacaggggatgtttctactatgattagccgtgctaatcccctcaaagagagaagggatgagagagaaaggggaataggtggagaaaatcgacaagcatgtttttatagtccctggagagaaaagcgtggcattttaaagatttactgctgccccagcagaagatgaagacgtgttaatctagctctgtctgcatacctgaagacatctgagctgctggaatgtccttctccacccacccgctgccaagcctgctggctgccctggcacccaccaactaggcaggcaggggctccaggccatggaaaggagaactctgtgcctctgacacatgcacctatccattctccacgtggacggagagagacagggaaatttattgcagacatctctaggcccttctccatttacaagtaagaaattgaatgggacacatggagctcctagtgattccttcccaccttccacagggtgtcaactgcaggacggaagccaggaggcccaagttacagaagggatatgagacttactataaaggacattctctgatggtttctaggggttaaatagcagtctcaatttttccctcaaaaacaccctaaaaatatttaacttccaaatcatcaacttctggatgtagttggctgcacaaaagtaacatccctacatatatttatgttccaacttagcactatcgcactctttttttttatcttcagaaacagggtcttcctctgttgcccacgctggagtgcagtggtgtgatcatagctcactgcatccttgaactcccgggctcaagcaatcctcctgcctcagcctcccaagtagctgggactacagatgtgtgccaccatgcccgctattttatttgtatttttttatttttgtagaaatagacatctcaccatgtcacctgggctggtctcaaactcctggcctccagtgattctcttgccccagcctcccaaagtgctgggattacaggtatgagccatgtgtcctgcttatctcactctttagagtgttgcccatttataaaaattgtatcatagattttggagaaaaacagtacttgaaagataatgaaattcatataaactattacagttagttgatgatttcaaagttctccaagaagaatattttgtcttctctgtcctaccgaaattaataaacagaaaaaattatcctgtttgtaccactgaaaaccctaatgagaaagtcatgtctcacttaattttgcctgtagatatttctccttggtctatattgaactcatggggaaagcagaggtctcaaaaaaatgtttcaatctgattcatttattctctccagcacattttgtcatttcttattcacttacaataaaaagcctcctagaccttttatatacaatctctctatttcattgtctattgcattgttagaaacgcccttcctacctgaatagtgttttttagaacagtagctgggcaaagaaggatgttttccaaacctgcctgataagaatcacttgctctgattatcaaaaataatggttcccagccctcaaccagaattcacttaaatagatctgtgcattccaaaaacacttttggtgcctatttgtttccgttactaggaaagcaactgaggaaacatgaacaaataacacgaggtttcccaaccttaaggagccttgtctagagaaaggtgatcaacatgttcaaaaccaccacatgtgctggaatgaaggcacgggcaaaatgcttgatgctcccaccgggcaaggagccaacggatgatgggcaggaactgactgggccaaggcaggggaggtaattgctgctgccgctaacacatattaaatgctgactctagtgacagatactaggcggagtgctttacagacgtgatcacacttaattttcacaattgctattatctcactaattcagatgtggcaagcccttggttaaattaatatttttcccaagaacgagcagctggaatggggctcagaactctcgttctgcacagaggagggtacaagccccaccgtcgtgccatcagcaagtctttcttgtcccttctctggacttcactatcaacagctctgctgtctaccgcgtgaggaactcaagatctgaaggaaaaaggagaaacttctttctgcagaacagtgtgcctctcagagcccttttctgaatttcaagcccaaatccatcatgctaaaggattcttcttcatttctgcaagctggctgtataactcctaagccactaactaaaagtgaagtcgactgctggcagaaatgcagtttcaaaggcctcctaattatttaccaaacacaattgtatagtcgacacacacaattctcactgaagcaaagtggaatgatgcctattcataaactttccttaattgtactcacaagcggctccatgacattagaaaagataagatagaatgaatactttttaggagactaaattagaacatgattacctcattatgtccagatcttgaatcctggtccccagaatttttttccagaaaacacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgactgcaaagaaaggaaacacaaaaagttctcatcacgtattcatgcatttgacttcttgagaaaatgaccagtgagaatttggaagtcccttctgtttaaactggagagaggatccaaaatcaggaaaagaaatactaacattcatattgagtttccaacattggaactttaaaaggaaaaaaaattttttcactttaaaactacaaaagcaaacagtaagaagcaatgtcaagattcactggtgatgaaatatgctccttattgcacaaaacaagccgtagatcaagtggccagcttggatgtaaattataaagtatctttgggtttaattggaaccgcaggttttgcagccccgtgggaagggcttatcacagaaggggtctctctgcttcccctggcctccctctgcagagggatcgctcccgaatgagtccttttccagaactcttctctacctatgccttaaaatgtgtggtgtttatttgtgaaaagaaatttatttccttacagtcttctcacgtggacagcactcccagatacctttccttgcatctgcattaacagctatgtaccgagaagttcagagtcttttcactctccttaaaatactttcctcgcaaatgaagtaatgcagcatacataattcgctttgatactagagacatatacgcatgtctatatgtacacatcacttgattgcatagagaggcagggagagggagagacatttgaatttgtgctagttccgcatggctgacaactgaggccccctggtggagattttccgaaaagcgcctcttcgagcattttctccgcttaaaaaccgtattgtgattctcatcagaaaacttaatattttgttttgtcagttcctatagtaaaatgatactcttgagttccaaagtgtttaaaattcactgctctaacaaattatacttatccacataaagagcttacattcaaacaaataaaaatgcaaatattaatactatcaaccagagctctacagatatattacagatcattcttagcattctttcaaattgccctgaaaaaattattaaaataaggaaacaaatgcatggctatttctaaggcaaactacgactaaaatactatggttaattgcagatgaaactcaagttggatcaggaagccacacaaaattaatgtattaaaacaaaagcttaggattaagatacaataattttgcaaagaaatattaaacattaagctctacctgaagtttggtacaatttgttattgaaggtaacttagaaaaaaggggaggagatttgagaggttataacaataaacaaagataattaccattgataggatcacatcgaagagcttgagccactccaagtctagagcatacattccagaagataaagagaaattttgcagaattcaaactgactatgaaagtctctggtaaaagttttgactctcagtcgtataaatcttctgaaaagacaagtgtccactacgagaggaagtatcttctctct

SEQ ID NO: 1389 - DNA, 906113 bp, Homo sapiens
atatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagaccacggcggcgtggggagacctggagccgagctttgcgctggtctggggaacggcggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttccgtcccagggagtcgaaacccgcagcagggcgggcccgcgtgccccgagttcccgaacttgtaaggtgctgtggaaaccactctcgccgacccccgccaggctgggaaggggtagctgcgggagtcgcacccgcagagggagcgcttccggctggcgggcgcggccggggcccgggagggcgcggtgcggcgagggcagagagctgcgggagaaccctgggatcccgcgatctcctcctgtgccttcctgactacccaggagaactccaggagtattctcctccgcctgtctttgctcccaagggctgggcgaacaattatctgagggaaatagagcagtggagacaatctggggaaattttctcaagctcaaaccagttttctcttgccataatcgcagggttccgtgtggggaggggggagcaaggatgacgcttgattgtctgaagtccccacttcgttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttcagagggcccttcccacttccccaggactgagcaggcagcggctttcgtctggttaagaatgttgaatatggatttctcaagggacaaaagaaacctcccattccgttccttacctctatccgagcttcccaggctgcggagacgccaaggctcagtctagcttagaatagttgcttcttgagttcaggcccatccggatgggttagtcttttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcacatccctaagtgcacatcactacggaatatgcctaaatcctttgttctcattactcctttgaaaagtcgccaaagtacccttatcacggaatggaacgtgtttcagggttcattgcttgtggaaggggtctttaagaacaggtattttccctctttccacttccaatcccctttaaatcttgtaaaaatttcgttgtaggggaagattcattcatgtctttactcattcaacaaacgatgtcttgctgggtgccaggatttcttatgcaaagaggaaatgacagtccttgacttctaggaacttaaagctcagctgggaatctagatagaaactggcaggcattttaattttacagattgatggggggggtggtggagaggtaggagtataagtttgtattaaggaaatgtggaggagagacagtttgaattaattctagggaggagtggtggtcagggatttgagagatgtaccttcaaggctttctagggagttttccaggtggacaaagtgggaaggcattcttggcagagggagcagattcagcaaaggcagggaagcatggaaggatctgacccactggttgtggctgttgcctagggagcttgggttctcaatgtcacttggcactatttgaacactagaggccgcatatttcttctacacacattatcggaagaatcagagagacgggggaattacctctcaatttgtacacttaaagtatcttgtagcttgagagggtataagcggtagctttctggaggcagccctctgattctgtgcagaaatcatttccacatcatccatccaccctcttcttaggtaacaaaggctggcttgtgattatcagcatccaaacagctgcgttgaaagtttctttgtcaagtgggacaattgttgtctgggctgttaacagtcctagatgaaataaacatgtggttcacttagtgagctgctcagatatcaccggcttttaatggaactgagtagatgatatcaggcacattttaattaaagcaagactgcagtgcagacacagttgcatatgaaaagatctaatgataggtgtcatgaggagctgcttaaatctgccttgttcagagaacttgttttagagtgcaaagtggagtcaagacgggaggtgccattctccagttcttgttatttctggttgagaaataattcagagattttcaggtacatcactaataatgaaaatttagaaggctacaataatagcagtaataacacactatctctatgagttttcaccaatgctttggcagtgtgaataattgaaaactcaataattattcccacattgctttccagtttgttttggtcaccagggcagagggtgaagggagtacctacacctgcaaagcccctactgaccaagtgaatgtcttttgctgccacctgctggaaaggagagaatttttttttttttttttgagatggagttttgctcttgttgcccaggctggagtgcagcgacatgatctcggctcaccacaacctctgcctcctgggtttaagtgattctcctgcctcagcccccccccccccccccgagtagctgggattacaggcatgcaccaccacgcctagctaattttgtatttttagtagagatggagtttcttcatattggtcaggctggtctcgaactcctgacctcaggtgatctgcccgcctcggcttcccaaagtgctgagattacaggtgtgagccactgcgcctggccaagagattttcttttggaaggaactctcaggtggatcattaattatgaattgaataatggaactgtgaacatgagcccccagcctccaaggatcatggaaaatactggccagcttggaacaggcatagagcatattcttcaagaaaattgcttttggggtattaaggaccttcgtaggtgcccaggggcccaaacctgattaagtggttgtgaaattctgtggttaaatgagctcttggagcatttttttagtctgcatggtccagaggaaaacagcttccaccatggacaatgagcaggagtaaatttaaagtcagccagacccaggaggatttgctggaaagcctatgtctgggaccccaaaggtgaactgagtgggctgtgggcccgagcattccctgggtgggggtgaggagcagccaatagcagcagtagcagcaggtatctttgttagggtggagtttctgaatcctagtcaggcctcaagtgcctctgtgacattgacatgctgccttccaggtttttaaaatatttcttccccaggagcttttcatcttgcttaattgtaattcccaattttagccatttgtagagccgttatgtccaaagtagagaactttaattgagtttcctaggaaagggcaggagctccatgcttggacaagaagcagaaacaatacattttttttttttatgagaccacactcacactacataaggttcaagacagcccatgtcaatgctgccttattaataggttttctgattccctaggcagtatgcaaaatgctatcctttatacatcctgctatgggcacgaggcattttcatcctggtggggaccaattaaaggcagagaagaaaactatccagaagcctaattgatttctctttttttggctctgtttttatgaggtgttttcataataaaagcaatacacttatcttaaagccagagaagctccttcacttttgagttgcgggcagggagttggggagcgaatatacatgtcatatatggattttactagcaaacccagcgtgagaggcccttctaagtcacttgggcatggataagggctgggaggaaaggggccatctgtaccttttttatgattccagtggaattgaggaccagggagctggagtggtctggagaactggtcttattaaagacagatgaaacaacccccagctgggcaccacctatgtgccagatggagctgttgaagtgtgaatatagtttccccgagtcctcatgagtctggtgtaacaggtaccagtatctttttacacacggtaacccaaaacatgaaatttcctacagcagaagatatgaagccacccgtgttatcgctgatatggagaactagagttctgaagtctctgcttcagcaatcccttcagggaggcaggtattaacgttcctattttatggatgaggaaactgaggcttgataaatgaatgcttttcttaagggcacagggttagtagagggaagagactggactgaaactggatctcagtttagtgttgtttccacaatactttctggattgagggcactgtgttctcatttgggggtggggattcaaggataccattggggtgttctgctagttctacagagtttgtttgggtggttgaagccttgcccaattaattgcagggctcttagtctgggagatttgagcgtcttaaggatgccatcgtagaaggtctttagtccctgcatcggtcaatattgtcataataattttgtataacaaataaccccaaactcagtggcttaaagcaaaccattgattttggttcacatatctgtaaattgtgtttggggttggcttatctaggctgcatttggctgggcttggtttcaaactcaggtaggctgcccgctccacatgtctaggtctccttggaccagtggaccagccgggacatgttcttatcatgatgtggaagtagacgagaacaaaccccactgcacaagcatattcaagtcgctgcctgaataatgttactaacatcccaatggccaaaacaagttacatggcttgcctcaaaatcaagagatggggaggtttactcccattgtagtggaaggaactgcaaagccactcagtaaaggctgtggatatgagaggggtaaagatttaaggccaatgttcagtcaaccactgtccttttggaaagtttcctgggcttgcatgtcatccgtcatctcatactatccccagatatgcatattgctcagagttcattgcacccaaagtattgatcatgcatcaactcattagataatcaggtcttaagttgagagcctgcctgccatctgtccaggcctgtgaaaggcacttgggcgacaggggtgcttccttcttcttgcgtctggtgaagggcacgttccccagaccacattccaaattcctggccagagaaacaccaacttggaggtcccctgaaatttaatttctgcccttaagcataaaccttagaaccctccaattatatctcagaattagaataacatccaagctccttttgggtcacagggcttatatgatctggcccttctctctctcccactttggcctctcttcttttttcttttcttttctttttttttgatacagagtttcactctggcacccaggctggagtgcagtggtgctgcaggatctgcttcctgggtgcaggtgatcctcctaattaactgggaccataggtgtacgccaccatgcccggctaattttttgatctttttgtagagacatggtctccctatgttgcccaggctggcctcaaactcctgagctcaaacagtcctcctgcctcagcctcccaaagtgttagaattacaggtgtgagccaccgtgcctgggtggcctcattttctacttctctacccctggcccattcagtttctgccatgctagccttttttctgttcttaggacactcccagtttgttcctcgtttgcatgcacccttctctgcatgtggaaagcttcctcccatcttgccttttctagtcattcaagtttcagcttgaaagaaacttttcaacccccctttctaaagtaggacccccccatccaagttgctttctatcccattactctattttcttcatggtgtttattgccatctcagattatcttattcatttgtttattttttgccctcccccaacctaacccacaggaatgcgagctccatgtgtgtgctatatagtaagcactcagtaatacctgttgaaaaaattatgaaatgaatgaatgcagagtgaatggaaggaagacatctttgggtcaactggaaggggaaaacttaaatcttcagttcaggggacaaggggaagtctgatagaaactgagaaggcagttatagacattttgtctgccttggcaataaccggtttcagctctaaagaggccttcctgaccaaccgtctgttgacagaagcctagcaggtcctgtttcctaacaggaaaagagtaaggaaagagtagatttccttctccaaggctgtaggaccaggggttaaggtgggaggacaggtgaggtggtgatagcttatgatgtcccggtgaacattcacgcagtgggtacaagccctccaaatcttgtctcagtgactgcattaccatcagatgagagttgacagctgttgctgattaaaacatttccaacagcacagtcaaaattgcactattgagatggtatgtgtagatagacacagcctttatgaatggcttaaacatagccccttagagtgatcactagccttattaatacatatagttggaaatcactttgcaatcatgaatgaatcattgctcagagcaccccatgggtgagaggcatctttagggatttgtctttctcaaacaagggaagaggaggctcacggctgtatttctctgcattaaggttctctaaaaagagttatcagggtatctggctttccatccaggaatccccttggatggaaatatatatccattattccagggattctccttcctggccagtccctctgccacccttcttcaacagggacagggtccttttccacttttttcctccttaacacaggtgattgtgactgattaattagggaacactttgtggaggtgtttactggtggtggtgggtcagattttgctactgcatcagtctctgaggcaggtggatcagggccacaatcttgtatccgcagtcaccacctctataaagcttggaaacccagtttcttcataactcatctgacagcaaaacctatcctgagttgaactcatttcatggcaagacttgatctaaactgatatcaacctatttataatctttatttatgccaattagagaagtatgtcatactttttgcttcagaaatgttgtacttgattatggggttctgagttagactttgctaaaaatgttacataaaatgtagtatataggccatattacctttctaacacatggcaccttctgaattctgaactatatttaaccccaggagttttggataagaaattatcaatccataattgggggtggggttgggggaaggaacaaagaaactacagtattagcggggtaagggagcaaagatttgcttttcttttccctccatagacaaagactctccaagcactcatcattggcttccttgtattccctgccactccccgactctgtaacctctgaatgctagtaacagtctgcattttaagcccaaacaactctttgttcctttccagtggtgggctttgggatggaccctgaccttcagatggatatcgtcaccgagcttgaccttgtgaacaccacccttggagttgctcaggtgtctggaatgcacaatgccagcaaagcatttttatttcaaggtaaaggcacctcctttcttgcatggtggcagaggttggggaggagggtctgtctggggagtgctcatttgttgtgtgtttgtctggagatcgcctttgctatttctcttgtgttgctgtcttgagtgtttagatatgcagggggtattattctgagggcaggagggaggcattagagatcatggtggtaaaatatttggtttggcagtgaaatatttccttgattttggtgaggatctaaagtgggatggatttataacatacttgaaagccattgaccatctatattattgttacaggacatttctctagctgttatcaatatctttgcctgtacttacacctatacctatatttacatctttcatctagtggataggccataagaacagaggaaaacttatggctgcattctccttgaggtagagcttactcagttctgcccactataagcgggaccacaattcattaaatcattcagcaagcatttatagagaaaacatggtgtggttcttagaagcatggtgtttctcacaattctggaggctgtgaagtccaagaataaggcatcagcagatttggtacttagtgggggctggctctgtctgcttccaagatgatgccttgttactgtgtcctgtggaatgctgtgtcctcaaatggtggaagggatggaaaggcagaaaaataactagctagtttcctttctaaagacactaatccattcacaagggcaaagacttcataatttaatcactgtctaaaggccccacctcttaatgcactagggattaagttttaatatgaattttggtgggacacagatattcaaatcagcaaagtgataggtcaacagatacttaaaaaatggataaaaagcctggtataggaagggatggggtctcacagcattctgaatagaggaaatagtatatataaaggtaaggcaaaagccaacaaaaagactttcgcatggcggaagggtggtgaatgtctagaggggtagacagagactaggttacatgggaccctgttgtcagagctgatattctgctgatatgtgtgggtttgggtgtactgatgatttatggtcagtgtccattttgataggtgggatgccatgtactttttgttacctgttttaagtattactcttgcccataggccacttaacagctttgtgctttactctcagagaagtggggcctttgtagaggtttaaacagggaaatgaactgaccagataccatagtaaggcagcctggatattcctctacgaaaatgtctggcagggttcttttaactcagccttttatgatgataacaaaaggattattttagcatggctgaaccaacataatagaatgagatttacatatttacagtgcagataacttaagacttgttagtgatatgtagcaaatctagagttattatgtaattatatgtaacaagactatggacatactaattttcacttactccttactaatgaattggtgaagtatgtaagctgggcatggttaaaagggtagactgaattactttgtttttgcattgtgctatatctggccagtcactgttgagagtccatacctttcttgatctgagtcttaatccatcatagcaacaactcatgctgatactttataaacaaagttgctatggaaacctggctggtctgtaagcttcaagagggcaggagtcctgctgacctagatactcctagatcctcagggccacctactgtgcatgaaacacagtaggtgatcaataaacattttgaatggaattaaaatttcttttgtactatgtaccttataaaaaacttactgcttgctttagttactactattcattccacaagtgtaggtcccctgggctggaactctactttctaatctgtgcattctctgttttggcaaccatctctgtgttgtctgcccggctacaacaactgggagggattttcagcttctttggtgggaagagtaacttttttatggaactttgacagagaaggcctttcgcttatatcccctgtgattatattcggctcacctagaaattcaggataatctcccccatctcaatatcagtaacttaatcacatctgcaaatcccttctgtcatgtaaggtaacataattatagattctgtcaattagcacctggacatttttggggagccattattttgtttgccacaaagtctgccctctagatcccaaggattcatgtctgtcccacatgcaaaatacattcaccccatcgcagtatctcaaaaagtcttaatccatcatagcaacaactcaaagattgaaatctcccttaatctcagctgaaaaattctacatctcattaagtaatctaaatcagatatgggtgagacagtgggtataatccattttgggggaaaaatttctctttattgtggtcttatgaaactggaaaacaggtaatctgcttccaaaatacaatggcgggacaggcataagataccagttatagatatttctgttccaaaggaaggaaatggaaagaagaaaggagtcactggtcccagacaattgtgaaattcagcagtgcaaactccgttgggttcaagtcttagaaataatcctctttggttttggctctgtcttctggcttgtggctcattcctctgagacatcgttcatttttcatgaaggatagcatttgtttgcagttgagtagtttaatcagcttgtttcctgcctgtaaagttttggtggtttgtcagacatctttcattgtgtcctctctcagtcttcttcagtccaaattggcagggtttctgttggtatagtattctcaagaatcttgaaggtctcctgtccactagacaagcagcttatccacagatctgtcctagataatgctgtctctattcctgactactactgagatggctgaagggaatccatgattcacatactgatctctacaaagaggcctctaggtgattgaatattttgatcttttgatccttccaaggcactctcaaaaagttgtttaaccacaacgtggctctagagcaggctttcctgatagtgtgtctccttttattgtgttttgcaatctggataggctgagaactctctgaattatcaagtcctgactcctttttgcttaacagctcttctctcaatcccttacttttctctcacattttgccataaatagcaagaagaaatcagactgtaacttcaacactttgcttggaaatctcctcacctaaatatccaagtttattttactttccacataactacaggacaaaatgcagataagctttctggcatcatgtaacaaggatcctccatctttgggtattcattcaataatatgtccctcatttccttttatgtctttgctgggaccacttttaacatctatatttatttttaactccctgttgaaggcaactggccttttctaccaagctccttaaaaattttccagcctattatccaatgccgaagcctcttccacatttttaggtatttgttacagcagcaccccacttccagttacctaaagtttgcattggtttcttactggtgctataacaaatttctacaaatttagtgacttaaaataaatttattatcttatacttctagaggtcataagttcaaaaaagagatttatggggctaaaaccaaggtgttagtagggctgtgttctttctggaagctctactgaatattcattcagttcattgcctgttggagcttccagaaattgccacattccttggctcatggctgcatcagtccaaggtcgacttctgttgtcacatttccttctctttgattctgtcatcatattatcttctctgatattgaccttctgccttccattttcccttataagaaatcttgtgattatgttggaaccacccaggtaatctaagtattctcatctcaagattcataatttaatcacatctgcaaaatctttttttgccatataagttgacatattaacaggttctggggattaaaatatgaatatcttttggggcccattattctatcatagaatggctaagcattgttgggcataaatatgaacataatgatgtttcctgagtactacaattaaatcttcctttttctagtgcagtatggtccaatcgaaatgtattgtgcgctgcatctttaattgtaacatctgtaagagccacattaaaaaagtaaaaagaaacagataaaagtaattatatattttatttaacccaacatataaaaaatattatttcaacgtatggtcaacccaaaaatatattaataagatattttactttttttaaaaaacaaggccttcaaaattaattggtattttacacttaaaacacattccgatttgcatgctaaatttttaatttgtagtaattgatatgtatgttgatttcataaaatttaaagttaaaaacgtagattcatcaaattattctgtacagacaattattagattaaaaaattaaacaggtttattgaggtataattatattataataaactgtgtattcaaaatatacaacttggtaattttaatatacaaatatacctgtgcagccatcatcacaatcaagaaaaatgaacatagttatcacccaaaaagtttaccttttttcttttataattcctcccacttacctctcccaacctccacttctaggcaattattgatctgctttctgtgactatacactaatttgcattttctagaattttatataaatagaatcatacagtatgtgcttttttggtctggattcttttactcattatgggtattttgagatttatacatattgcagcatgtaaagtgcttttcttacaggcaatatatagttggaggctaactttttatttaaaccaataaaataatttgtgttttttcatcagcgtatttagactatttacatttaatgtgattattgacatgattatatttaaatctatcttctcgtgatttgtttcctacctgttccatgtattctttgttccctttcccctctttatgtcttcttttggattaattgaatattttttacaattttgttttatctttgttggcttattagctataactctttgttttgctatttagtttataaactcctgactacattgttatttttatttaatgagtcaattatcttttaagcagatttagataataaaatcaattatacgtttaactcatgtagtttctttttttccccaacttttgttttaggttcagggggtacctgtccagatttgttatatgggtaaattatgtgttgctgaggtttggtatacaaacgatcccatcacccaggtagtgagcataattccctataggtagtgtttcagcccacaaactccctcccactctcccgctggaagtagtcctcagtgtctatttttcccatctgtgtctgtgctcttgccgtttctgttttctgtgttctttgttcttttgtgtaactttatatttccacccgatattattttcatcctgcctgaaggactttctttaacatttaacatttctttcttcactaatatttcttatagtgcaggtctgctggtgatgaattcttttagattttgtacatctgcaaaagtctttattttgcttttatttttgaaatatatctttgctaagtataaaattctgtgccgacaggtttttgtccccattctttaaagatgtcttttcacttatattgtttccaacaagaagtctgttgttattatatttttgtccctctggagacaagtatttttccctgcttttaagactttctctttatcactgattttgagctattttattatgatgtccctggtgtggtttttgtcatgtttcttgcatatgagatctactgaacttgggaaaaatttggccattatgtcttcaaatattttttctgttcgttcttttttttttttttctgtagtgactacaattacatgtatatatttgactgcttaaaggtgttccataactaattgatattatatttatttaaaatatttactaaggccaggtatgggggctcacacctgtaatcccaatactttgggaggtttgaggcaggaggattgcttgagtccaggaattcaagaccagcctgggcaacatagtgagaccctcatctctacaaaaaataaaacaaaaattattttaaaaagactaaaaattaaattaaaaaaatttaaaacattattcttttttctctctgtgtataatttttgatcatttccattgttatgccttcaaggttacgaaacttctgtattatctgtcattactatcacttagtgtattttttacctcatatattgtagctttaactctgtaagttcagtttgactgtgtaaaaaatcttccatgtctctacctaactctttgaatatatgaatacagttctaataactgttttaatgttgttaatcgaaaattctaataattgtatcagtgctgggccaattttgattgactgatttttctcctcattacttcttccttgcatgcctcttaatttttgattaatggccagtcattgtgaattttaccgtctttggtactgagcttttgtgtatttttataaatacctttgagttttgttctagtaactgggacacaattcaattcttttagatcctactttaaaggtttgttagatgggcccagagaagtgctagtgctagtagttagggtagaactaattatttaccatcactgaggcaagatccttcagcgtactctacccagtgactgataagtcatgggattttccagtttgactggtggaaataggtactatttctggccctcgtgtatgctggatactgttgccttttgggtgggtctttcctgtccttgggtaattttctaacatgtatgcacaggtcagtactcagctgaatactgattttgggtagatctgtgtttccgtctttgtgctgctatcttctcttgtgtatactgtcctgtgaaatctaggtgccttggtctccccagacttcagctttctctcctcaactcaaggagattgcctgagttctgccttcctatgctatgcctggaaactccctcagagcagtaagctatggtaattatagggctcatctcttttgtatcccgtctctgaaggatcactgcccttcattgactgatggctagtgtcttgaaaactgtagtttcatcaaatattcactataaatctaaattaaaattaattaaaattatgcaaaattgaaaattcatttcctcagccacactagccatatttcatgtgctcagttgctttttgtggctaggggttaccatattagacagtacagatctggagatgctcagaaattttactgtttcaccacagctctgttaatataggcagacttcaaaaatcctgtactttaaggttaatgtatgatagcaactatcaagctacttaagctctccatctcaaagtacttccatttactcactgataaggtgggggtaataatagtgcctactatatatggttgtagtgagggtgaaataatacatacaaagtgctcgaacagtacttggtggtgagctctcgttaaacttgagtctatacattttaaagtaatagggtatagctttggctttttttccctcatgtgtatcatctgccttatgcattattgatgtcagattttaacccagaagtagattaggatagtggaaaaagcagaagactggggaagggcagaagattaaaatcagcattttttgttttaatttatttcatcctcactactatgatataaaataggtactattattacccccttttatcaatgagtaaatggaagtattttgaggcagtatttaagggtgacagtggatacgtctcttaatgtattcaagcctcagtttccttgtctggaaatgggacgaataaaaagactgataagaattcaatgactacatatgggaaagcacttcaaaagtgcaaagtgtaaaaaaaaaacagttcattattctttccttcatttatttttatttctcctaatatttcaccatctgatgtccagctgtgaattgtgtgttcagagaatgaaaaccttcatttcagtgctagcctgttaataatatcgatacatttaaatagaaacctcacttaactgggaacatttctacagtaccaattgcaaagcctggtagcatttattttggggctagccagcttttgagttatctttgttactgctgtctttgtagagcacaaagaattgagtaagtaagatttttattttcttcttgcttgaaataaatttttttagggtgttaaaagaaaaactttagacaaattaaatttaacagaatttaattgagcaaagaatgattcgtgaatcaggcagcccccggaaccagaataggttcagagagactgtcactgccgggtggttggagaggatttatggacaaaaaagggaaagtgatgtacaaaaaatggaaggaggtgtggtacacaaacagctgaatttgttgtagcttggcatttgccttgttcgaacatttggccactgtggctgaaactcggtgatcaatatgagtaggttacagtctgtttacaccacccagttaggttacagtttactatgtatggagaaactttcaggtggaatttacaaggaggaagctttaggctaaacttaatttaacaattctcccctttcagtgccctctccaagtagagaagctgaccaaaactctaggcattgaagtgactctgtcattattgtaaatatatttagttggtctcaaatatcactgggaaatagtagaacatgtgtgtataggggcttcagtttttttttttttttaatagaggttagagtagaggggtcccttttatgctggaatctcctgttttcaggagagaaaaaaacatctggtctgttttgggatctctctctctctctttttttttttttcaaatttttagtttgattatgttatatttagtatgagtgacttcattttggtttgatctgatctggtctcttggggactagtatatgagttttgtctaaaagaaggcctctcgtaattttaataattcttttagtgagattttttcttattatttaatttttatgagtacattattacatgtggtattgaatattttgatataggcatacaatgtgtaataatggtcagatattaatgtagatgagtgtgaccaaaactaaggacttcagtgctatttttgttattattttgaatttttggtctcagtatgtcatatgtcatgtggtgtctttatgactatgtatttttgtttattgagtttttgtagtttcagtagaagacagactatttgacattttatgaatggctatgtataaacatttacaatttttgggagaatgtagtatgccagggagattggtattatgaatattaggaagataatgttaagaatatggagtatgttttttggttaaggtctttatgaactaaactaaatttttttttttttccgtgacagttttgctctgtcacccaagttgtagtgcagtggcacagtctctgctcactgcaacctccgcctcctgggttcaagcgattctcctacctcagcctcctgagtagctgggattacaggtgctcactaccacacccagctaattttttgtatttttagtagagacagggtttcaccatgttggccaggctggtctcgaactcctgacctcaactgatctgtccacttcggcctcccaaagttctgggattacaggcatgagccaccatgcctggccttctctaactaaaattaaataggtcaaagaataagttagacagactatttgttttaactaagtagtctgttttattaatctcgtataattgaatccctataatgcttaatgtgtaacaagaagtatcactaaccatacagattttttttcctgtttaataagtatgcaatttaaagtaaattatttattttatttagtatacttttagtaagagaatttaaagaagtccattgtgtaaccatagttttcgtagtagaatttgttatagaggctactatgagagagaactttttttttattttttaaattaaaaaagttttctctttgcttttaaaaataatttcaacttttattttagattcagagggtacatgtgcagatttgttacttgggtatattgtgtgatgctgaggtttggtgtataattgatctggttacccaggtagtaaggatagtacccagtggtttttcaacccttacccatcaatatcttccccctctcgtagttcccagtgtctgtagctgccatctttatgttcatgtttatccaatgtttagctcccacttataagtgagaacctgtagtatttgattttctgtttctgcattaatttgcttaggataatggcctccagctgcatccatgttgctgcaaagaacatgatttcattgtttctttttatggctgtgtgatattccttggtatatacatatataccacattttctttatccaatccaccattaatggccacctagattgattgcatgtctttgctattgtgaatagtgctgcaacaaacatacgagtacatgtgttttttggtagaatgatttatttacttttggatatatgtattatatacccagtgatgggattgtgagtcaatggtggttctgtttcagttctttgagaaatctccaaactgctttccagactggctgcactcattcacattcccaccaacagtgtataagtgtttccttttctctgcagcctcacgaacatctggtgtattttgactcttttgaacatccattgtattttgactctttagtaatagccattctgacaggtgtgagatggtatctctttgtggtttggatttgcatctctctaatgatgagtgatgtggagcgttttttcatatgcttattggccgcttatatgtcttctttcttcttttgaaaagtgtttgttcatgtcatttgctcactttttaatattgttatttggtttttgcttgttcaattgtttaagttccttatagattctggtcttagacctttgttggatgcatagtttgcaaatattttctctcattgtgtatgctgcctgtttactctgttgatagtcttcttttactatgcagaagccctttttttattttttattttttattattattatactttaagttttagggtacatgtgcacaatgtgctggttagttacataggtatacatgtgtcatgctggtgtgctgcacccattaactcatcatttagcattaggcatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaattgcattcatgtccccacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttatagtcctttgggtatatactcagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatagccattctaactggtgtgagatggtatctcattgtggttttgatttgcatttctctgatggccagtgatgatgagcattttttcatgtgtcttctggctgcataaatgtcttcttttgagaagtgtctgttcatatcctttgcccactttttgatggggttgtttttttcttgtgaatttgttggagttcattgcagattctggatattagccctttgtcagatgagtaggttgtgaaaattttctcccattctgtaggttgcctgttcactctgatggtagtttcttttgctgtgcagaagctctttagtttaattagatcccatttgtcaactttggcttttgttgccattgcttttggtgttttagacatgaagtccttgcccatgcctatgtcctgaatggtgatgcctgggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttctttctgagggctctgttctgttccattgatctatatctctgttttggtaccagtaccatgctgttttggttaccgtagccttgtagcatagtttgaagtcaggtagcatgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttgtttcattgagcagtggtttgtagttctccttgaagaggtccttcacgtcccttttaagttggattcctaagtattttattctctttgaagcaattgtgaatgggagttcactcatgatttggttctctgtttgtctgttattggtgtataagaatgcttgtgatttttgtacattgattttgtatcctgagactttgctgaagttgcttatcagcttaaggagattttgggctgagacaatggcgttttctagatatgcaatcatgtcatctgcaaacagggaaaatttgacttcctcttttcctaattgaataccctttatttccttctcctgcctgattgccctggccagaacttccaacactatgttgaataggagtggtgagagagggcatccctgtcttgtaccagttttcaaacagaatgcttccagtttttgcccattcagtatgatattggctgtgggtttgtcatagatagctcttattattttgagatacgtcccatcaatacctaatttattgagcgtttttagcatgaagggttgttgaattttgttgaaggccttttttgcatttattgagataatcgtgtggtttttgtctttggttctgtttgtatgctggattacatttattgatttgcatatattgaaccagccttgcatcccagggatgaagccaacttgatcatggtggataagctttttgatgtgctgctggatttggtttgccagtattttattgaggatttttgcatcaatgtccatcaaggatattggtctaaaattctcttttttggttgtgtctctgaccggctttggtatcaggatgatgctggcctcataaaacgagttagggaggattccctctttttctattgattggaatagtttcagaaggaatggtaccagttcctccttgtacctctggtagaattcggccatgaatccatcgggtcctggactctttttggttggtaaggtattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcagtttatgaattttgttgatcctttcaaaaaaccagctcctggattcattaattttttgaagggtttttttttgtctctatttccttcagttctgctctgattttatttatttcttgccttctgctagcttttgaatgtgtttgctcttgcttctctagttcttttaattgtgatgttagggtgtcaattttgggtctttcctgctttctcttgtgggcatttagtgctataaatttccctctccacactgctttgaatgtgtcccagagattctggtatgttgtgtctttgttctcgttggtttcaaagaacatctttatttctgccttcatttccttatgtacccagtagtcattcaggagcaggttgttcagtttccatgtagttgagtggttttgagtgagtttcttaatcctgagttctagtttgattacactgtggtctgagagacagtttgttatagtttctgttcttttacatttgctgaggagtgctttacttccaactatgtggtcaattttggaataagtgtgatgtggtgctgagaagaatgtatattttgttgatttggggtggaaagttctgtagatgtctattaggtccgcttagtgcagagctgagttcaattcccgggtatacttgttaactttctgtctcgttgatctgtctaatgttgacagtggggtgttaaagtctcccattattaatgcgtgggagtctaagtctctttgtgggtcattcaggacttgctttatgaatctgggtgctcctgtattgggtgcatatatatttaggatagttagctcttcttgttgaattgatccctttaccattatataatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaactggagcatttagtccatttacatttaaagctaatattgtcgtatgtgaatttgatcctgtcattatgatgttagctggttattttgcttgttagttgatgcagtttcttcctagtctcgatggtctttacattttggcatgattttgcagcagctggtaccggttgtgcctttccacatttagtgcttccttcaggagctcttttagggcaggcctgggttgacaaaatctctcagcatttgcttgtctgtaaagtattttatttctccttcacttatgaagcttagtttggctggatatgaaattctgggttgaaaattcttttctttaagaacgttgaatattggcccccactcttttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcttggatagtatcctgcagagtgttttccaacttggttccattctccccgtcactttcaggtacaccaatcagacgcagatttggtcttttcacatagtcccatatttcttggaggctttgttcgtttctttttattcttttttctctaaacttcccttctcgcttcatttcattcgtttcatcttccatcactgataccctctcttccagttgattgcatgggctcctgaggctctgcattcttcacatagttctcaagccttggctttcagctccatcagctcctttaagcacttctctgtattggttattctagttatacattcgtctaaatttttttcaaagttttcaacttctttgcctttggtttgaatttcctcctgtagctcggagtagtttgatcatctgaagcctaggtcctccttgttaatttttgtttttcttgtgattgcttttgaggtactagccataaattctttgtcaaagctgttgtccagaatggtattttctgggttttcttctaggatttttatagtttgaggtcttatatttaaatctttaatccatcttgagttaatttttgcatatagtgagagacaggagtctattttcattcttctgtatatggctggtcagttatcccagcaccatttattgaatagggggtcctttccccatcacttatctttgtccatttagtaaagatcagatggttgtaggcgtgtggttttatttctggattctctattctgttctattggtctatgtgcttgtttttgtactaataccatgctgtttactgtaggttactgtagccttatagtatagtttggtaatagaaaatatagaagtggggtaatgtgatgtttctgtggggtaatgctctttctgcttaagattgttttggttatgtcagctcttttttggatccacatacattttagtgtaggtttttttttaattctatgaaaaatgacattggtagttttataggagttgtgttgaatccatagattgctttggattatatggtcattttaatgatagtgattcttctaatccatgaacatggaacgtttcttcatttacttgtgtcatctatagtttcctttagcagtgttttatagttctccttgtagagagctttcacctccattgttaggtgtgtttctaggtattttatttttttgtgcatatattataaatgggactgtgtccttgacttggctctcagcttgaacgttactgttatataaaaatgttactgatttttatacattgattttctctcctgaaagtttactgaagtcgtttatgagttccaggaaccttttggcatagtcttcagggttttctaggtagagaatcatatcatcagtgaagagggatatttggactttttcttttcctatttggatgcctttaatgtcttcctgttgcctaattggtctgactagcacttccagtactgtgttgaataggagtggtgaaagtagacatctttgcctgttccatttctcaaggggaatgctcccagcttttgcctgtccaatacgatggtggctatgggtttgcatagatgacttttattattttgaggtatgttcctttgatgtttagtttcttgagggtttttatcataaagagacgttggattttatcaaaagctttttctgtgcctatttggatgatcatatggtttctgttttagttttctttatgtggtgaatgacatttattgatttgtgtatgttgattacatccctacttgatcatgatgaattaactttttgatgtgctactggattctgtttgctcgtattttgttgaagaattttgtgtctatgttcattagggtagggatgttggcttatagttttagtttttcattgtgtctttgttttttgataacagggtgatgctggcttcgtagaatgagttaggaaggagtcctccctcttcaatttttcacaatagtttcagtggaattggtaccagcttttctttgtacatctggtagaatttggctgtgaatccatctggcctgggctttttttttggtagataggattttttaaaattacttattcaatctcagaagttgatattggtttgttcaggggttcaattccttcttggttcaatcatgagaagttacgtgtttccaggaatttatccatttctggatagattttctggtttgtgtgcatagagatgtgtatagtagtctctgaggatcttttgtatttctgggggattggttgaaatgtcacctttgttgtttctgattgtgcttttttggatattcttttttccttgttaatctagctagtgctctattgatcttgtttatactttcaaatacccaacttttggtttcattgattctttgggtggacttttgagtcttaatttctttcagttctgctcttattttagttatttattttcttctgctagctttggggttagttttttctttttctaggagtgaaaaacactaggtttggggtcatttttgtcttgttactctgggtgtgatgttagatcattgatgtgagatctttctaactttttaaggtaggcctttagtgctataagccttcttcttaacactgcttttgctgcagagggatatatttaacattattgccacatttattttaaactatgccaaaagggacctaataaatgatgtctatctagaagagggaaagcctttggtaatgtttttcattttttaacctattataggttgtaaggagtggacttatgttttgtttgtgcctgattatgaagtaataaaaatactactcaatttttttggtctacatcttaccatttattttttgtcatctgacactgtcacaataactttagaaaaattacatttaatgaagtttaagcaaagaataatttgtgaattgaacagccaccctcctcaactccaaacaaccagaataagtctagtactgtcacgtggttggagaggatttacagacagaaaaaagaaagtgatatacataaaacaaaagtgaggtatggaaatagctgaattgtttatagcttggcatttgctttatttaaacactgtttaaacagttggctgcctttggttggctaaaactcaatgattggtttaagagtatgttacagtctgtttacacatccagttaggtttcagttcactatgtatagaaaaacctctaggccaaacttacaaggaggcaactttagaccaaatttagcaacaaattagcgatggtgccgggaaaagaatgagtgtctatgggtaaggctggcacagatatttaagttgaaaactattctaaacaccagcattagattttcaaaaatcattttggaacacctctgctttgctttgagtggtactcagaggagatctgagagtttgaaactatacttctccttgactgacagtgtcttagtgttaagtagttgggaggatgtgtcatcggtggttcatttataaaagtgaattagaatatgcatgagtgcaaattctttaatatgttgcttttttttttttttttcctgccaggaaagtgctacctttcaggagttctgcttcaaaagagtttctaaaggaagaatagatagtatctttcaagtagcttgttttatgtaacaagatagaacaaaggctaatgtagctgcttccaggggaagattcaggaatttagcacctgtttgccttctaggctttgagctacatgttgtggaagacctagatgaataaggtaaagatctcagcctcaactacgttacagttcagaagggcaaatatgacctctggcaccctaattcagaataaaagagaactggcttgccgtcaagtgtggataaagtcttaagagtgttcaagaaagaaatttcttactggatgacctgggaaatggtctttgggggaggtggcacctgaacagaccttggaagatgtacaggagttaaatatgtggtttctttttcataggaacactgcccatgtgtaaccattttcacaaaaccgtgcttgaggtttgagctatagctgttaatgctcagaaaatctgagtaagatggaattacccaaagggtttgttaaatgccgatcttccagatttcctgccacccactgttgcccaagtctgaattgttttttctgttgattggatgagcctagtcactaattacctcagggagcatttactagtcaaccttactttgagtggagtgatttagtataactttgcatttaatcaattagccgagtgattcaattcacataccagtgtctcccaaatagaagtgtttttgctcttgccaaataaaagctcaagctagccgtgagagtggagtggtttttcaaatctctctctggggcaaattaacacctgcactggcttattctggaaaatcattaaatggctttgtgattatcgtagagcaaataaactgtgtttattctccaaatctgtccacttctaccgtctgcactaaaatctcttctctcagtcatgctccttctgccatcaaatagtacattaaggaaagcagagatggagagagacagcagagaatgcaaaatcataagaattattttagaaactatttagctatatgggccaatttcatctgaacaaattaaccttgggcaaattgcttcatctcttaaatgtgttgcctcttcagacattgaataataatgataatgtccaaggtagaagatatttttaaggattaatttagataacttaaattcatggtgtgagaaaaagacattcatattaaaatttctttcaatagtttttggggaacaggtggtttttggttacatggataagttatttagtggtgctttctgagattttggtgcacccatgacctgggtagtgtacactgtacctaatgtgtagctttttaatccctcaccccattcctacccttccccacaagtccccgaagtccattatattattcttttcctttgcattctcatagcatagctcccacttataagttatacaatatttggttttccattcctgagttacttcatttagaataacggtctccaaactgggcgtggtggctcatgcctgtaatcccagtactttgggaggccgaggtgggcagatcacctgaggtcaggagtttgagaccagcctggccaacatggtgaaaccctgtctctactaaaaatacaaaaattagctgggcatggtggcgcacatctgtagccctagctactcgggaggttgaggcaggagaattgcttgaacccaggaggcggaggttgtagatagtggagatcgtaccactgtactccagcctgggcaacagagcaagactctgtctcaaaaacaaacaaaaaaaacaaaacaaacaaaaaagaataacggtctccaactccatccatgttgctgtgaatgccattatttctttcctctttatggctgagtagtattccaaggtatatatatgtatacaccacattttctttttctttttctttttttttgagatggagtctcgctctgtcactcaggctggagtgcagtggtgcgatctccgctcactgcaacctctacctcctgggttcaaacgactcctctgccttagcctccccagcagctgggactacaggtgcacgccaccatgcccaactaatttgtgtattttagtagagatggagtttcaccatattggccaggctgatctcaaactcctgacctcatgatctgcccaccttggcctcccaaagtgctgggattacaggcgtgagccactgtgcctggccacacattttctttatctactcattggtagatgggcatttaggctggctccatatttttgcaattgctgattgcgctgctataaacatgcatgtgcaagtttcttttttatataatgacttttcctctgggtagatacccaatagtggaattgctggatcaaatggtagttctactttagttctttaaggaatctccatactgttttccatagtggttgtactggtttacattcttaccagcagtgtaaaagtgttcccttttttatcacatccatgccaacacctataattttttagtttttaaactatggccattcttgcaggagtaaggtggtatctcattgtggttttaattttcatttccctgataattagggacgtagaactttttttttataaaatgatgctttcattatcagtcaacatagtccttgacaaagcaagcttcattacagaactgtttttagaaaaaacaaaaacaaaaacaaaacagagcttaaaaaacaaaatatatgttaaatggataatatgtatttcaataggctgggtgcagtgtctcatgtctgtaatcccagcactttgggaagccaaggcaggtggatcatgaggtcaggagttcaagaacagcctggccaatatagtgaaaccccgtctctactaaaaatacaaaaattagccaggcatggtggcacgtgcctgtagtcctagctactcgggaggctgaggcaggagaattgcttgaacctgggaagcagaggttgcagtgatccaaggtagtgccactgcattccagcctgagcaacagagtgagactccatctcaaaaaagacaaagaaaaaaaaatatatatatttcaataaaattttttttattatacttctaggatacatgtgcacaacatgcaggtttgttacatgtgtatacatgtgccatgttggtgtgcggcacccattaactcgtcatttacattaggtatatatcctaatgctatctgtccccccttcccccaccccacaacaggccccagtttctgatgttccccaccctgtgtccaagtgctctcattgttcaattcccacctctgagtaagaacatgcggtgtttggttttctgtccttgtgatagtttgctgagaatgatggtttccagtttcatccatgtccctacaaaggacatgaacttatccttttttatggctgcctagtattccatggtgtatatgtgccacattttcttaacccaatctatcactgatggacatttgggtcagttccaagtctttgctattgtgaatagtgccacaataaacatacgtgtgcatgtgtctttatagcagcatgatttatagtcctttgggtatgtactcagtaatgggatggctgggtcaaatggtatttctagttctagatccttgaggaatcgccacactgtcttccacaatggttggactagtttacagccccaccaacagtgtaaaagtgttcctatttctccacatcctctgcagcacctgttgtttcttgtctttttaataattgccattctaactggtgtgagatggtatctcattgtggttttgatttgcatttctctgatgctcagtcatgatgagcattttttcatgtgtcttttggctgcataaatgtcttcttttgagaagtgtctgttcatatactttgcccactttttgatggggttgtttgattttttcttgtaagtttgtttaagttctttgtagattctggatattagccctttgtcagttgggtagactgtaaaattttctcccattctgtaggttgcctgttcactctgatggtagtttcttttgctgtgcagaagctctttagtttaattagatcccatttgtcaactttggcttttgttgccattgcttttggtgttttagacatgaagtccttgcccatgcctatgtcctgaatggtgatgcataggttttcttctagggtttttatggttttaggtctaacatttaagtctttaatccatcttgaattcatttttgtataaggtgtaaggaagggatccagtttcagctttctacatatggctagccagttttcccagcaccatttattaaatggggaatcctttccccattgcttgtttttgtcaggtttgtcaaagatcagatggttgtagatgtgcggtattatttctgagggctctgttctgttccattggtctatatctctgttttggtaccagtaccatgctgttttggttactgtagccttgtagtatagtttgaagtaaggtagcatgatgcctccagttttgttcttttggctcagaattgtcttggcaatgcaggctcttttttgattccatatgaactttaaagtagtttttttccaattctgtgaagaaagtcattggtagcttgatggggatggcattgaatctataaattaccttgggcagtatggccattttcatgatactgagtttcctatccatgagcatggaatgttcttccatttgtttgtgtcctcttttgtttcattgagcagtggtttgtagtcctccttgaagaggtccttcacatcccttgtaaattggattcctaggtattttattctctttgaagcaattatgaataggagttcactcatgatttggctctctgtttgtctgttattggtgtataagaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaactgaataccctttatttccttctcctgcgtgattgccctggccagaacttccaacactatgttgaataggagtggtgagagagggcatccctctcttgtgccagttttcaaacggaatgcttccagtttttgcccattcagtatgatattggttgtgggtttgtcataaaaagctcttattattttgagatacgtcccatcaatacctaatttattgagagattttagcatgaagcgctgttgaattttgacaaaggccttttctgcatctattgagaaatcatgtagtttttgtctttggttctctttatatgatggattacgtttattgatttgtgtatgttgaagcagccatgcatcccagggatgaagcccacttcatcatggtggataagctttttgaggtgctgctggatttggtttgccagcattttattgaggatttttgcattgatgttcatcaggcatagtggtctaaaattctctttttttgttgtgtctctgccaggctttggatgatgctggccttataaagtgagttagggaggattccctcttttttctattgattgaaatagtttcagaaggaatggtaccagctcttgcttgtacctctgttagaattcagctgtgaatctgtctggtgctggactttttttggctggtaggctattacttattgcctcaatttcagagcctgttactggtctattcagggattgaacttcctggtttagtgttgggagggtgtatgtgtcgaggaatttatccgtttcttctagattttctagttcatttatgtagaggtgtttatagtattctctgatggtagtttgtatttctgtgggatcggtggtgatatcccctttatcattttttattgcgtctatttgattcttctctcttttcttctttattaatcttgctagcagtctatgaattttgttgatcttttcaaaaaaccagctcccggattcattggtttttttgaaggttttcttttgtgtctctatctccttcagttttgctctgatcttagttatttcttgccttctgctagctgttgaatgtgtttgctcttgcttctctagttcttttaactgtgatgttagggtgtcaattttagatctttcctgctttctcttgtaggcatttagtgctataaatttctctctacacactgctttaaatgtgtcccagagattctggtatgttgtgtctttgttctcactggtttcagagaacatctttatttctgccttcatttccttatgtacccgaaagtcattcaggagcaggttgttcagtttccatgtagttgagtggttttgagtgagtttctaaatcctgagttctagtttgattgcactgtggtctgagagacagtgtgttataatttctattcttttacatttgctgaggattgctttacttccaactatgtggtcaattttggaataagtgtgatgtggtgctgagaagaatgtatattctgttgatttggggtggagagttctgtagatgtctattaggtccgcttggtgtagagctgagttcaattcccgggtatccttgttaactctctgtcttgctgatctgtgtaatgttgacagtggggtgttaatgtctcccattattattgtgtgagagtctaagtctctttgtaggtctctaaggtcttgctttatgaatctgggagctgctgtattgggtgcatatgtatttaggatcattagctcttcttgttgaattgatccctttaccattatgtaatggccttctttgtctcttttgatctttgttggtttaaagtctgttttatcagagactaggattgcaacccttgcttttttttgttttccatttgcttggcagatcttcctccatccttttattttgagcctatgtgtgtctctgctggtgagatgggtctcctgaacacagcacactgatgggtcttgactctttatccaatttgccagtctgtgtcttttaattggagcatttagcccatttagatttaaggtcaatattagtatgtgtgaatttgatcctgtcattatgatgttagctggttattttgcttgttagttgatgcagtttcttcctagccttgatggtctttagagtttggcatgtttttgcagtggctggtaccagttgttcctttccatgttcagtgcttccttcaggagctcttgtaagtcaggcctggtggtgacaaaatctctcagcatttacttgtctgtaaaggattttatttctccttcacttacgaagcttagtttggctggatatgaaattctgggttgaaaattctttaagaatgtcaagatacaaaatcaatatgcaaaaattcacagacattcttatacaccaataacagacaaacagagagccaaatcatgagtgaactcccattcacaattgcttcaaagagaataaaatacctaggaatccaatttacaagggatgtgaaggaccgcttcaaggagaactacaaaccactgctcaatgaaataaaagaggatacaaacaaatggaagaacattccatgctcacgggtaggaagaatcaatatcgtgaaaatggccatactgcccaaggtgatttacagattgaatgacatccccatcaagctaccaatggctttcttcacagaaatggaaaaaactactttaaagttcatatggaaccaaaaaagagcccacattgccaagtcaatcctaagccaaaagaacaaagctggatgcatcacgctacctgacttcaaactatatgctacaaggctacagtaaccaaaacagcatggtactggtaccaaaacagagatatagaccaatggaacagaacagagccctcagaaataatgccgcatatctacaaccatctgatctttgacaaacctgacaaaaacaagcgatggggaaaggattccctatttaataaatggtgctgggaaaactggctagccatatgtagaaagctgaaactggatcccttccttacaccttatacaaaaatgaatttaagatggattaaagacttaaatgttagacctaaaaccataaaaaccctagaagaaaacctaggcaataccattcaggacataggcgtgggcaaggacttcctgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaacgccaacaaatttacaagaaaaaatcaaacaaccccatcaaaaagtgggcaaagtatatgaacagacacttctcataagaagacatttatgcagccaaaagacacgtgaaaaaatgctcatcatgactggccatcagagaaatgcaaatgaaaaccacaatgagataccgtctcacaccagttagaatggcgattattaaaaagtcaagaaacaacaggtgctgcagaggatgtggagaaataggaacacttttacactgttggtggggctgtaaactagttcaaccattgtggaagacagtgtggcgattcctcaaggatctagaactagaaataccgtttgacccagccatcccattactgggttatatacccaaaggactataaatcatgctgctataaagacacatgcacacatatgtttattgtggcactattcacaatagcaaagagttggaaccaaccctaatgttcaagaatgatagactggatataagaaaatgtggcatatatacaccatggaatactatgcagccataaaaaatgatgagttcatgtcctttgtagggacatggatgaagctggaaaccatcattctcagcaaactatcacaaggacaaaaaaccaaacaccgcatgtttttactcagaggtggggattgaacaatgagaacacatggacacaggaaggggaacatcacacactggggactgttgtggggttgggggggaggggggagggatagcattaggagatatacctaatgctaaatgatgagttagtgggtgcagcacaccaacatggcacatgtatacatatgtaacaaacctgcacgttgtgcacatgtaccctaaaacttataataataacaaaataaaaaaaaaaggaatgttgaatattggcccccacttttttctgacttgtagagtttctgctgagagatcctctcttagtctgatgggcttccctttgtgggtaacccaacctttctctctggctgtccttaatattttttccttcatttcacctttggtgaatctgacaattatgtgtcttggagttgctcttctcaaggagtatctttgtggcgttctctgtatttcctgaatttgaatgttggcctgccttgttaggttggggaagttctcctgaagagtattttccaacttggttccactctccccatcatttttaggtacaccaatcagatgtagacttggtcttttcacatagtcccatatttcttggaggctttgttcattttactcttttttctctaaacttctcttctcgcttcatttcattcatttggtcttcaatcactgataccctttgttccacttggtcgaattggctactgaagcttgtgcgtttgtcacgtagttctcctgccatggtgttcagctctatcaggtcatttaaggtcttcttggtgctgtttattttagttagccattcatctaatcttttttcaaggtttttagcctctttgtgatgggtttgaacttcctcctttagctcagagaagtttgttattaccaatcgtctgaagtcttcttccctcaactcgtcaaaatcattatctgctcagctttgttccattgctggcaaggagctgcattcctttggaggagaagaggcgctctgattttgagaattttcagctttccttctctggtttctctccatctttgtggttttatctacctttggtctttgatgatggtgatgtacagattgggttttggtgtggatgtcctttctgtttgttagttttccttctaacagtcaggaccctcagctgcaggtctgttggagtttgctggaggtccattccagaccctgtttgcctgggtttcaccagtagaggctgcagaatagcaagtattgcagaacggcagatgttgctgtctgatccttcctctggaagctttgtctcagaggggcacctggctgtaagaggtgtcagtcggttaggctactcagggatctgggacccacttgaggaggcagtctgtccattctcagatctcaaactccatgctgggagaacaactactttcttcaaagctgtcagacagggacgtttaagtctgcagaactttctgctgccttttcttcagctatgccctgcccccagagctggagtatacaggggcaggcaggcctgcctgagctgcagtgggctccacccagttggagcttcccggctgctttgtttacctacttaagcctcagcaatggtgagcgcccctctcccagcctcgctgctgctttgcagtttgatctcagactgctgtgctagtggtgagtgaggctgtgtgggcgtgggactctctgaaccaggcacaggatataatctcctaatgtgcttcttgctaagactgttggaaagcacagtattagggtgggagtgtcccgattttccaggtaccatctgtcatggcttcccttggctaggaaagggaattccccgatcccttgcacttcccgggtgaggcgatgccccgccctgcttcggctcacactccttgggttgcacccactgtctgacaagccccagtgagatgaactgggtaccgcagttggaaatgcagaaatcacccgtcttctgggtcactcatgctgggaactgtggactggagctcttcctgttcagccatcttggaacctccctgaacattttttttttaatgttttttggccatttgtatatcttcttttgagaattgtctattcatgtcctttgcttactttttgatggtattatttgctttttttcttgctgatttgcttgagttccttgtagagtctggatattagttctttgtcagatgcataatttgtgaatattttctcccactcttttggttgtctgtttactctgctggttatttcttttgctgtgcagaagttttttagtttaattaggtcccatccatttattttttgttgcatttgctttcagattcttggtcatgaagtccatgtctaagcgaatgtctggaacagtggtccgcaaactttttggcaccagggaccagttgcatggaagacaatatttccatggactgtggtgggggcaggcgatggtttcaggatgaagctgtttcacctcagatcatcaggcattagattcttaaaaggagcacacaacctagattccttgcatgcacagttcacaataggggtcatgctcctatgagaatctaatgctgctgctgatctgataggtggcagaactcaggtggtaatgcttgcttctttactgctcacctgctgctgtgtggcccggttcctgacaaggggttggggaccccttgtctcgaagagtttttctgatgttatcttctagaatttttatggtttccggtcttagatttaagtctgacccatcttgagttgatttttgtctaaggagagagacgaggatccagtttcattattcgacctggggcttgccaattatcccagcaccatttgtttaatagggtattctttccctactttgtatttttgtttgctttgttgaagattagttggctgtaagtatttggctttaatttctgggttctctattctgttccattggtctatgtgactatttttataccagtaccatgctgttttgttaactatagccttgtagtacaatttgaagttgagtaatgtgatgccttcaaatttgttctttttgtttagtcttgctttggctgcatggagtatttcttggttccataggaattttaggattcttttttctagttctgtgaagaattttgatggtattttgatgggaattgcattgcatctgtagattgcttttggcactaaggtcattttcacaatattgattctacccatccgtaagtgtgggatgtatttccacttgtttgtgtcatcaataatttctttcaatagtgttttgtagttttcctcatatagatttttcacgtccttggttaggtatattattaatattttattattattcttattttttgcagctgatgtaaaagggattgagttcttgatttgattctcagctttgtcattgttggtgtatgtcagtgctactgatttgtgtacattgattttgtatcctgaatctttactgaattcatttgtcagatttaggagctttttggatgagtatttagggttccctagatatacgatcatatcttcagtgaacagcaacagtttgtcttccactttacagatttggatgccgtttatttctttctcttgtctgattgctctggctaggacttccagtactatgttgcatagaagtggtgaaagtgaatatccttgtcttgttccagatctcaggggaaatgctttcaacttttctcccattcagtataatgtaggtggtgggtttgtcatagaaggcttttattaccttgaggtatgtcccttctatgccagtttcgctgaggtttttaatcataaagtgatgctagattttgtcaaatgctttttctgcatgtattcagatgatcatatatttgtttctaattgtctgtgtgatgtagcacatttgttgacttgcgtatgttaaaccatccctccatccctggtatgaaacccactagaacatggtgtgatatctttttgatatgctgttggattcagttagctagtattttgttgaggatttttgcatctgtgttcatcagggatattggtctgtagttttcttttttgttatgtcctttcctggttttggtattagggtgacactggtttcacagaatgatttagggagaatgccatcctttggaatagttttagtaagattaatattaattcttctttgaatgtttgatagagtttagctgtgaatgcgtctggtcctggagtgttttttgttggcagtttttttttaattactgtttcaatcttgctacttgttattggtctcttcagtttctatttcttcctgatttaatctaggagggttggattttatccatctcctctagattttctagtttgtgtgagcaaaggtgttcacagtagccttgaatgatcttttgaatttctatggtgtcagttgtaatatctcctgtttcatttctaattgagcttatttggatcttctctcttcttttcttggttaaccttactaatggtttctttattgtgtttatcttttcaaagaatcagctttttgttttatttattttttttgtatttttttgtttcaatttgttttagttctactctgatctttgttatttattttctttttctgagtttaggtttggtttgttcttgtttctctagttccctggggtgtgaccttagatattctatttgtgctcctgcagactttttgatgtaggcatttaatgctatgaactttcctcctagaaccacttttgctgtatcccagaggttttgaaaagttgtgtccctattatgagctttttccacccctttacctttagttagtgtgagtccttaggtgttagatgagtctctcaaacagtggatacttggttggtagatttttattcattctgtcattctgtattttttaagtcaagcatttaggccattcaattcaatgttagttttgagatgtgaggtactgttctattcatcatgttgttgcctaagtaccttgtatttttttctcattgtgttattgttttataggtcctgtgagatttatgtttcacggaggttctattttggtgtattttgaggttttatttcaagatttagaactccttttagcatttcttgtagtgctggcttggtactggcaaattctctaagcaattttttttttgtctgaaaaagactttatctcttcttcatttatgaagcttagttttgctggaaaattcttggctgataattattttttttcaggagactaaagataggaccccaaccccttttggcttgaaaagtttctgctaagaaatcagctgttaatctgataggttttcctttataggttacttgatgcttttgtctcacagctcttaaaattctttacttcatcttgactttagataacctgatgactgtgtgcgtaggtgaagatcattttgcaatgaatttcccaagtgttctttgagcttcttgtctaaatttctagatctttagtaagatgcctagatctagatgtctagatctttagttctttgagcttcttgtctagctgtctagatctttagtaaggccagtgaggttttcctcaattattccctcaaatatgtgttccaaacttttagatttttctttctcctcaggagcaccaattattcttagatttggtcatataacatattcccatatattttggaggctttgttaattttttaaaaattattttttctttgtttttatctgattgggttaattcaaaagccttgtctttgagctctgaagatctttcttctacttgttctagtctattgttgaaactttcccttgtgttttgtatttctttaagtgtgtctttcatttccagaaattataattttttttatggtatctatttctctggataatttttcatccatagcctgcattgttttttaaaatttctttaacttggttttcacctttctctggcatctccttgagtagcttaataatcaaccttctgaactttgagtagcttaataatcaaccttctgaatttatctgacaattcagatttcttcttggtttggatccattgctggggagctagtgtgatcttttgggggtgttatagaacctgttttgtcatgttatcagaattacttttttggttccttctcttttgggtagagtaatccagtagagaggtctgcaactaaaggcctgctgttcagattctcttgtcccatggggtgatcccttgatgtggtgctctcccactttcactacggatggggcttactgagagctagactacagtgattgttattgctcttcgggttttagccatccagtggggctaccaggctctaggctggtgctggagaatgtttgcaacaagtcctgtgatatgatccatcttcaggtctcccagctgtggataccagcacctgctctggtggaggtggcaggggagtaaaatagactctatgggagtccttggttgtaaatatgtttagtgtgcttactttctcgaatgctagttaacagtgaagctgtcacatggacagacaggacctctggttagctaggatgttgcaggcagtggaattacctgttgttttctctttcctgggagcaggattattccatcatgagttgctttaatggcctgagttggttggcctccagccaggaggtggcgctttcaagagagcatcagctgtggtagtagggggatataagcttgccctaagttgaccagggtaagtattctggtttctcaggtgattgatgggcaggtctacaaagctccggagtgtctgtcttttgtgttcagctaccagggttggtagagaaataccatcaggtgggggaagatttaggcaggtctgggctcagactcttcttgggtggggcttgctgcagccactgtgagggctggtagaggggcggtggttctcaggccaatggggttatgtttcagaggggattatggctgcctcttctgtgtcatatagttcaccagggaagtgggggatagctggtagtgaaaggtctcacccaacacccacgcagttggtgaggctggtcttgctcctgcagtgccccctgttcagatcttgcccaggtcataaagttcccactgagaaagaaaacatggctttcaggccttgccccctccctgtctgcccacattgtggtcagcagctcctgtgctcatatctgcagcagttcctggccaccccccagattttactcaagaaaatttgtgtccagttgaaattattacagatttcatttggaagcttggttcaccttgtgacccctccccagttctactcattgccttctttaaggatgcctataattataataagggatggcttccctggatttcagctggagattgggagtgcctagaaggctcttcctgctgctgcttctattttttattttgtgcagctccctaaatttgtttcagctctaggtaagtttaaatctttctcctgagatctggatattcagattcctcagtttgcatgtatgtttggaggccggtttttcccctctcacccttcgggaactcagttttttgtctgtctcccagagtttgcttcgtgtgccacttctttcaaaggatcaatgcattcttttgtttttttctggtatgtttctgtggtggttcttcaagcaaaagttcatggtgtgagtctccacacactgttctgtcattcgaagtgggagctacctcccctgtctcctatctgctatctccccgattttttttttttttttttttttttttgagttggagttttgctcttgtcacccaggctggagttcagtggtgccttctcagctcactgcaacctctacctcccaggctcaagcagttctcctgcctcagcctcctgagtagctggaactacaggatcacgccaccacgcccggcatttttttttttgtagttttagtagagacagagtttcaccatgttagacaggctggtctcaaactcctgacctcaggtgacctgcccgcctcagcctccctaagtgctgggattacaggcgtgaaccatcatgcctggccctgatgtgtttttttatttttaatttttttttgaggcagggtctcactctctaacccaggctgcagtgcagtggcatgttgccagctcactgcagcctcgacctcccaggctcaggtgatccttccacctcagtctcctgagtggctaggacccacaggcatgtgccaccacacctggctaatgagaaaaagaaaattaaatattaattaatgttattattaagagtatttattagaaaatatacttttaaaattaaatacctagcaatttcctaccatgtgctaggcactttttaaagcatgagggatataacagtgaagaaatcaaagacaaaaggcaaataagtaagtgtagagtacgttcaccttatataagttaagaaaattcgtgcatttaaatcaggaaaatatttctgctttgttttctctcaagaagcatatatttgaaattataggacgggagcggtggctcacgcctgtaatcccagtacttcgggaggccaaggcgggcggatcacgaggtcaggagatcgagaccatcctggctaacatggtgaaaccccgtctctactaaaaataaaaaaaaaattagctgggcgtggtggcgggcgcctgtagtcccagctactcgggaccctgaggcaggagaatggcgtgaacccaggaggtggagcttgcagtgagttgacatcgcgccattgcatgccagcctggggacagagtgagaaaaaaaaaattatatattgcgcttaattcctagtgaggatggatgactgccatttgagctgggtttttgtttttttttttttttaaagaatgatttcaaatacctaaaatttataatttaatccttctgtcagccttcctatacaggtactatttttatattttttatccagatgaggaaattgagacccaggaggttccggtaactcatttgtgatcacacattagctgttatggcagacataggatttgaactcaggagactatgcctgtggagcctgtggcttagactcactccaccttatgcatgtttcccctacttcacgaaagtggaaaggaataaataagtgcaacctgacagaaatacagcttctcttaagagacaccagaggacatctgccaatgtgtcttttgacaggtattttaaattaaccaggacagatggttgtcttgtcagttggtgaattccatttaatggaattttgatgatcctttcactcagaggaggctgctgaatacctagagttgagtatctggtagtctttttgtctgcttaaagagaatctgcaagaacatctgaattaaccatggggccacaatttaataggcagctatttcaatgtagcctttgtggatatttgacatgggctttcttgagaaagcattgtaggagaattagatctgtattgactacactgtctttcatgaatgttctgattctaattaggatttatctttacatattggggctaaattattttctgtgggaacacatctctaaaattaaaatgtaagtgaaaaaaagattcgatatgcaaatattttacttaaatacaactttctgtgaatgcagccaatgtatgaaataaagcacatgtagtgataagctaggctggctccagtctcatgcttacagtctgttaaaaaaatcgggcacagaaactgcctggcagcatgggctagcagagcaggcatggggccacgtgcctggggacccaagctctagccttcactattgacccctgggtatatcacttaacttttcctggccttagctctcagtcaaatggctatatagcttgacaaggaactattttacaaaacaaaataaaaatacacacaagcacaaaggatgctattagcaacaaccctgtagctgtctctcagaatcaacacatcttcacattttttcatatttgcctcgatctttaacaaaaaataattgcaaaataaatggaagttcccctcctggttcctttcctttatcaaccttgccagatgtcactattaatgtgattgaaagcattcgatccatgtccatgtacgtgtgtatgtatgtgtgcatgcttacatattaccacgtttgtatgtgtccatatacaagatagatagtagagagggcttatgtctagtggcaaaatgtgaagcctttggggacagactgcctacattcaaatcctagctatgactcttactagctgtgtaatcttgggcaatttccttaacttcttcacttcatttttaccatttgtaaatagagtgtctatttcatagtattgttctgtggattaagcaaattagttaatataatgtattagaacagcattgggtatgtagcaaacactcagtgagtgttaactgttgccttatgcggtttacaaaattatctaaatggcataatacaaatggattcctctgaaacttatcatttcactctccatttttcttttgaacacatttagatctagttcattagtttgaactactgcataataccacaatgtattcattcatttgctattgatgaaaacttggcttggttcagatttttgacaaacaatactgcaatatacatcttcatgcatacctccttgttcatggcttttaaattcttatggcacataccttaccacagaattctttaggaaatccttaattatccaacaactcattagtccaatcctatgcctggtcatcccaatgatggagataatactacattgtgaggcagcaaataatatttttggactgctctgttataagtaatttgaaggaagactaaatttggtttaatgcaatggtcttacgtttgtcccacctaaatcacttcagtcatgctggccacattttggttgcctgaatactccaagattttccctgactcatgccaccatttctgcttgccttttgcctggaagacctctttgtctttacacagttcctttacacaaggaactttacaacaaaagtttctgttccttataaatagaggttctatttacaaatgggaaaaatgaagtgaggaagttaaacaccttgcccaagattaaacagcaagtcagagtcttgactggggtttgaacttaggcagcttgtttgtttttctgtatctggctcttactcatcgtctctttttaacttaaatgttactttcttaaggactgtcttacctttgagggttccccattttgttatcaatcactacttcctgtttagtcattcagagttcttttcataaattgaaattacatatttttttggtctcctttaatttttgtcccccagtaaataataaataactccataaactctacttgttttgtcttccatcataaatcagtacccagcacaatgtgtgacactcaatgcaagtgcatatgttggtgttagtgtagcccctgtcacaatattaacttgtagtaaacttattgtggaccaaaaccccaaagaggtttgtttgtttttcacttgttcctgctaatctctgacttctcccttcttgagctcatgcagttagttttttggactcacatttatgtccttatgttcattaccattaaatttcattactatctataaaaggagagggttgaattaaataaccaaggtcactttctgcttctaaaaatgaaattggttattccagagcagcattatccaatagaactttctgtgatgatggaaaagatctatagctacactacccaatcctatagtcacaagccacacgtggctattgagtagttaaaatgtgactagtgcaactgagaagctggattttaaatttaaatttaagtagccacatgtggccagtggctgctttattgggtagtgccattctagaaaaacagtatcagaattttaaaagatgaaatggcatgcatagcatatggggagaaaccaacaagcagataggatggcctgtttagggtcagggtttatttattcatttttttttttttttatttaatagattaaaatattttttctttcactgagcatcagctatgtgctaggcacagtactgggtactgggatatagctttgaagaaggcagtcattacccttgctctcaagggtcttcctcttttaggtgtcaaacctaaaacatttcttcaaggtaagctatgagctcctggcaaaatgtattgctagtcttcagactggatttctgtgcatagtgtttttcatatctgtaatcttcgttagtctggattctagaacttaaggctctagaactcagccccagtacgatgaggagaacgaggggccaaatgttgatgaggcagaaggaatatcggcttggatctttcaaagaggagggaatttatggttgtatcattccatataggctggattgcactgtagctagtaccaagggctgatttctttacgtgttcattatgggacatctgggactcctggagcaagctgacagggcagcctttatgtagaactttgctggtgttctgacagaaggaaaagagagcatgatgaagcaggagctggcctcgaaagcatcttctagaagtgtatcccttttgcttaaagcaagttccatggctaagcaaggaagtggcctcccctaggaaaagacaacaaacatttgtgaatgataataaagtttattgtagtcttttcttctcatcacaaatatttggttcaatctctttttgattgagaaaatacactctcttctggcctttctctagggaggacaaacaaatgtcccatctaatcatggcaataggatcatagcccaggatcctgtgatgtgtctttctctaggtatttatttgattctcttgcttcaggtattcatgaaggaaaaaagcaaattatctgcttctcatattaaatattcattgtcagaacaaggccagaatatttaaatatactattaaaaacacacacacacacacacacacacacacacacatagttttggaaaaaggaagaatggaggatacacaatagttacttctagaaaaaatttgtgatttaatggaacagacattacaaggatccttaccttaaaagttgagcatgttctttagctccctggaaacagatctctagttcattgttttccatggcttatggtttcactttcttggggtccttctttttccattatagtcttgaaaaactctgtcagtccactctttacccatagaggttggaagcatgaggattattttatttcctaaacaatcattgactcttttagtctaagatagtgtgactgtttggctatgaaataagagtgaaacttggtgatttttatcatctatttaattccaatcagccatggtatgtaccaggaaccatactcacaattaattttgagtaccacaaacctatcaggatttaatggaaaaaccagactgttagtcacttttctttatctcgtccaactgaaaagattcactggtactaccttaatttgttcagatgctttaacaatgggtgggacatctatttccttgacttaatccttgcctcaaggctgagtttttttgttttgttttcaaggctgagatttaattggcctgcccaaagcctttttcaggtttatcttttattgctggagatgagaaaacgttgttgcttttgatactacaagctctggaatttctggactctatttcctttcattttcatttataaggtggccagttcattcctgttttttttttttttcttttgagatggagtcttgctctgtcacccaggctggagtgagtgcagtggtgcgatctcagctcactgcaacctctgcctgcagggttcaagcgattctcctgcctcagcctcccgagtagctgggactacaggcgtgcgccaccatacacgtttaattttttgtatttttagtagagacagggtttcaccatgctggccaggctggtcttgaactcctgaccttgtgatctgcctgcctcagcctcccaaagtgctgggattacagacatgagccactgtgcccagcctcttttctgttcttatcttgtattagtttgcaagggctgctctagcaaagtactgttgactaggtggcttagaaaacagaattttttctttccatttttggatgctaggagtccaaaatcaaggtattggtggagttggttccttctgagggctgtgagggaagggtctgttatggggctctctccctggcttgtagatggctgtcttctctctatgtctcttcaaatcattttccctctaagtggatctctatgttcaaatttcttctttttataaggataccagtcatactgggttagagctcaccctaccaacctcattttagcttcattacctctgtaaggccctatctctaaacaaagtaacattctgaggaattggagattaggacttcaacatatgaatttttggggggacacagttcagtgcataacacatctttttctcctggtctttgtctgatgcagccaatagtaaccaagacacactactttctgttttccaagctcatcaggtacattttcctcttccaatttatttaggatgacagctttagcaaatgtttcatccttgtgaagtatgaatcaaaatcagtctagcttccaacaatacagtctcctttctgcccactgcatggctccagaaaccaatgagatatagatatatattttgtgtatatatatatatatagtgtatatatatattttgtttatatatatattttgtttatatatatatatatttatttgtttgttgttgtgttgttatggtagtacctcacacttcctgtacgaattttgtatcaacaggaagactggatgttgttgcaacaaccctcaaatctcagtgacatacaatatcaagagtttatttcttgcttgtaatacatgttcatcatgaattgcctacctttctccttcacatttttcaccccctgggattcatgcaactgctataaggaggcttgctgttgctgtggcaaattgtgggaaaataagaaaggtgaagcatctactggcatttaaagctactgctcagaaatgatatgtgtcaattctgctcaaatttcattggccaaagtaagtcttatcgccaagccttaagttaaaggagatggaaagtacaattctcctctagggaggggcagcaaatatttgtgagcactgttggtcacagtctagcataatataatattttaatgtttttagaaaagttcggggagatagtagacagagtttaatgacttgacactaggtgagtgggaagactagggcaaagggtaaagagaaggactttggctttggcacagagatctaactgtagttaacaccagaagaatctatcctttatcagatgcttaacaggttaacatgtgagggtttgaagagttcttggcagagggggagggcggatagttggtgcaggctttgtattccaggacttcaagttgcagctctgccacttagtagctgtgtaaattttgtcatgttacttgacctttctgagtctctctttttttttttttttttttgagacaaagtcttgctccatcacccaggctggaatgcagtggtgtggatctcaactcactgcacctgcatctcccaggttcaagtgatcctcccgcctcagcctcccaagtagctgggattacaggtgtgtgccacaacacccagctaatttttgtatttttagtagagacgtgattttgctgtgttggccaggctggtcttgaactcctgacctcaagtgatctacttgcctcagccttccaaagtgctgggattacaggcatgagccaccatgcccggccctgagtctccattcctcacctctcaaagggaacagcagtgtcatccacctcacagtaatattttgagtaatatctctttacacagtagttgtatggaattgggcaacttggttatgtatacttcagtttcctcatctgtcacattgagataatactagtacacattttgtagggttattacaggatttagtgatttaaaacatttacgccaatgcttgtgataaatcctcaataaatggtaattattctcattgtagttagctgaggtgatacatgtaaagcttttagcacagtggcaggctcacagtgagaacacaataaatatgagacaatcattttctacactaacccttattaagaagtgcaagccgaagaagccagagtcagagaaataaagcagagaaggagggagaacaaatacaagagagttcattaccaagcaagccatagttgcctggcaagttgattactcagtctctgtatcagtctattctcacactgctataaagatactacctgagactgggtaatttataaagaaaggaggtttatttgactcacagttttgcttggctggggtggcctcaggaaagttacaattatggtggaaggtgaaggggaagcaaggcacatcttacataacagcaggagagagagagaatgaggaaacgccacactttaaaactatcagctctcataagaactcactcattatcatgagaacagcatgagagaaactgcccccatgatccagtcgcctcccctgacatgtggggattaccattcaagatgagatttgggtgggaatacagaaccaaaccatatcattctgcccctggcccctcccaaatctcatgtccttttcacatttcaaaatcaatcatgccttcctaactgttctgtaaagtcttaactcagtccagcattaactcaaaaatctaagtccaaagtatcatctgagataaggcaagtcccttctccctatgagcctgtaaaataaaaaacaaattagttactcccaacatacagtaggggtgcaggcattgggtaaatgttcccattccaaatgggagacattggccaaaacacaggggccacaggcctcctccaagtccagaatcctaaagggccctcagtaaatcttaaagctccagagtaatctcctttgacttcatgactcacattcagggcatgctgatacaacaggtgggttcccagggccttgggcagctgcacccgtgaagctctggagggtacagcccccagagctgctttcataggttggtgttgagtgcctgtggcttttccaagcacacagtggtaacctgttgctggatctatcattctggcatctagagaatggtggccctcttccatagctccattaggcagtgccccagtggggactctgtgggggggggctccaaccccacattttccttccacactggcctagcagaggttttccgtgagggctctgcccctgcagtagaattctacctgtacatccaggtgtttccatatatcctctgaaatctaggtggaggttcccaaacctcagctcttgacttctgcacacccacatgcccaacaccacatggaaactgccagggcttggggcttgcaccctctgaggccacagctcaagctgtaccttggtcccttttagccactgctggagctggagcagctggaaggcagggtgccatgtcctgaggctgcaccgagaagctggaaggcagtgtgccatgtcctgaggctgcacagagcagctgggccctgggcctggcctatgaagccatttttccctcctaggccttgggcctgtgatggaaggggttgccttgaagatctctgcaatgctgtggagacatgtttcccattatcttggcagttaacattcagctccttgttacttatgcaaatttctgcagccagcttgaacttctccccagaaaatgggtttttcttttctaccacatggtcaggctgcaaattttccaaacttatatagtctgcttcccttttaagcctaagttccaatttcagaccatctcttcgtgagcatatataactgaatgctttcagaataagacaggtcacctcttaaatgcttcgctggttagaaatttcttccaccaggtaccctaaatcatctcactcaagctgaaagtcccatagattcctagggcaggggaaaatgccaccagtctctttgctaaagcatagcatgagtgacctttattccagttcacagcaagttcttcatctccatccgagaccacctcggcctggacttcattgtccatatcattatcagcatttggtcaaaaccattcaacgagtctctaggacattccaaactttcccacatcttctttttttcttctgagccctctaaactgttctaacatcttcccattacccagttccaaagtcccttccacattttcagtttatctttatagcagtaccccactctgccggtaccaattatatgtattagtccattcttacactgttacaaagatactacctgacactgggtaatttataaagaaaggtttaattgactcacagttctgaatgactggggaagtttcaggaaacttacaatcatggtagaaggcaaaggggaagcaaggcacgtcttacatgttggcaggagagaaagagaatgaggaagtgccacactttaaaaccatcagctctcataagaactcactaaactgcccacataatccaatcacctccctcaacatgtggggattataatttgagatgagatttgggtggggacacagagccaaattatatctgtctccaggatgtttttaaagacaccatatgtagtcacagcatctccaaacagttcatgcagtaagggaggaagggagaaaaattcatctgttgactcccaactactattgttccaaatttcctacatgaaacatccacttccccagacttccaggttgcatgtgcctggatgccatatgagttctgagatatttcctgtgtcagtggcatcagggaagccccagagatggcatgaaagtaggtgaggaaccatcagagcaggcatgtgagcaacaggagtatctgagtacagtctccaaggcaggctgtaagtctgtggtgatgtggcggcagcaatctgctggatcaccgtgggaattgtgtaagctaatgagagggtgctctctggcttgaaagcaaagaaaatgcatgaatctggggttttatataaacatacttaccttttaagccccattttctcactttatatgtgaggaaataggtgctaatttggaaaaagttttatttagagttatacagcttgttaattgcagaataaaaattagaatccaggtcgtactaggaattagttttgatgttttctgatctctaggttgctagtttttgtttatttttccaacatttattttagattcagggggtccatgtgcaggtttgttacctaggtatattgtgtgatgctgaggtttgaagtatgaatgatcccatcatccaagtagtgagcatagtacccaaaagttagtttttcaactctttcttcctccttccccactctagtagtcctcagtgtctattgttgccatctttatgtccatgtttcccaatgtttagctcccagttgtgagaacatggagtattttgttttctgttcctttgttaatacatgtaggatagtggcctccagctgcatccatgttgctgcaaaggacatgatttcggtcttttttatgactgcataatattccatggcacatatataccacactttccttatctaatttaccactgatgggcacctaggtttagtccatgtctttgccattgggaatagcactgtgatgaacatgcaagcacatatgtcttttggtagaatgattttttttgggatatatacccagcaatgggattgttgcatcaaatggtagtttttttattaaaaatattttattgagacataatcataaagaaatgtgtacaaattataagtttacaacttgctgggtttatgcaaagtgaatacaactgtatagtcagtctctggactaagaaatacaatataccagcaccctagtcactagcaccggaaaagataaccataatctgacttctatcatcgattagttttgcatagtattgaactttacacaagttgaaccccacagtagaaaaatctttgttcctgctttaaaaaaaaaacactcaatattatgttaatacaatcaccaatatttttttcttttattttttaaattatactttaagttctagggtacatgtgcacaatgtgcaggtttgttacataggtatacatgtgccatgttggtttgctgcacccatcaactcatcatttacattaggtatttctcctaatgctgtccctcccccatccccccaccccatgacaggcctccatgtgtgatgttccctgccctgtgtccaagtgttctcattgttcagttcccacctatgagtgagaacatgcagtgtttggttttctgtccttgtgatagtttgcttagaatgatggtttccagcttcatccatgtccctgcaaaggacatgaactcatctttttttatggctgcatagtattccatggtgtatatgtgccacatttgcttaatccagtctatcattgatggacatttgggttggttccaagtttttgctattgtgaatagtgccgcaataaacctctgtgtgcatgtgtctttatagtagcatgatttataatcctttgggtatatacccagtaatgggatggctgggtcaaatggtacttctagttctagatcctagaggaatctccacactgtcttccacaatggttgaactagtttacagtctcaccaacagtgtaaaagtgttcctatttctccacatcctctccagcacctgttgtttcctaactttttaatgatcgccattttaactggtgtgagatggtatctcattgtggttttgatttgcatttctgtgattgccagtgatgatgagcattttttcatttatctgttggctgcataaatgtcttcttttgagaagtgtctgttcatatactttgcccactttttgatggggttgtttgattttttcttgtaaatttgttggcgttcattgtagattctggatattagccctttgtcagatgggtagattgtaaaattttctcccattctgtaggttgcctgttcactctgatggtagtttcttttgctgtgcagaaactctgtagtttaattagatcccatttgtcaattttggcttttgttgccattgcttttggtattttagtcatgaagcccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccggaacctcaaatggtagttttgttttaaattctttgagaaatctcctaactgctttccacagtgattgcactaatttacattcccaccaacagtgtataagtgttccatttttctccacagcctaactagcatttgttgttttttggctgtttaataatagttattctaactggtatgagatgctattttattgtggttttgatttgcatttctttaatgattagtcatgctgagcattttttcatatgtttgttggccgtttctatgtatcttttcgaggagtgtttgttcacgtcttttatgtgttttttaatggggttatttgttttttgcctgttcagttgtttaagttcctaatagattctggatcttagacctttgttggatgcataggttgtgaatattgtctcctgttctgtaaattgtctgtttactctgttgatagtttcttttgctgtgcagaagctctttagtttaattagcttctacttgtcaatttttgtttttgttgtaattgcattttaggacttagtcataaattcttacttttcaaggtcaatgtcgagaatggtgtttcctaggctttcttccatgattcatatagtttgatgtcttacatttaaatctttaatcaatattgagttaatttttgtaaatagtgaaaggtaggtgtctgatttcattctgcatgtggctagtcagctatctcatcatcatttattgaataggaaatcctttcttcattgcttatttttttttttcaactttgttaataattagatggctgtagatttgtggctttatttctgggttctctattctgttctcttggtctatgtgtctgtttttgtaccagtatcatgctgttttggttactgtagtctcatagtttgaagtgaggtaatgtgatgtttctggctttgttctttttgcttaggattgctttgactatggggctctatttttggttccatgtgaatttcatcatagtttttcctaattctgtgaaaaatgacattggttatttgatatgaatagtgttgaatctgtagattgctctgggcagtatggccatgttaatgatgttgattcttgcaatccaaaagaatggaatactttttcaaatctttgtgtcatctatgatttcctttaactgttttgcagtcctccttgtagaaatctttcacctccttggctagctgtattgctaggtattttattttttttatggctattataagtgggattacattcttgaattggctctcagcttgaacattattggtatataaaaatgctactgatttttttttaacattgattttgtgtcatgaaagcttgctgaaacagtttattagctcttatatccttttggcagtgtttttagggtttcctagatatagaattgtattgtcagtgaagagatagtttaacttcttttttgacctatttagatgcctcttatttttttctcttgtctgattgctctagctagcacttccaatactatgttgaacaggagtggtgagagtgagctttattatcttgtgacagttctcaaggggaatgcttctagtttttgcccattcagtatgatgttggttatggatttgtcatagatggcttttattattttgagttatgtccctttgatacctagtttcttgagggtttttatcataaagggatgttggattttatggaaagctttttctgtatatattgagatcatatgattttaaaaattctgtttgtgtggtgaattacatttattaatttgaatatgttgatagattgctagtttaattctatctcatcttcatccatccatcctttcatctatccatccattcatccactcacctatctccatggttaaagacctcccttatatctagtgctgggcaggtatttccacacagtaatggagtactaggagagaataactgtgagtcacttcttttgcctgactttatgctctcttctgctgtggcggttgggaaggcaagctgtctgtggagctgagccaatggggaggaaattggatgcactcaggatgtctgatagatggaatgactgtgttagtctgggccaagggaaagggaaagcagctgttccatctctggcttgagctccagtggattggctgtagcttcgaaatgtagagagaagatgaatttccaaggaggacacttggcttcgcttaatcatataggaccttagacacagcttccccgttgaaacaaataatcaaagaggactaatggctcactaactgcaaggtaccatgtaggaactgtgaattacaggcagatccaagtttgattcctgtcctttaagatatgaaagtatagttggaaaataagcaaatatgtaaaagattattaatattatactgttaaattagcagctaacagtattgtgcttgtctaagagacacctgttgtatcttagagatcttaacagtccatggagaagcatcagtgagcctgtaaactgcctgaaattgcatgtaaattttgtgtgtgtatgcattttactggggaaagggtctatttttgcatcatattcccaaagatgtgtgcagtctgtcacaaatttaagtccattgtatttcattctcatagcagtcttctttttcacatgagaaagccaatacccagagaggttaaatggcagaatcggtacttgaacctagacctctttgataccacaccttgggcttggctcatcttgctatggtgcactcctaccatagtagaggaaacagaggcaagcagtggttggtccattcccccagctttgatttgtacccacgaatggtgtgtgactgtgaccgctgctttgaacagaagtctgtgcttcagggtgaaagccagcaaggtttgggatcatttaaccttgagagcagcagactgaggatggcatgcttcctagtggatacctgaatgtgtaagacaaagatgatggcaggcagttttccctgacttcacagaggctggatgaggagtatagtttatacccaaggaagaacttcctaacttcaaagtggctactgagggagggattacattttcaaagcagccagatctggatatgtcttgaataattttgactgagattaggggaaggatacatagatctctgaagattttctttggtcattgttcttttctgtgattctaaatgcactttattttcctggtgtccagaagccagtggagagttaatcggtatgtatgagtcaggattctatgataatttcagctgcagctccaaaaggggcatttgacacctacactacttaacattgctgttcaccttgagaaacacagttctgcagacacctgaggaggtctgcacttatatggggcacccagggcttcagatactctgtgaatgtcttgacaccttgacaagctgcaaggctttagtgggcttaaagcactttggaaattacctgctgaggttctgttgcacaaattaagaccacataggaaattattatgttgggtttacttggctgatgcctgtggctgaatgaaagaaggggagagagtaggaacctttgcttctagcaataaagaactggagctaggttaggtagcttaggttagagggggcgtcactgtgagtgtgtgcattaaaggtggaattgtgtgtgtgagtgcatgcctatggctctgtaagtgtaaatgtgcagatgctcaatacccatgtgtctgcatgggcatgagtgtggggatgtgcctgagtatgaggctgttgggattatgtgtgcatagtaattaagacgtgggtttgaattccagacttacaattcacaagccgggtaggttaggtaacttacctctctgcacatcagttttcttatctgtcaagtcagaataataataaccacctcacagggttactataaggatgaaaataaaaaccatgtataaaaaatgctaagcatatgtccgggattagcaagtattgagtaaatggcagctgttgccatttgtagtgggagcaggtgtgcgcagatacatgtggtaaggatgtgcatatgtgtgggtaaacacgttggctttgtcctcagctgtcttagaagactctctgagtaaaagacttcccttcatgcaaaatcactggtgtgctctctaaaccaacttttctagagaagcatttcacaatgaggctcctctaatggagtcctctgggacccatcctttctaggacttgcctagctttctgctgggcttgttcagggttttggagtcttttttttctcactagtcatcattttccgagtcctttccctcggtggaaggaggaggtattctggaggaatgggtgatctgatttacactgggcccacttgctaccacctgagacctagatagaactttgccctttcttcctgcccattccctctttgttcttatgcttcatgaatctgaataaatgggagagaatatttgagttcctcctgtgttaagctccatctttaatcctcacttcagcttttcatggcctcagttgcctcttttactgcatggatttttgtccttttgttctgcactaatagtttggggtcctactgttgtttttctgataaggtaactaccagcagagtctagctggggaggaaatacagatatatgtgtaaagataatgagcattaatggtgtgcctgaatgactcccaggtggtgagtgctgttggaggtctgaggatttggagatcatttggggctggcaggatcctggaggatttgcagcaagaggggaaaagtgagtatggctgggaaaggctgagaagtgggggaaggcatatgaggcagcaggggatatgctgtcaagggacagtgtagatgccagtttgacatgagtaatgagttcatgtggcaagacagagagaaaatcctggaaagttaggttagagcttagctgtacaaagttttaagtacccggttttggagcttattgtcggcggggaggcatgggcttttgtatcatttagacctgagttcattcattaattcttttgtaagtcatttattgaaatgccaggtaccattccaggttctggtgatacagtggggaacacaaaggctagtctctacatttacagaacttacattctagtggattcaaaccctcgctttgttattttccagctgggtaaacttaaacaggttatttaacctttctaagtctcaatttgttcgattgtaaaatagggatagttggacctaaatgaaataatgtaaatcaaagggcctggtatatggctgctatccaagtgtgttagctccccgcttcctcttcctccctgccatccctcttcctctatcttccttccataggttttgagagtctttgttctctcctacatctgttgctctgacagaagagcactgtatcttctaacattcagctacaatttagcggtctccttaggtacttggcctaatgtatttgcttcctagaagtgacatctaattgatgtaggtcaagatggttcatcagtagtagaaattaacctgtaagtgcttgggaagttctccaggacaactgcaaattcagagcatagtctgagctcaagctggaccatgcctaaagagaacctagattaggagcttaggctgggagaagcaggaacagatgaggataggaagtagaatcagcagaggagaggatggggacaagaagaaataaaaaagtccccaggtgtagtgggaaattctaatggtaagagtggtccatatgtagaagtttattttttccttatgtatttgttgagtacctaccactgtgcagtcattgaggctacagcaatgaccaagagaataaattcccttatgaaggttgcataaaatcagaagagagagaaaacaaacacatgaacaaataaattacaagataatgttgaatagagacaaaggccattcgttcatttattcaatcaacaaaattttgagtgtctactctttactagttattgttttaggtgatgggactataacaagaaaagggacagtctttgccctcatggactttgcattctagcgtagacagtcaattaaccagtagacaaataaatatataataagactctgttagtgacaagtgctatgaagtaaaataaaggaaagcaacagagtacaggtgatagggatgtttttagatgaaatgcttagaaaagtcctcaagaaggagttaatattagggcagagacctacctgaggtgatggaagaagccatttcctactccaggagaaggacatcctgggtagatgaaacagcaagtatgaaggctccaagcttggtgagtttgaggaaaatgtagaagatcatggtgactaaagtagagaaggtgagaattgggagtagcaggagttaatgtcagagaggtaagcaggagacagatcatattgggccttagaggttatggagagaaatttagattttgttttccatgggtgggaagcagttggaggattttgagcaggacaatgatctatgattagtatttttgaaatatgactggctgcttttgtgtataaggtgaagaatgtaactagagagaccagataggaggagaggtgcaggaatccaggtgagatgatggctccgatgaggatcatcatgaaggatatggtgagaagtattcagatttgggatatatatattttataggtagagacaacaggatggattggatgtgatggattggatatggagtatgagggatcctgaggaatcaagactgcatttgtggtattaccattggaaagactaggggaggtgctgatatcattcagtcatctaaggtcatgttagatttgagaaatccattagatgtccacagggagatgtcaggaaggcattaggtcaaacaagtccagggttcagaggagagattgggctggaggtgtatttctggagttcatcagcacaagtgtgatatttgaggccaaggtggtgataagattatttagggcagcatctcttaaagtgtggttcttggagcaacaacagcagcagtggcccctggggatttgttagaaatccaatttctcaggcttctccctagaattactgaattagaaactttgggggtggggtctagataagttttaataattcctccaaccaattctggtggtaactgaaattaagtactggggagtgagatagagaggaggcctagactgatcccgggatctctagcaattagtattaggaagagaagaaggagccagcaaaggttactaagaagaaccaatttggaacttcaaagaaaaactcagaaagtgttttgcaatggatgctaagagtttaaggtggtgagcagtcgggtcaaatgctgctgagggttgacggagatgaggactaaaaattgtccaatggcttgggaaagatgaggattttattagtccattctcatgctactataaagaactacccaagactgggtaatttataaaggaaagaggtttaattgactcacgtttttgcatggctgggaggcctcaggaaacttacaatcatgacagaaggagaagcaaacatgttcttcttcacatgatgacaggaaggagaagtgccaagcagaggggaaaaagccccttataaaaccattatgtcttgtgagaacttactcactatcatgagaacagcagcatgggggtaactgcccgcatgattaaattacctccaaccaggtccctcctacaatatgtggggattatggaaactacaattcaagatgagatttgggtggggacagagccaaaccatatcaaggatctttttgcagccttgactggaacagtttcaatggagtggccagcatgaaaccttgtttgaagtaaggttaaaagagaaaggatggtaaagaaacagagacaagtatagccagctgtttatggggttagataaaaaggtacagtgacaaagagcagtagctgaatgctgactttgggtttagggagtttttgttttggaaggggagttttttcttaaggtcagagatattataacatatttgaaagtgggcaggggtcctgtagtagagtctgtaaagtatgatgcagtagaggggttgctaattgcaggaaggaaatccttgaataggagagaggggccgggatgccatatgtgagtgaggggactcattttaggagcagggtaagctgatccttggcatcaggaggaaagggagaggataatgaatatggatttatgaggttagtatacttgaagatgcaaagatgagctagttctgcctctattcttagtgaaataagaagtgaggtcatccactgagggcaagtggggggtgaaggtttgagtgagagaagaatgtgtgaaaagaggaaaataaatgaggccatgtgattggctagagcatgccttctcacatgctctccaaacactcacggtgggcaggtgagagggcagggcaggagaaagacagttagagcttctcctatatgggctactcctcttgccccagcagccacaggaagcccctggccgagcagagcaacctgtcagtgcacaagtgaggcaagcatagatgcctacgctgccctcactggggtaaaaagttaggcatttagcccagcgtcaaagctggcccctgtcatcatggtttaggataatctttaagttcaagaatcatcttggagtttctcattcagagaagatggtggtctgcttggtctgtggaatttctcaggcctgctctttattgtccattgtctaaaatacagcattactttatttacttcatcaaacattctgtacttattttttaaatcatgaagttctttattttcaccataacaagggatatatttctaaaatgtttaaaggaaaagttgataatttctggacccctaccctcctcccctccccctcccttcctctctcctttcatttttttgagacagagtcttgctctgtcacccagactggagtgcagtggtgtgatctcagctcactacaacctcttcctccctggttcaagcaattctcctgcctcagcctcccgagtagctgggattacaggcatgtgccaccatgcctggctaatttttgtgttttttatagatacggggtttcaccatgttgtccaggctggtctcaaactcctgacctcatgatctgcctgcctcggcctcccaaagtgctgggattacagatgtgagccaccgtgcttgcccccctttcctcttttctatacctctcctctccagtcctgtgtagccttcttccctacgttatttatttattttttacttacctgctcttatttttattatttctcctcattctagagctcacataggctctggagtctgatagcctggtgtgaatcctgccccccagtttgttattgttattctcctttaaaaataaccagagctccctgggtagaactgattacaaaatttggaacaggggtacatcaaggtggctctggggtatctgttttcagatatatctgagttagagcaaaaaagggccaagaggtaaactgaaagggctcccattggtcaatgtggaacaatttaattataaaaaagcaacaattattataattgataaaaataacttgctacaaaaaaatccatgaatacatgataatgctcaaaaagaatgtgaccctgagtcagtttttttaatgtgttgtgcctcagtttacatgtgtaaaacaggtagataatagtagtgtgtacctcatagtactgtggtaaggattaaggaatacagtgcctgcagagagattagcaagtgattgaaacatcatgcttaagtgtcagccatagttagcattattattattatacatctcctactactagcattattattagttgtattattccataatggtaatattattggttacagtctctactattaacattattattatttccaaagaatattctacaagatactatgataaatattccaagtacaaaaatttaaagtggagaaaaaatcaaatttactgagaactactattacctaggcactgtgcaatgctcagagttggaacgatcaggaattatagtttatgtttatacgtggatttgtttaatgttattcttccatactagatataagggccctgagtttagcttcctttaagttgtgatgttcactgctatatcccagttattggtatagtattcgttaagtaaacgaagtagtgaaaaacacccagaatcatctatcatctatgacacagtgtgagaaaatgtagcatagaagattgtaagatcacagccaatatttctgctgagagctagagggtgtgtgcgtgtgcacagctgtgcacgtgtgttttccaggtaagcatcccagaagaggatactccaagccctggtgggtggggggattttcatcaggttgagaggctggcaggaggcattctgagcagagatgcagtgctttacagagagcctggcacacaggagtgcacagtgctgagggactgagtggatgaatggaacaggcattgaggtgctgtcaggtcactgggtttgctggcttgctggggcacagggagtgcagatgatggggaatcactgatggttttaagcaggagcacttcagcttagatgcagggtcctgggagagactggtttgagctactgtggatcaaaatctgggtcactttgctgtttgtgttcacgttagaaaatttgatgttttcaaaaagactttttctttcttttcttcattcttttctgatggaattgaataatagcccaggttctggacttggacctggattcaagtcccagcttaggcaggactagcttcttgaccttggatcatgtccccacatgtaaagtgtaggaggaaatatctatttcccagggtattgtgaatcaccaatgaggtaatgcctggggaagaacttttcctgctagaggacgagaagccagatttgaaagatgggacctatttctttattcctcagagatggcagtgtacttggtctttaaccccaggaagtggagtcagactttgcttaatgtatttcttaaaggtgtgtttcctgttggaggagcaagcaagtcattgaggtgttagaactgggagcagagatacaagtagggctcttttagcaccttagagctgagttgtcctatataattgccgcaagctacatgtggctatttaaatttaaattgattaaaataaaagttaaaaattcaggtccttatttgcactagctacatttcaagtgctcagtaatcatgctgtattggctactgtgttggacagcacagctgtccttgtagaaagctctgttggacgcactgcctgacaaagagcagggaacacggcaacgttgatcagcagagctctgctaaaatcgtggtggtttggcagcaccttccagggcccgttgacattgtccagtgaggcctgcagaggacagagcccttgagtgaaagtgaaatgatgaaccgtcaatgttactatgttctttgtgctgtatttgcagatgggcaggatgcacaccacgttgtcaggttgcatcttgggagccaaatgctcaacattaaatgaatactgtctcttgctttcctgctgtgctttgttgctctttaaatgttcccagcagacaataatccagccgctgtctgcctgtatttacattttctgtcacgatagagagagtgggagctgtggcatggtaaaagcacttcaccatttctgtctttcccttgacagtgtcttctgagaatcctcagaaagtgaaagggatggaggtccttgctcaagtgacctgcaatgggatttgggtgggattcagctggataaattgccagtcatgttaatggacatgttcccgcactgccattccctgggcagagagacaaagtgacctcttctcactttctgcagggttcacaagaggatgtgcttaatatactgtagggggtagcatgagaaaggaagtagtgaaatggcctagaaaactcaagtggtctggaagcacggtttttaaaggagtcactcagagacatgcaacaaaacaaagagacaataaccaagatactttaccctcaagcgccatcgttataccaggaggaagattcagagagggaactatttattcactcaacaaatatttattgagtcactgccatttgccacatactattcttgtgcctaagttatagcagtaacaaataatctctgttctggtggaatttacatttcagtgagggaagaatagccaacacttattgagtgcagaccacatgctgggcacttttctagcccactcaatgcttataacaaccccctgagatgtacactattactgtcctcatttttcaaagggtcacttgcttggaattggcagaactggtcctggctacctggcttcctagtccacactcttgatcgtaccctgcactttactgtcactcctcaaactaggaaaggagaaggtcttcctggatgaagacagactgagcagtccctgccatctctgggagcaggaaccccatgtttaggacaggggactttgtaattggccttgcatttccccggtcccaggctcttgctcctctcctttggggcattttccaaacctgaagaatcctgaagctttctcagccttgtaataccattgagggcactgcaacttccatggttgcccctggccctggagtcccttagatctaggaatccttccctccttgatcctcaatggagagtccccttaacagattgctgctgatgctggtgtcccaagttgcagcatttgatttctttagccttaaataacttttcttaatgttgtcatgatgatgacaggaatatcagtgatgtcagaaatattctttttctagtacctccttggttgcaacaaagaaattcaaatctactttttctaatattttattttcattttcttttcattttatcttaattttattttttgtagagacagtatcttgctatgttgcctaggctggattcaaactcctgggcccaagtgatcctcctgcctcagcctcctgagtagctggtactacagctgggcaccaccatgcccagctctaatgttttattttctgttccttctgatgttccctttctgctttctgcagatttaacttttttaaaagggcttcaacctgctttttcagttccttctctgaactgacatgttttctggttctgagttttctcctctcctttacttctttctggcccctcccccaccccatcccccgttttaactttaagaacaaaaccaatttttaagctgcttctaatcctccctgggtttctgatgttctcattctaaagttcaaatagtagctttctgtgcacatgtgaattcctggagccttctcgcccctcatagtgtttttccctctgccttgatgcatgtctgattcttaatccacgtcccaaatacagaccatttagctttccctcctagaccccgggcttatgctattgccatttgtcttttctcctatctcaacttaagaaagtgtcatactgtgtcacctggcagaagggcttctattcatctctaactgctcacagatgatgacatttttccattgtgattaaactgacctccaggtctctgaagcctacaagcataatcaggacttatttaatattcctgattaggataaaaagggcagagacattttagaatcttccctgtcaagccaccaagaacatcatggtgtttcttttcatctctgtgaataatcctaagaacttttcagagattagagcttccttccttaaagagggattgctagtggtactgggtacttcaaagaaaatgtagatgagtcacccaaacccatcaaggttaattctacgatggaacactccaagtctttataaacttctctcaattttcagaattctgggaccgtgtttccacagagattagatggagtatttgtcaggggaactgatgaatacgtaattctgtgctcagttagccaccccttcctgcaaagtcctaagggaaatatatgatggagtcatgcttcttaaactttaatgtgtatatgaacctttcggggatcttgataacacatggattctgattcaggagattaggcattctgcatttctaacaagttcccagaagacactgatgctgcaggtctatggaccatactttgagcaacaaagggttagaggacaagaaaccagcgaaggagcattgttattactagctggggcttttctccatgctctggtgcattcctctattgaggaggactttgcagtaagaagggcttctttttccaagaggagactgttgtttacacctaggcatcagccaggctcttgcttggctctgttgggaatgaagtgctgtggcggacacatcctcccaagctggggaaagtgctgtgctatgtcttactgtaatggttataggtaaggaggagagttcaaagaggtagtagggggaaaccaagaggaaaatgactgaaatctttccaagcaagagcagaaattataatgcctttcctcgagactcagggatcttggctcccatgggtctactcattacctccccttatagcacactgaaaactccatctgtagtagtctgttctcacactgctaataaacacatatctgagactgggtaatttataaagaaaagatgtttaatagactcacagttccatgtggctaggaggcctcacaatcatggcagaaggtgaatgagaagcaaagtcatgtcttacatgacagcaggcaagagagcgtgtgcaggagaactcctctttgtaaaaccatcagatctcatgagacttattcactatcacaagaacagcatgggaaagacccacccccgtgattcaatgacctcctactgggtccctcccatgacatgtgggaattatgggagctacaattcaagatgagatttgagtgaggacacagccaaaccatatcaccgccttctgccccttgatatccctaacccatagcagtgctttttggaggtggaagagctgtggcaggtaggggagggaagagctcttcctttatattctattctttcacctagaatgtttctgtgtgcacattttcaatagatatatacatcaggtaatctacactgagctaatgtagcttctaaccaatctgtattcaaagactctagaaagctcaaagggcttgtagaaactattaaatccagtgactctgggtgggcacgggagctcacacctgtaatcccagcactttgggaggcctaggcaggtgtatcacttaaggtcaggagttcgagatcagcctggccaacatggtgatctcgccatctccactaaaaatacaaagattagccaggtgtgatggcgcacacctgtaatcctagctacttgggagactgaggtgggacaatccttgaacccggggggtggtggctgcagtgagccaagatcgtgccactgtactctagcctgtgtgatagagtgagactctgtcttaaaaaaaaaaatccagtgactctgaaacttttctgactaaaacctatttgtgcagggaacaagactcatcgcttatctgccaaacccaaccctactttctagacatgagttgttgtaacaatgagattactgtttacttttcctggtcttttctttattttcttttgtaattagttgtatatcttctttagccatcacctaaagctaggaatgaatcaaatttgagccttgagtcttctctaggtatcctgcttcagtccttgcctgctttcctcttaccccacagacccttatttccctgtaacctttgctggcttgtcctcagcttctgtatcttcaaatattgctctgagctctgtctcatcttctccacctcttcaggtgctctctggtcacatggctccaaatatcatctgtacactgatgacacttagatttatatttctaactcacaccacttccctgaaaggcagagttaaatatctaactggcaagctagcatctcaaacatggtatgccaaaactatccactctcctcaccactctggacatcttcttgccccaatcctaagccttttctatctcactaaacagctccatcatctactcagttactcaggcccaagatttaggggccattcttgaacactgttatgtttatgttcctcatctagtctattgattagtaccatctcctctacctccaaaaatatatcttcaattagatcacatctcactgtgtccatagccacaatcttattccaagctactatcatttcttgcttagaaaatcacaatagcctcctaactggtatcctgtcctccacttacgctccactctagtccatcctacaggcaacactcttatgctgaaaactgtccagtgacttaccactatgattaaaatgaagtgcaaactaaagacttttaaagttgtaaagttttaccttatctgactcctttctatctcatccatattattatactatttatcatccttgcttgtcataatcagaccagtcttctcactgtctgaacatgctatatcagtcagctattgctgtataacacactactctaaaactcaggagcatacattggtaagcatttattctctcttttataggactgcaagttgacggaatcagctaatctaggctgagcttgactgggagttcagctttaagttgttgggcttggctctttatagtagtttaagctcaaatctgctccataggtggtccttctggagcccagaatgatggggcagcacatactcagggcagactcttttctttgcaaggcggtagcccaggagggcaagcctattgcacagcatgttttaagcctttgcatatatcacatctatttatgctccattggccaaagtaaattcatacggtcaaactcaacatcaggggccatggtaatatgttctgtccacagtgggagtagggagggaatatatttgctgaatgacagtccagaccatgatactccaagcttgttcctgcctcagaagctcttttccttactgttccctctgcctggaatacagttgcccagatcttcacaagtctgccactcattatttagtttatgacttatgtgttacctccttagagacatctttgaggacctttgccttggctgaagaagccttctctctaccacattaccctattttatcttttccatcaccctttttttgaaaccaggtatcacttcatttacttgttttgttcatgtgtttattgtctgtagtcttctgctagaatgtacaattttgaacgacaggatgttatcttgttcacagaagtgttccagtgcctggaacagaacttgtcacataataggtgatcagtaaatatttgttttttgtccagccatctaatttttatatgccttaaagcccaactattgaaaattataagtctcacacattgatccaagtatgtatcaccacacatggtagaattaaccaaatgacccattacaatctaaatggataattatggagcttattaacatcaatttataagcaatcataacagcaatcgaaagccatgatcaactgaagatagcactgacattagtgtgttcttcctcaaaattgcgggctttaccaccatctgcacatgttcatacacagtaggaactttgaatgttgctaagtagttgagtcctgaataaactaaaagcacattaattttagttgactgttaacaaattacagtaacctacttagtaggttactagtaagtaatctttggctgtatacaaaatagcaccttgaaatgggatgccatttactcatgcaattaataaaaggagctttgtttttccatccagtttagacccatcaagacaacccttatggtctaccactgggtgtgggccacatttgaagggtgattgatctggtgcaatgccataatcttctagatgaggacattgaggctcaaagcagggaaatgacttgtccaagaacacataggaagtaatggctgaactatgaaatattttattcttgtcctctgactctgagcttagtgttctttctgcttctctgtgctggacctccatgtaaagtgaaaatatctttgcaaggaaaaagaatttcttacctgtctaaagtctgttaactctaattatttaactaataagaagataggtgagcaaggagagaaattatcctatttaaaaggggggaaactgagacactgaggagccaaacagtgacagagccccactagaatccatgtcttttgggtgagggaagacttctgtagtcacctggactgtggttgcagatactccctatcttttgacagtgtctgttggcagagggagaagcacagggtctgctggacctttgaccttacttcttactatagttcatagaatgaagttctttggaatcattacacaaaaatctccaagtttttcaagaactctaaggtgacatggatgagtggaaagatgtgatttggagtcagacagatttgggttcaaatccttctccccacttactaggtcagtaatcttaggcaagtaacttaaccactccaacctcagacttctaatctgtaagatggagatattaatattgtcctcccttcacatatgtagaaaagcatcgaagtatgtggcatacagagccacttaatagatagtggttatgattatttaaaagtggaattgtgacagatttcacacacacacacacacacacacacacacacacacacacacgtggaattgaacattgcccttttctcatcctattgtttttgccaagtgtgattttcagataaaggacattgaaggtgaaatcttatttacaagatatgttctagatcatttttagactgttttctcagtacactcaccagtttttacattgtttatttctctgtagtggttttggtaagtggaaatccaggatgtgtacgatacacagcttcccaggtagtttgttcctggttctacaccattatatcctgaaggctggaaacaaccttgaaaagacttttgtgccattcccatggctgaagttaacaacttgtgcacactattccaggctgataaaaccctttcattttctttgccctcgaaaggagaagtccctggtggtgactgcagttagctgattattggtctgctcccctttggctcacagatatgtcttgttcacaattacatgcctgacttcctttttatagaacacctggcacatataataatttttgagtattgcctcagagtgatgggttgtgctgaccaggaaggcaattgaattatttaaatagtgagaaaatgttaagtagtctgtgtgggcaatgtatctgtgtataaagatatatcaatgtatggttttgcatgtttgggaatattttgtacgatacattttattagtggaaacagaatgtgctgaatcttttgaaatatgcatctaaacatgatttcttcagcaagaggaacatgtcttggtcagcaagataactaggtcatctaggcatgatgaaaaggaagagctattcagtttggcaccctttcattcaaaagagagaaggaactgagatggaattcagatgtcttagtccattttctgttgattataacagaatttctgaaactgagtaaattataaagaaaagtaatttatttcttcagttatggaggctaagtccaaggttgaagactgcatctatacatccataaatggattaatctattcatgaaagcagaacccttatcacctagtcacttcctaaaggccccacctctcaatatgtcaatcttggaaattaaatttcaacatgcgttttggaggtgacaaatgttcacatcatagcagaaggcatttattgcagagggcagcacttgaggtcatgggattatatggggatacaagtgatctgagtatcagaggaaaaacctgagtttgtaagttttaggccttcttgagcatggcagctgtgtatggtttcccttgcttgagctatagttgggaactgcatgtcctcaagctatgtgtcttcatttgttctgtctgttggcatcactgaatgaaggaaaagctggctggggaggtggggaaatttgtattcttagtggctttctgatgggttggattgcaaagctccaattactttctttacccttgccatagctaaagaggggtgagcttctactaagagttagccctccaacatgtcagttcagatgcaaaaccttcattctatagccaaaatttttgtcctcttgctccatctgcagtggaattaggaaacccagtattcccttaatgacttagtgttgcacctaggatagaccacctaagaatcattaggtggtctttgtgatatggtttctgtctacatgtccagcagtgtcttaccactcacctccctgcttcctgtactccagccacattgaggtccttttgattccttgaatacctcatattccctcatgcctcttgggtacattttagatattttgtctgcaagtaactgccaacactcaattagcttaagtatctataaaatttatttatttcagtagcttttgggatacaaagtagtttttggttacgtggattaattgtacagtggtaaagtcagagattttagtgtacccatcatctgagtagtgtacattgtacccagtatgtagtttttttaattccttattccccttcccacccttctgccttctcagtctccaaaatttattataaattttgtatgcctttgcatacccatagcttatctctcacttataagtaagaactcatggtattttgattttccattcctgagttacttcacttagaacattggcctccggctccattcaagttgctgtaaaagacattattttgttctttttatggctaaatagtattccatagtatatgcgtgtatatatataattttctttatccactcatcagttgatgggcacttaggttggttccatgtctttgcaattgcgtattggagcatattctatcatccatccatccatccatccatccatccacccagccacccatccatccatccatccatccatccatccatccatccatccatccatattttgacatatatttactgaggggctgttataccctaggaattgttttaagcaatagggttagaatggagaacaaagcagacaaaacctctactctcatgggatttataatccagtgatagaaacagacgttaaatgattataagtaatgcagctattctagggctgtttgatcttggttgagtgataattctttgtacagttagcttttagggcagggatggaagaaagcaggggatgtcacacagtatagtgaacagctgggactatggcgggcgagaaattactagcacgttttgtaaaagagcaaaaaagttcaatgttttcatattttttctcttttaaaaattaaggtataggttgtgtactgtgtctcacgtctgtaatcccagcactttgggaggtcaaggtcggtggatgcttgagcccaggagttcaagacaagcctgggtaacacaatgagacctcatctctacaaaacattaaaaaaaattatccaggcatagtggtatgtgcttgtggaccaagctacttgggaggctgaggtaggaggaatgcttgagcctaggaggttgaggctgcagtaagctgtgttcatgccaccacgcttcagcttgggtgacagagaaagaccctttctcaaaaataactaaataaaataacataaaattaaggtgtaattagcatacaataaaatgagtagatattaactgttattgatgagtttttataattttatacacccataaaaccatcaccctctaaataaaaatatttttattatcccttcctgacacttcatctaccccccactatttagctttgcctgtccttgaactttagatgaatagaatactactattcactatactttttgtatttgctttcatttttctcaacataaaatttttagatgtagccatgttgcatatatcagtggcttatttttattgtcagctagttttccattgtatgaaaatattatttattttgggtaaatatttaggagtggaattgctgggacagagagtagatgtaactttataagaaaccgccaacgagttctccaaagtggttatttattttacaatcctatcattaatgtataggagttgcagttgctatattctccaacattcagtattgtcagtccctttgattttagccattcaaacgtatatttagtattatctctttgtggtttaaatttgtatttccccgatgactaatgatgtttagcatcttttcacgtgtgttttgtttttattcctatgtctcagtgcagggtccattaaagtcttttcttcattattattatttaaaaaatggacttgtaggagttctttattctggctgcaagttctttttcagatagatgcattgcaggtacttttcttacagtctctggcttatctattcatattcttgctggtatttctcatgaacagaaatgttaaattttgatgaagcccagtatatatattttttcttttgtggctttttgtgtcttttctaagacatcatttcctactttaaagccatgaagaaattttatcttgtagaaatttatggcttttatgtttagtatataatgtacctcggaattattattattattattattattattttatcattttgagacagggttctcattctgtcacgtcactcaggctggctgcaatggcaagatcatggctcactgtacccttgaattcttgggctcaggtgatcctcccgtctcaacctccccagtagctaggaatacaggtgcacaccaccacacctggctaattttttgtattttttgtagagatggggtttcacaatgttgctcaggctggtctttaactcctgatctcaaggaatccacctaatttagcctcccaaagtgttgggattacaggcgtgagacaccatgcccagcctggaattaatttttgtgtgtgatataaaataatggttggggttcagcttttaaaacacagctccccagatgttctggcactatgtgttgaaaagacttttcctatttcattgactttgtcaaaaattatttgtctatgtgtgtgtgtgtgtgtttgtgtgtgtgtgtgtatatatgaatctatttctattccgctgatctatagcttatccttatgctaataccacactttgctattactgcagttttatggtaaatactgaaatcaggcagtagaagaattccaacttttttttttttatgactgcttttctcttctaggttcttttcattttaatttacattttaaaataagttgtcaatttctttaaaaaattttgctggtattttgatttggattgcattaaatctatgcatcaattttggataatgcacatcttaaaaatatttttaatactaatacaatattgagttttccatgactcaatccatcaacattgtctatcattccatcaatttaggtttctttaatatctctcagcattgttttgtagtttttagtgtagagatgttgcacattttctgttggatttattctttttcttttggagttggggtctcactctgttgcccaggccggagtgtgatggcatgaccatggcttactggagccttgaactcctgggctcaagtgatgctcccactccagccttcttagtagctgggactacagacacatgccaccatgcctggctaagttaaaaaaaaaaaaaaaaaactctttttagagatgaagtcttgctgtgttgctcaggctggttttgagctcctggcctcaagcaatcctcctgcctcagccttctgagtcattgggattacagacgttaatcaccatggccagctttttgttggatttattttttaatattagatttttaatgctaatttaaatggtattacacttaactttcatttttattgtttattactatttcatagaattgcaattaacttttatatattggccattcatcttgaaattctgctgaatccactgattttggtagtttttttcttttttaatgtggcagattctataaggttttcttcatttacagtgttgtcatctgtaaacaatagcagtcttacttttctcatcttttatcttttatttcttttcttgccttattgcactgatcagtacttacagtacagtggtaaatagaaatgatgctgaatatttttattccaattttagttgaaagcattcaatatttcatcaagtctgatgttacctgtagatttttttgtagatgccctgtatcagaatgagttgtcatgtattcctactttgctgagagatttaaaaaataaaatccttggccaggtgtggtggctcacacctataatcccagcagtttgggaggccgaggcaggcggatcacctgaggttgggagttcgagaccagcctgaccaacatggagaaaccccatctctactaaaaatacaaaattagctgggcgtggtggtgcatgcctgtaatcccagctacttgggaggctgaggcaggagaatcacttgaacccaggaggtggaggttgcggtgagccaggatcgcaccattgcactccagcctcagcaacaagagtgaaactccatctctaaataaataaataaatacataaaatccttaagaatggtgcattttgtcaagtgtcttttttgcatctgttgagaaaacctggcaccaactctagttcaagtcagctttggaagtagtcatttcaacagtaggagctgtaagagggcaaaaatttataaacatggtttgtaaagatggcaaagaaaaactgacttttctttgagaattttctctgtaaaataaagttataactggtgagaccacaacattacttttcactcaaattattgtccttgaagcagaaaattttgtatatggcccacgtatcagaaattaccataattttaagatcttatcattaactatgtctgggtgaagtagaagaaaaaggaaaaaatgggtgctgtgcttgaaatagaagctataacattaacagatgacacacacacacacttttccttatttgattcaatttttccttccggaagaatggtcttaatacagtacagtataaagcaaacaggagaaagaaaaaattaagccctaatttggttataacaggaagagggcctcaatgtgctttaaacaatttctaatcctgagcccagatgaatctcatccaaagaaacagaacaaatttagttttggtcatccaacttctatgctataatcttagaaaaatcaaggagagtgagggatgtgctaatggcttctatgctatctgtccttattatttttaatggagaaattttgtattccaaaaagcataggatagcagagcctagtgatcttaatatctcttcttggtaaaattctgaattaaagaaattaaacagatggtaacattagaaatgattcactctgctggagctagttcaagaatacactcatatgtcatattttttttcctcatggctttttgaaccctggaaggtggaatcagttcagtttggtctttgtgcccctacattaatcacatttgagtctagctctaactacatattttcttgtaatttgtatttttaggtgccggtctccttcattaggccaccacctctttaaaaaccagggccaagtctaaaagatcaatagccaattcaaaatggcttaagtaaaagggagaaattaattagctcttgttattaaagttagtgttggatgtaacctgcatcctcctggaataaggtgctccaatgatgtcatcatggcttaatctcactttctctccatctctttgctccactctgtcttgggctggctatatttaggcaggctgtccccataggagcaaagtggtccctaggatcccaggcttatatcatattttctcaggaattccagttggaagatgctactcaagttgtttgctttgttttgttttgttttgttttcatcaataagcagaacaaaacttctggaactgtgtctcattggtttgtcatggggcatatacacatccttaagccaaatatgtggtcaagaggatggacggtgttgatggaccagacctgaaccccatgcctacccatagagttgcagggtggagtgaacacctgcatcatatgggctgaaagtgggtgagtggtggatctccagaggaaaatcactgtgtagctaccaaaaaagagggagtacatgacaagcaggaaaaataaattcaagtacctccaggttctggactaagttatctattgctatctcacagacaagttgactttgatttcagtagggcctttaacagtgtctcagaaataagacagttaaatgtgagcgtgttgataatatagttaggcagatttatagtttactgaacaaacatatcctaagaatgttgattcatgaattgatgttgacctgaaggatgaaccctagggccatgctatgtggtttgtatatataatttctgggctgacatttctcatcagcaacttgcacgaacacgtcacagttgtatttgtcaaatgtttaggtcacctgctcctagaattttgggtttcacagtcttggaaaattgtagaaaaaattatttaggaaattatgcagggtctccaactttttatttttgccaaggaaggatgtacatatattaactgtgatctattcatttcactaacattttactaagatatgacattttaatatttaaaaaagtatatgatgtcataagaaaagacagttccaagaaaggaaatttggctgccttatactgacattaaaataaaataatgtaatggatataacacaaacaatcgtaacataagaattcaattttcaaaattacagtgaatctcatttctgtaattttctctctgaagatttgtcatttggagatcatagactggagccttaatgttagcctgtggatttgattgtcttttagacttagtgaaaagttcaggtccatatagctctgctgacaaaaatagaagaaccacactcttaatgctgttttattcaattcaaatatttcgcattatacagagagtggttgagaaacaacttccccaaccccaagccacatacatgtacatatctggcctgactcatcatcagccgtttctgctccctccttttccctgcaggggagggaagaagctgtggtacccggcagtaagatgtgcgggaagtatgatagggggcgctgttacttagagggctgctctcacctgagtgctcaggtaaaaacccagctcattttgactgaagcaggcagaaaactagctgagagaatgctgccaatcaccagcatcctggatccagttgtagtcgcctatttgggagctgctgctggaagtaatgaagagctgagagaaattgctccttcactgaatgttagaaccaagcctctcatttcattatctccatggactgtaaccagaaaccaaaactgaaaggatggaatttcataggggttaatataaagttcttccaaggggtctaacacctcagctgtacaacaacaagccaaacttgagagcatttcatgtaaaaaagacctgtgtgggtttttgtttttttttgtttttgtttttgtttttttttttttgagacagaatctggctgttacccaagctggagtacagtggcacgatctcagctcactgcaacctctgtctcctgggttcaagcgattctcctgcctcagcctcccgagtaactgagattacaggcatgagccaccaggcctggctaatttttctatttttagtagagatggggtttcaccatgttggccaggctggtattgaactcctgacctcaggtgatccacccaccttggcatcccaaagtgctgggattataggcatgagccaccacgcccagccagacctgcggtttttttttttttttttttttttttttttttttttttttttttatgagacggagtctcgctctgtctcccaggctggagtgcagtggcgtgatctcggctcactgcaagctctgcctgccgggttcatgccattttcctgcctcagcctcccgagtagctgggactacaggtgcccgccaccacacccggctaattttttgtatttttagtggagacggggtttcaccgtggtctcgatctcctgacctcgtgatccgcctgcctcggccccccaaagtgctgggattacaggcgtgagccaccgcgcctggccagacctgcattgtttaatcgagtcaagttcaatatgatccagaggagtctatgtcatctatcttaggccacctgaatagggacataatgtccagatcatgggagatgatagttgcactagagcagagttactgatattttaggtcagataattccttttttatttatttatttttttgagatggagtctcactctttcgcccaggctggagtgcagtggtgctatctaggctcactgaaagctccgcctcctgggttcacgccattctcctgcctcagcctcctgagtagctgggacttataggcacctgagatggcgccgggctaattttttgtaattttttttttttttttttttttttttagtagagacagggtttcaccatgctagccaggatggtctggatctcctgacctcgtgatccgcccaccttggcctccgaaagtgctgggattacaggcgtgagccaccacaccaggccagaaaattcttttttgatggggtctatcttatgctttgtgcattaacagcatcccgggcctccacccactcactgccggtaggttcccccagatgtggcaaccaaaatatttccagatactgccacatatccctgagagaggggggaaatgcctctagttaagaaccattgcactagactccatagtggagctcgtattcagttctgggcaatgcattttacgaggaaaattcacaaactggtaaagtccagaggaattgcatggaccagggtgagatgtatgaacaccatatcactagtatattggaggaactaagactgttcagactggaagagaacagactctggtggtggtgatagagatagatgttggggaaggatatcccagctttacctccatccttccttctctttcttctttctctcccaactttttttctctgtaactcctttctttcttcccctttctcttttctctggcttcattttcctttacacttagttttttttttttaaatataattttaaaattgtgataccatatatatatgtaccattcagtgacattaattacattcacaatgttgtgcaataatcaccactatttccaaaattttttatcaccccaatcagaattcactcagttttatcttcctaccccatcactgggtatagagagacttctcctggctgccttactataatcccccaccttgggtaaattccaccatccatgctcagtaggaatggtgagactcagctgcttacagcctttcaaatttctattagccagctttagctggactcttattatcttcctttggtgcttatatatcccaaatgctttctgaccctatatacataccagagcatctgtttcaaacctttccatttttcttatttggctcactcttttactgcccataaccttgcctttatctcagtaaaaatttaggttatgtgaaatgagtttccttaactcttttttcctctggaattccaccgtcatcacctctcttctcatcctttaggctcagcctctgagagccatgtgattgtcttcctttctaaaccgattttacctaagcccatggaatctcctgcctccaaaacctgatttgagagccatgttctcctttttttgcaattttggtatgttccttctatttcctcttaacatgctgtcttagtcagcttaggctgccataacaaatcatagaacttgatggcttaaacaacagaaatttaacagttttagaggctgagaagtccaagattagggtttcagcatggtcaggttctggtgagaaccttccccctggtttgcagatagcctcctccttgctctatcttcacatggcagagagagaggggccaagctccctggtctcttcttgtaagggcacttattccatcacgacggctttgtctaacctaattaccttccaaaggccttgtctccaaataccatcatattgagggcttcaacatacgaattttggggtgatggaattctgtccctgcctcctaaaattcaaaacatcccttcaccctgatatccccttatactgtcactaatctccctcttctccaggtcatactctaagctgtggcaggcattgtcctcccacgagacccatcatggtgtcgcctgattcagaatgtgtcctgtggcctaataaatccaaactccttagcatgacatttgagaacttccatgaatctggctccaaaccacttttctcatcttccactacatcacgctcctgattctaagttcttcctatcctactgacccttagtgtatgctaagctaaggagaggcattttgagttagaaccaactgacaatagagagaggttgtatcaggggtagtgagtgcctgtccctgaaaatgttcaaaccaaagccaggaaaacaatccctcagagttattgtagagagaattcccaaagtagtgggaagatggttagaggtcctctcaggccagatttcttagtgttggtacttgacatttgaggctagataattctttgttgtggggagctatcctgtgcattgtagatgtttagcagtattcttgactgctactcactagattacagtagtgcccctaagtggtgggaatgataaatgtctcaagacattgccagatgtcccctgggggcaaaactcagttgaggatgactgttttagagtctcttctattaataagaatctgtaacattttgttcttctattttctaggtaataagtacttaaaaaattggtggaagtacctaaggttgggagaatgaagggaaagatgagaaggaactgatgttcgttgagcctaccatataccacgaaaatctgtgagatagagaattttatcccatcttacagatgaggaacttgaggctcagaaaaattatgcagctgttaagcagtgtagctaagtcccaaatgtggacctgcctgacaaactctgtcttcctctactttcctcttgcttttatctaaatgtatctccattgcttttaactcaactcttacattaacctgcctccctttatgaactacacatttaaaatttgggagtattttggtatttgcttcttgtaattaacttttccatagagccttggctcaacactctcctatagggctgacctggagtctcagacattgaaaggatccatggtccacgtggaagaagaagatcacattgaaatgctgtacacttctacttaatgctgctaatggtttgttgtgagactcagtgtcaccaggattcacaaacccgtgaataccaatggaactacagtattgctaataaccataaaacatctattcttgcatcattctgtccaagcataacctctcgtgttttgtgcgtcatctcaggaatctaagtctttctggggttccttctagggcatctcaccactcagtccgacagcttcatccaccactgggcaggttgttctctcttctcaactctggccagttcaagaagctgctggaggaggtttgtcattgccagggctgatagaatcctctctaaatcaccacctctgtccagggtgctgcgcctgattggcctccagagatgcaggtctttagagatactgttggagacagaggtgtcctccccactttgaccagaatccagccctctgggggagcagagtgttcctgggtccagaaggactcttactccaattacaccacactttgtttcctggactctatccctgctttgcccagaatccacagaatctcttaaggaactatcctgtctcctgtgtgttcttatacctctaaacatagtggctccaaccctgcccaaaggcctggggaggagagagagatacttcattctctccctacaggctactatcataatgaaaaaagagaaacactccctttcctctccccagatgccaaacaaaggtctcagaacatatagcggctatatggtgtgggttgggaggtaggttgcttacagctatagcactgggcctcaacttagctggccaccatgccctcttaggcaaatgaaaagaggagattgacactagattggagaaatgccaacatttttgcaccatcagtgaaagatttcagctggagtgtatgtagccgtaatgttgttctcaagtgtgtttaactcatccttttggttgacttaactagtgtggctggtccaattctctgctactcagtctgtgtccaggatgccactgatcagccagctttagagttgtgaaaggagagcccaagagacatttgggtacacactggtactggcacaaatgcagattactaatagttttatgttccagaccatgagcccctagactttttctgggaaaagtgaatctaatgactgttgtagtttctctgtcctcaagggcatggatggaagaaggcacatggagtgtgtccagccagtggaggacagagagggaatgattaattagggcttacggtgatggatgtcagctcctagatctatcaggcaagaccttgagatttccatctgggattctttgaaataaaaataagatttcttaggatttcaagcaagattggtataggcatacattcagctagtttggaaatctttttatctttctactttatttttaccactaaatctgaagtatggtgcctaatcccatttgactgtgtctgttaaagatttaaatgccactgccagattcccaggtctcacttggcccctttggaaaatcgggtctggtggaaggaaaactcggcccaacatctctaaatgcgcagcttctcagagtgccaaaagccgctattgtgtgctgtcccgcgggtataaaaattagctctttttcatgagtgttcaagctgctgccttatttatctgccaaagattcagactcatcttgctgtccaaactgcaggcatgtctggcatgagagtgtgtttgaggttgtgaggtggtggaggaggaagaattttattttgcatctgcacataaccactgttgggttgcctgttgtcatgaagtgtcaatggtaaggtgcagtttaacataacatgacattaggttagacaatgtgactaaactcaccccctcaggaactatagcctcaatacagtagccagtcacttgggcttaagacttgttctagtggatacaagcagtcacagttcaaggctacctggcgtcttggagcacctgcactacctgggtgaagagaaaaaaaatgtggagttgcagtcttcagaaatagttaccagtgtgcatctgcacagtaaacttatgaaaatacaacatacgcttcaagctttttgcattctgcttttcttgagaataccagggttcattttcttgaggaatgtcagaaatattttgtagtctcagcttaatcttagatttgtttgtaaagctccacaaacaaacccacaacttgggaagtttggcaaatgctcagtccaggagatctaaatcttgactcagttcttcaagttttagcgaaggaatgactttaaaatgtcttcttgcttttacatattttgaaacaaactctgggagaaaatgtatttggaagggatcttggaagctagctggttttgcatgtgtgataaaacaagatgcttataggtttgctttaaaaaaataaaacctcgaaacttgaagtctgatatccctggggccatttgataaatgttgatggttttgcagagccacacattatttccttttccttttcacatttatttctttgaaagacatacgagagtctgaactttgaagggacctggtagcctttgctaagaaaaggaaacttctcgggagagaaccttgtgagtgccttaaatatctttccaggtgggcaccatcacatgagtgatttttccgatgtaaagttgcccactttgtggattagtctgtggtctgaccatgtctcttagagtcaattgtttgatgtgttgtttcaagccaggttcatatggagcagagtgccctttggttttttatttgttccctaattgtttagaaatgtgctcattaaaagacaaagtaaacacggttcaggtgttgtgctgaaggcagggattgtggggtattgcgagggagacaggagagatgagagaacacacgtggtccttcttttagataaaagcctgtcccagaaacaaaggctgttggaatacaaaagctctttgtacactgagcacgtctgcggttacggatgaaccctctccaatggctgctatcaaacttgtcatattttattcatgagttgtggtgtgcctggatgaaataagaaaagcaaagcttcaaatcataattagggcataaaaaagataaaatagttattattttgacatttttgaagaatttttaaatctccccgataattcatttgaaaaagttgcatggaacgactgggtgtgtggcatgtatttatgctggttggagtctcagtcacacccatacccacagtgacagactccatgcgtatggtgaataagagcgtaattaaggagagggctacagccatcgttacacataaatagaaacgttgacaggcatctttgcatttctcacgctcacattattattctgtggttgatcaaaatattgctttcctgttttttacatttttgtcttttttagagaacatggggtctggatcatttggtatgcctggtatggggggacttgagggaatagtggcaggaaaaacttaaaagtatacctgcacctacagatgttgtgggacagcagcacggggttgaagaaagacactcgtcctgttggtttacatcatgaatttttaaaagtaagccgaaacactttaaaaaaagatacgccaaccttactggaaagacaaaaaagcccaactgttgttccatggctttctctgtggatgcagggcttagtgactcctcatttattgactaacttacccggagacacctatcacccacaccatccatatgctcatggcctctctcctccctggggattcggcgtgaggtatttatttactcagggtttatctttgtcctgctggggtctatccacccattctcactgctgggttgtaagctatttgagaagcgtggtaagagcaagccctcccactgtagccaccgcatgtacccagcctgcatggggttgtcctaccctggcactcaggcatggaggaaagtgagagcgacattttcaaaactggtcatgtgcatgatcacatgtgttaatatttgttgtgtggattctgggatagaaatattctcattagtcaccactttatgaaggagacaccaagattcagagggattaaatgaccacccagatattagtgttggagtattaaatatcacccagatactaagtggcaggactgatggtgcatcccagatcttctgatccccaattctacttcaacactggaccacgttctgtgacctttttcatatcatgacacataaggaaaatggctgtatttgtacattacacggaaggaaagagaagggactgtttttatgccaaaagtgctctgccgagccacagcgagggctgagggactcatactacagtgacacctgtaactcaggccctggcaggccagctgagaagcaccagggtgaggctggcgagcctagaggggctgggaagaacctggaagggcaggaatggagggggtttgtgtggggcctgggtgagtgtgtgtagtattagcataagttagagatgtgctggggagggtcttcaatcccaggtgcatagggggccagccaggtaacagctgagtgatgtgcactggcaaggtaatgcagccaactggcaacattgtgccatgagctgcatttcttcaactctgcattcactgcactgttgcctgtgggaatatgggctctgcgttgccaggtcatctaattttttaatggagatttgaatttttatatgaaatgtttcaatttttatgctgtatttcactgattccaaggcacacacacttattcacataacagctatccagaacttttttattttgcaaactgaaatgctatatccattaaataataactatattttagggtaggattggattttgccttataggcaattggtataattatgtaataaattacatatgtgttacaattatggtgtctcttataatcaacagctttttgtttatttcttagggtatgtcaaatgatggtgtattttataatctatggcactgtggacttggtgaaatatggtgggttgggtgagtaacactgggagctacaccaacatgctgaggctgcatctggcctgaggctggtcagtatgctacttttgacctggagccaggatagtcaccaagataccaagacctgaggctgggacaccagttctcagctgtgactgcccatcatgtttatttgaaacaaataaataaatattgacacctggcctacaccccagacctttttttttttttttgagtctctcagggtgcagactgaaaatcacatttaaaaaatgttacccaggtgattctgatgcacagtgagtgctgagaactgctcagctggagggagttgggaggaggaaaaggtgagatgttgagtctgtgttcacaaaaggctgagggggaaggaaactacacgtgagagtcaggtatttgttgatcttgttgaccaaaatctccaatcaaggaatgagaactgggggctgctgtttaaattggaatgagggctgggaaggatgactcatgcctgtaatcccagcactttgggaagccaaggcaggaggatcacttgaggtcaggggttcaacaccagactaagcaacatagcaagatgtctctacaaaatttaaaaaattagccaggcaggatgacagatgaccatagtcccagctacttcggaggctgaggtaggaggattgcttaatcccaggagttcaaggctgcagtgagctatgaacatgctattgcactctagcctgggtgacagagcaagaccctgtctttgttaaaaaaaaaaaataaaatgaggcagatacaggagaaattctaatgctactgtatactgtaggcattgtacttgcatggtaggtttagggacaacgtacagatagcttcagaaaggcttaattttctaggttcatacaggttcagaagggattaccaaggattaccaatggattaccagtcatccatccatccatttctccaatgtccttcagtacctgctctttgtgctatgtgtggcaccagacaccacagcacagtggtgagcttccatgcagcctcacactaggataagcccaaagaaggaaaagctgtggtatggtaattaacatagaccaggaggcctgctttagctgggggctggggtctagggaaatgacgtttcagctgaagcctgagtgatgaatggcaggtaaccaggtatggagtgggcgaaagtgtgtttcaggcaaaataatggcctgaccggagaccctaaggcaggaaggagcttgtgtattagttggtggaatctaaagaagggccaagaaggaggccaagaaggagggaagaggtgaggtgggagttgggcctggtgaggtctataggagtacattgtgtagagttttgttggtcatattaaggggattcaatttttattaaatttgcatttttaattgcagataaaaaaacacacaacataaaattgaccactgttaccatttccaagtgtgcattccagcagtgttaagtatattcatggtgtataacagctctccagaacttttttattttgcaaaactgaaatgctatatccattaaataataactccatattttaggaggattggattttgtcttagaggcaattggggtcattgaagggttttgaacaaggcagtggcatacgtaatcagttgtgacacaagtatgtaccaggagctgtaagcacaggtaagctgcacctaagctattcaagggagtgaggaaggtgtaggtagacatctccatacttcaggattgatgtcgagaatgacccttccctgggccccctgtcaaagcccaaacactgggctggatggcagtaatagtgcagcactttatagcagtgagaggagcaactattttcatgtgaagtcatgtcatttctactctaaactgcaggcagggtgaaagcagggagtgcaaccagatagtgcctcaaagaggaaggtcctcatctgactgggcatgagctgcttgttttattggaaaggaaagacacaaggtggttggcattcagggcgtggcaaggttttccccaccaactggcttttagccacatattttatgtataattttgccacagcatccttttttggtatttcatttaaacagaagatctcaccatgattaaagaactatctaaaccctctagtgtgtaatggggacagggcaaggttgagagagcaacttcctggggtcctgctttgaatctctcttttgtcaacatgtactttggcatcccttctctctcaatctttgactggatggagaaaaatcatttcttattttgagcacttacctttaaaggaggctttaaatcctatttcctattgacatattttttttttttttttgtttcagacagagcctcattctgttgcccaggctgaagtgcagtggcacaatcttggcttactgctgcctctgcctcttgggttcaagtgattctcctgcctcagcctcccaagtagctgggattacaggcgtgcaccaccacgcccagttaattttttgtatttttagtaaagatggggtttcactgtgttggccaggctggtcttgaactcctggcctcaagtgatctgcctgccttggcctcccagactgctgggattacaggtgtgagccactgggcacggctgctgttgacatattgatcaatcacgatagtctgttatgctgctgtgtgccagccactgtcctggtgtgtctgttgttggttccttcaggtgggttcttggtcttgctgacttcaagaatgaagctgcggaccttcgcggtgagtgtaacagctcttaaaggtgacatggacccaaagagtgagcagcagcaagatttattgtgaagagcgaaagaacaaagcttccacagcatggaaggggagctgagtgggttgctgctgctggctggggtggccagcttttatttccttatttgtccccacccacgtcctgctgattagttcattttacagattgctcattggttcattttacagagtgctgatggttgtgtttacaatcctttagctagacacggagcactgattgggacgtttttacagagtgctgattggtgcatttacaatactttagctagacatagagcgctgattggtgcatttttacagagtgctgattggtgcatttacaatcctttagctagacagaaaagttctccaagtccccactcgacccaggaagtctagctggcttcacctctcactgggtcttgattatgtaagagtatgacagacaccctgtccttgaggggctattggcctaggtacagtgaagagggaaccagcaatatatcatattcattcattcattcattcattcattcatgcactcaacaaatatttattgcacatcatgtgacaggcactgttctgagtgttaaggatgcagcagagaaaagacagtccctgtctacatgaagcctatattctagcaaagatggccaatggccaatcacagtaaacaagtatactaataaatgagtaactttagattgtaatatatactatgaaggaaatataagagctatactggagagagaaagagagagagagagacttagggggagagttgactttacattggggaaggcttccccgcagaggtgacgtttgagctgaagcctaaatgaaggagccagccatgcaaagataatattattattaataatcactcacattattaatgacgaacacttcatatgctaggtactattctaaattctttatattcatgagctcatttaatccttataacaattgtgcaaaggagataggtattatgagccacagaaaggaaaatagaggttaaatcacttggccaaggttatgtataggtccagtaagctgagagttgaatccaggctgttgtgctccgaagcccttgttcttgaaacagccagccaaaaggccccttggatcaaacaagtttaaagggcacaaggatggcccatgtgggtgaagctaccaaaggaggccagagagcatagccagggcctttcaggccatggcaaggagttagggttttattcaaatcataatgggcagtgtggagagctggataatgctgccctccttcccagtgatggccacattctaatctccataacctgtgactatattacttcaaatggtaaaagggactttgcagatgtgattaagttaagggtcttgaggtgagaagattatcctggattccaggtggggcctgtgtaatcacaagggttctcataagagaaagacatgaggatcggatagaaaagtgatgtgaagatggaagcagagagagatcataagattctatgctgcttgtgttggagatggaggaagaagacacgacccaagggaagctgaaaaaggcaaggaaacagtctcccctagagcttccagagggagtatggccgtgcccccatcttggtttttgtcctgtgaaacctgtttcagacatctgacctccagaactgtaatataataaaattgtgttgccttaagcctctagggttgcagtaatttgtcacaacagccataagaaactaataaagcaactctttgaggactttaagtaagggattgaggtaatgtgatttaagtttgaaaaggatcttcctgattttctgattgctacatgggatagagagagaaaacgacaaagactaagaggaaaggggaaatgaggagaggggacaggaggggaggcgaggagagacaagtggaggcaaactgacagtgaggggctgatgcaatattctagtcaagaagattgggggtcacagtggaaatggagctcagggcttgctgatggatgaatgttctttgaggcactctgacaagtaagacagaaggcagaggagtgcacaataaaggagcctctagacagccccggaggtaggaggacaacaggaagaatgcagtgtcaaaagggcagaatgtttcaaaaggaggcagagcacgactgtttgggaagttaccaagggttcacttagtggtcaggccaccgtctggccattaactttggcacaatgtagagaataagatttgtaagagtgggtggtattggtcagtgcagctaaaaatactggccagatatttctctccagactgagtccatcttaatcaccacagtacagagcctggcacagagaacatactccacaaatacatctttgaatgggtgagtgattgaattttggattcgaggaggaaaatcaccctcagctggggtgctagaacttcatggagttagaggaattgggttgggccttgagagatgcgcagggcttggataggcacggagatggctggaactctgggagggagaagggttgagatgttgtccccacggagccccccacttgtgcctggctgtgcttcagacccttcccatgtcttgcgctctgagatctgacaagtactctaattggggttgcacaaggatgaacttacaactactcttggtatgggtggttcagggagctgaaaagaatatctgttgtctaagttagatgatacccaagtagaaaagactgcgtgggagcctaccagcatcctttgaaatgaattatcacaaagtctttatttaatacactgaaggaataatttatcgaaacagattcaatgttcttaccctaggacacgcaagaaccaaattatttgcaacaatgatcaaagaccaattttcccccaaattgacattttcatttcttttaaaaaagcttcagtaaatgaggattatcattttagccctcagttatggctctcatttggaagggtttgaggtgggaaattggttgagaaagatcctgcagccagatagcaacaggccgtgagctcaaggagcaagtggcatttccagtgattcattttaaggggggacattaatgtttaatacagtcagaataacatctctaaagaggaggtccatttttaaagaaaaacagcaagtctgccaaaggaaaaaaatccaccacatccatagccccttttctggacagatgcacacatttcttggagcttctgttcaaagcctggagtttcaggtgacctgtttcctgtccggaaagcctcactgtccttcctgagcacaaggttgaaggctgataattgcatagtttccccaggaacctgaatgcacaaacaccctgtggccaacacagatagataaatagtgagggagacctcctcagcagtgactctggaactaattagctaacaaggcatgtaattagattaatgcatgtgatctaagagctgatgatgtgctttttaggacagtggaaataaaggagctgaaaagaaagcattatattgaggagctctgaattattattcctgtcagaaataccagctgggagggtggggtggtggtgagcatgagggtagctattcatcacttagttcctgctggttcatcagggactgacattgcttcatgactcctggctgctgtggaaaataatttttcccctccttctgatagcaaggtgagaggctcctgtattatttatttggcacacattgtagccagatctgcactggacagaggggtctttccagaaacaacctgcacagttgtttctggaaagacccctctagcttccccccggctctctccttgggctcaactggagagaagaaattacatatttgaagcttactaagccccctccatctccccaagtgcaggcttctgcaatgcagagggtccccctccccaagtactgagtcatgtccctcaccactgacctctgggaccccaataaagccaactttacttctcactctccactcctttcctacttctcattaattcctttgcctccatctgaggtaatgctgccctgttggtccctgagtgtcaaatctgtgcagtttctggggtgaaatattgctgaggccaccaaagtcatttctcactgagcctctgacagtttgctaattaataagattttggtcattgcatcctatgctgaagttggaccaatttcccaggggtgggaagtcagacattaatccactaaaccaactaaattacttgtgtgtgagagaagacaatttcttcaggagtattttcctgtggtttgacatatcgctttgcaggctatggacttttaaaagcactttctagtctgatgacggggaagcctagattcctgatagaaaagtcatatgattaagataccccaagatacctctaagttctaaagatactcttagagctgtttgcgtatcatagagaggggatgccagctctattttgaagctggggaaaaatctatctggtgctgttttctgtcaggcttaatacaagcttattcagaagagtgtgtctttctgcttctgtgtgccacaactgtctttttgcccgcggagccacaggagcttacctttgaaacattagctgttcaccctagtaattgctccatcctctaatttaatgaaaacccattaaaccgaaacaataattaaaatgagacatcatctctgtaggaggtttgcatattaaaatcactgtgcctttcaatgcaggcagatttttattcttgaaaaacagcatttgaagtaacatgtaaaaatgatttataatgaataatcataaattacagagcttggcagttgaacatgatgccctactgtttactattgaatctgagtagatgtggcaaggtcagggccaatacagcatttaaaaatgtctctttcatgcctgagaattaggaccgtgcacaaaagggaatgaattataattagatcagcccaccaaacttttaaagcaggctagagatgacacccttaatatacagagtagtttagactctgggaggaggagtgttgctacgtaggggaggcatagcattggagtagagaagtaatgatgctctcgtgttggggactagggaagccaaacagaaatatacacaataagctacaaagttggagtcagagacacatctctgctacttgctagaggtgagatcttggataagtcacttattttctataaaccacagattcttcatctttaaagtgaggctattaatgcccatttaattggttttatgaatttgaaatactatcatgtatatgaatatgcttagaaaatgttaaagtcctgactttaatgtctagatatgggcatttttttaaagcatctcagaaatgtcataaggtgcctattacctaaatattaggcacttttcattcattcattcattcattcattcattcctgaaccctggaaggtgagtgttacagatgaggcaactcaaggatgaaggaaggaaaacagctacctaaggtcttacagcaggtacttggcagagctgggattcaaacactggtttgtctgagccaatagatggtgctgagggacagtggtgccttatgattggctttagacagatctgggtttgaattccagctagactagttagtagaacacgttttaactttttgtatctcatctgtaaaatggagatagcaatgctgacaccactaggctgctatgaggattaaattagcatatataaagtccttagcttgacatctagcaaaaataaaaaattcagaactgtttggaaattggctggctggacttagattggagtggctggaagtcccatagtctctgcccaattttcaatttttgttttaacagaaaagagttagaactgaccactaaccatgcctccaaccctggctggcaacccctgctcacctgctcaatgctctcctgctgggccaccataaccaaccatcagtgtgacctttacttcagccccagctgcagcaccagggttcttttggcatggtggctgctgccatagcttggtaccccacccatcctacaggacccagggcctgtcctggctgtataccaaataagctaacagatgtcatgtgctgcttatgtggaagacagttttgagagtttaacatgtacttattgatttaatctttatactatccccatgggtagatgtggttttattctcatttgtaaaaatgaggaagctgaggcacagagagattaaattatccaaggttatatacttgataagatgtgaaattggattttttttttcttttttttttttaagatggagtctggctctctgtcacccaggctggagtgcagtggcgccaccttggcttattacaacttcctcctcccaggttcaagtgattctcctgccttagcctcccaagttgctgggattacaggtacatgccaccaggcctgactaatttttgtatttttagtagagatggggttttgcaatgttggccaggctggtcttgaactcctgaccttaagtgatctgcctgcctcagcctcccaaagtgctgggattacatgcgtgagccaccacgcccggcttgaaactggaatcttaaccaaacagtgaggcttcagagcctgagctcttaaccactaccctacattgcctcttacctggaagattaagtccctgatgagggactcactctctggtcctgctccaggtgatttcagacctatgatgacatgacctaaacatgacctttttttcccctctctctttcttctcttctctctctcctttccttccctccgttccttttttcctccctcccctcccctcctgtcccctcccctcccctcctgtccccttccctcccctcctgtccccttccctcccttcctccctcccttcctttctccctccctccctccgtccctcccttctttcctccatccctccctctcccctcccctcccatcccctcccctcccatccagtccacttactttccctccctccttcccttccttccttcctttcctccccctctcccatcttctcttctctccttcctttctttcccttccttccttttttcctccctcccttcctctcctttctttttttctttccttctctcctctctctcctttctttctctctcttctttcctccttctctttcttttcttttcctttctttcttcttagagatagggtctttctcactatgttcctcaggatagactagaattcctgggctcatgttatcctccgtctcagcttcctgagtagctgagattacaggcatatgctaccatgcctggctctacttttcttatatctctgaactgaaaagctgagcaggatccattcacttttgtttgtgtctttattactagacttttagatcttcatgaatagaaggtgtgtcttagttttttgtccacagtgctggttcagggaatgctcagtaagggtttttaaagttaagaatgaatgaacaaatgaataaatgagcggatgggtggttagcagagggcagggcaaggactgccctcatgtctttataagaacatcgagagcatctcttgctggaactgatgttcttgcttgcacccagcaacctttggtgcttagagttttgtacactatgtgatgagtacaccttggggttctcagattcttgacaatcagtgtgtattaaaatggcacctgaggagggttgctggtcagttattgccaaaaaaaaagaaaaaaaaaccctgttgtcctcactgatttaaggatacacaattgtgggactgaaagcaaggtgattggtgcttattttcttcttttgtaggatgtccttcttgtttctcccatttctatgatgagctcatatattttagcataaacattgtagttttttttcttacaataactctcagagaagatttggaaaattcagacatgtggaaagaggaaaaatttcacccatgttagctcccaattgctgacaaaattgaaggccatgcctatctatctgctatgcatcacaaaataaattttatgttaccatagacttggtatgatgctgtatgtactattgtatacctgtttcagagtattggctggacatttcctatgttatttcaatgcctttcatatcattatattacaatatataattttccatggggtgtatatatcctaatttacttagccattctctaccattggatagcttcttgactatataatgcactcttaatcgtattataaaaatcttttcaccactctttttgctttttgttctcctgtcttgtgattcagatggagctggcattcatactttaactctctctttattcctgtgtttctcactgagatgcggtgggaggtatggggatgagggggatggggataaggggacttgattgctggtgggtggcagtgtggagaggcagcctaaagaggagtggctacacatgtttaatttcttagcaacagggaatgcattgattttcctactagtattgtcaaatgtttttaagaagagctcatctgccttatagtacctaattagcaaaattatgggggtaccagaatctcttttgatcgaatggcacagtaattacaaaaaattggttaataccatgtgtcacaggatgccttaggtttagtcccctaatggaggagttagggacattgaactggctttattattccttaggcagctcattacttgaatgtactttttctcaacaggtttgggttatatttgtgtgtatttggtaaacctttttttcttatattgtgttccagactttggagccaagatgtagtttattaatgtgacaaagatttgaggcttaaccaggtaccaggcactgtgcttggtgtagtgtacatgttggtaggcaattcttcatggaacttacagtccagtggggaataaatatagcacttggctgggggccgtggctcatgcttgtaatcccggcactttgggaggccaaggtgggtggatcacctgagcccaggagttcaagaccagcctgagcaacatggcgaaaccccatcttctaccaaaaatacaaaaattagccaggtgtggtgatgggcgcctgtagtcccagctacttgggaggctgaggcaggagaatcgcttgaacccgggaggtggaggttgcagtgagccaagatcacaccacgatccagcctgggcaacagcctgggtgacagagtgagatactgtctcaaaaaaataaataaaaataaaataaaattttatatatatatatcacttaataaaatgattacacatgtaaatgattctatacataatctctgacaattgtgataagtacaatgaagataaataaagacaggaacctgagttggcctggggtggtcagagaaaactggtctgaggagtagcaattaaactgttatcagaaaaggagggagagaagacaggttgctgcagatgggagtgtaccaaaatgggtaggaacgtggccctgggaagaagggatattagttaggcttgtggtgctagaatgcgggagtgtgggctgtgggggagaggaaagggaggaggatgaaaaataagcagaagcatcagttgaatgccatggaatatcacagtcgactctgctggggcaagagtcagctttgtctccactcgtcatgtgaccttgggcaagtcatgaaacctctctgtgcctcagttccttcacctgtaaaatggagatgtgttggtatttacctcataagggttgtacaaatagattgttcattcatttattcaataaatatttcctgagtgaacacaaaagtgccaggcactgggtgtatcatggtgatttacccttgatttatatcaagcactgagatcacacattttggtgaatagcaggtgtaacacagttaagagtgtagctcatggaaccagctttccaggttgaaatctcagcaccaagccttcctagcccagtgtcctttagaacattatttaaattctgtaagctttagtttggtcatctgtaaagtaggaataataataataatgtcttctaaagttattgtaagtgcgatgacatgtgcagggcattagccctgcccttggcacagtaataagatatacaggtttgatttctctcattccggcttctggaacaaatggaggtttaatggaatattattgtgaacttgttagtggagatgaaagtcccttacacgttaactgggagtcttctagtgacttctgtttttttgaaagctgcttggatcaataacatctgacatccttaaagaagggtcacaagaccaaatagtgggacatgtgcctcccatcctccaaaaccagaaattgcctcactgatggttggcagttctgaattgacaaatttcctctacattcagaaatgaaaagccaactgtcatttcaaattaagaaatgttgctttaccttttggggccattcttaccatgagcttatgtggcactcaggctagaaggttgtggcctgtctatatcaggagtttgctatattttgaggttcacagtgtaattactgaaatgttgcctgcattctctaccagtcaaggctgaggcgggctgccttggtgcattttttgtttatatgtttctggctgctgctgcttttcccaccttgatttgctgattcttcgctgtgaactggtggggattctgcctcttggtctgctttgtgctaatgtggtaccccttggccaatcaggggcctgagaatttgctccaatattaggttaagtagatgctttctctgctgaacttgtagtaagagatacacttgcagaaaaagaaaaatgccagggtaatgtataacacgtgagttcacagccatacgatgctgctgcagtgagtgccctcttctccctctctcctgcctagtaagtgcttattcatgtttttagagtcaggttcaattatatcctccatgatgttatccccaatctctatgggcctcctctgtttttttgtgcactgccctattctgcaactattgtcataaggaaactgtcttgcttacgtgtctatcctctagggcagaaactgtgtttttacttttatttccccagtgccaaccacagtgcctggcataggggaagcaaggtatatgcttgttgacaatgaaattcaccaccatcctcactctatacatcagggaagagggaaatgaagttgcttctatttgaggcagagaagagtgtgtgtttacctcatttaatttctttccttctccaatctcctcccttcacccagcacttttttttttttttttttttttttgctgatgtttaatcatcatattagcatttttagtctttctttaaaaatgactaggtagagccgtcttatcctgggaaagaaaaagcacttcactcttgctgctgagttagcacttcttaactagaacatgcaaaacctgagcatttggaacgccattttcccccgttttaaaaatgtgaaatattcactttaagtggttgttgtgtgcgaaactacctttatgcaatggtagcctccaagtacacccccagggttacaaaatggaaagcctcacggacagactaaattcaaatacttgaatcatgtttaaaatatctaggaggaaacaggggaaagagatggagtaggttaacacatgtaggattgagtgtgagcagtgggaagcaccagcccacccagttcctgtgttattcattgctcatatattctgttttttttctctctctctctgctgcatcagcttctttgatgatggtgtgattatgaggactggagctgaggttaacgaaaagggagggggctcagcaaatgggaggtttccagagcccacatgcttcctctattggaaatactcagaagcaagtaatcctggctacaactgtaattcaccagttaatttggtgagcagtgatgggttttattagcatttctcaaggatagtatatgtggggccagaatggaaatgaaatggatgtcaatgatgggtgttggtttagggatgacatgactgtcattctgaaggtggcatgatacgcacattatgacttggtcctcccatcccattgtacttgtaagtaacactcttattcaatcctttttatctgtgttcaacacacttatgttccacgtattcaatctatgtttagcatgtttcacaggtttctaacttgctctctatatttagcacttcttatgggctttatctgtcccatttgtttttcctgttatctctagcagaattgaatattcttaagtaatacagcaaatacatactgtagtggttgaatatggaagtacaatattcactataggttcccattaattgggtttcattggttgctcttttaactccaggaaaaaagcaggctgctgcaaagtaggtgacatatcactatttttaagagttgacaactttatgttttatgttaatttggaaaatcagcagaggagaaaaattgtagaatctaggtttcttaatagatggaatttgctctcagtgctctcttttgctatgcagctatgagcaggatcaagtgattaactgaaatgaaatgtcaagactaggaaagaacttggagatcatggaatttagtggtcttaattttcagatgtagagtgtgaggttcagagaggtaaggtactttatccaaagtcacacagctagtcatctgcaaaactcaaagtgatctcagtcctttgaaacctgtccagtgtttctgcctgcatattgtaagaaatagaattactttgttggtgtttttttaacatctggatcatggtcaaaatttacttgaaagggcttctctgagagtgagaatgcacataaagcctcagtgtatcaaaacaggtgtttcttacatttcactctagtgagtgctaatggggtctctttacttcagtgtgccaatcatttttaaaaagaaataagaaaagtcaacataagaaatgtttcattttcttggaggattgagtgagcagaagtttggtaggactagatcagactgttaagtgggggtgtcctgcaaagaagtggggtttatttagcaccaaacatcattacaataaattttcatggccatgagcatttgagaaggacccatttatctcctggttttccaaaagatatattactttctgactataatatatatggttacttgaagtaacaatataaatgagaaaaataaatggaaaatacattaattaattcagtaaacctttattggatgcctgttttgtgccaggcactaagaattgtggataaaacaatggataaataagtatgcctgccctcatggaacttacagtctagtgggaaaagaaaggaaataatatgaggtaacaagcttgaaacaagactgtgataaataatatcagcaaataataaatggattacaatacatatattatgacaagtcaaatgaagaaaatacccagactggagcattagagagacattaatgcagagtctgccttggagaggccagaagattgcatttacagtgaaagctgaaggagaaggagtcagggacgtgaaaaggagagagaagagcactgtgggcagagggacaagcatgaagatctgaggtgggagtgggcctggtgtgctcctctagtaaccaaggagaagagtgtgaatggggtgggaaaggcaggcaagaatcagtttgtgtgcaactttgcaggcatgctgaagggactggattttatcctatgagcaatgggaagccattggaggattttaagcaggaggctgaaatgactcggacttagggtttaaaaagagcacgttaactacagtgtgaagaatggtgaaaagaaggcagtatggaagcaggaaggagatcattggaagtgccctagggagcaatgatagtggcttgggcaagagttttaagagtgaagttgggaagaagtggacagattccagacatgggagcccacttaacttgtttttagactggatatggagagtggagaaaagggaaaaatcaagggcaatttctagttttttgacttgaggaacagggtgtgaccgtttactaagactgggacctttgtgagaaaattgagagtggcgggaagagaacaggcttcactgtaggcacattacaatttgaaatgcttgaaggtgaacgtttgaatttactgcataagggagaggttagggctgcagatataaagttggaggccattggccatggggttggatgatatcactcagggagaactgagtgagagatgacgatacccatagctgataggatattcatatccatttcctccagcaggcattgctgatcgcttatggctgtcttttctttgggcccaagctttacaatcctgaaattcaggcatctgctaccaatcagttgatttctaattgatgagtaaagaagaaaaaagtaaaaagtaaacatataacttaattttaagacttgaattttttttggcattacttgtaggtaaatttattaagatgatctttgcttagaagtaatgataatagggtgcagtggctcacacttgtaatcccagcactttggaaggccaaggtgggtggatcccctgagctcaggagttcaagaccagcctgggcaacatggggaaaccctgtctctaccaaaaatacaaaaaaaaaaaaaaaaaaaaaggcgggcatggtggcacacacctgtggtcccaactacttgggaggctgaagtgggagatcgcttgagcccgggaggtggaggttgcagtgagccgagatcatgccactgcacttcaacctggtgacagagtgagaccctcatctcaaaaaaaaaaaaataataatgataataaaaataatattaacaaacattttctaatactctttagtttacagagtgatttgctcacacatttaataggttttaaatgtcatctggaatatctttggctgggattttgtagaaggcatagaagcatttttcaagatgctatctcttttctcaacacttgataaaagctgacagcatgccacttaagaattaagtagcgaaggccttgctactattgtgcaggtaggttttatactggtagactggtctgcctgggttgggtgtctccatggtggaggacaaacattgctttctgcgattcataccctagatacttgcagatgggaaagactgtgctgttcttttctgtgttataaaattgaagcagcaattcaaaaaattatagaaggctaaggtgggaaggttctaagagatcacctagtctaccccctcattttgcagatgaggggactgaggcccgaggtcaagaattgaaggatatcttattcagaagccattctttaggatgagattcttcaaggtccgtataccagtctgtgatattgcttgggcagtgcagcatttgaagttctatgtttttcaagggcttcccatgtagtcctggagaaataaccatgtagttatcttgcagtcagaggagatggtcaggatgtgagaggaggtcaccaaacacacttctaatgttcatttatcatcctctgaataatcttctctaactttgctcccttagtgcccctttctgatgccagaaaaatgtagtgtaaaataatgagataacacccagtttatcatgacaagggtgagtctgggtatgaagtgatggatgtctcttgttatgctgatattggagaaagaaacattcttgtctaggagcaggattagctggaatcacacacctctaggcctgctgaatcggcctcaacttcaataaatatttcatgaggaaagtcatccattgcatgcttatggagaaattccaggcacgggtgtggagcatgagcatgccttgtatttattcgttaagcaaaggcagagttgtctggcattattagtgctagtaaatatctgctaggtacaaagcaaggacaggtttcctatatccattgtggggagaaggaagctgtgtccatggaaaaagtgaaattggaggatgctgagtggcatttgggtcttattatcccaagattctctgaatttaggaccacatttatccgactacctctcaccttatttacagcaacctaatctgtttgcagcaaactgaattgctcagcgtcccgtcaaaattcctgccagaaaatcactgtctggccaattgggaacttgtcaaagtgacaagtgggcatggtgacagagacagcatttccgggatttgcattgaatgaatgcagctgtagggagtggggaatggtgcctgaaaatgaaaactattgacagaagaggaaaatgaaacttgcaatctggattctttggacatgacatttttaaccatggatcttttttcctcttccttctcatctcccctctcctctttctcctatatttcttctctactccttctccttcctcttctcctctcctgtttcctcctgcttttcttcttgattcctagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggtaagaaagctctttctgcttttgaaaatctccttagagttaatgggttatacaaaatgtcttgggatttagagtttgtagccccatgaaaactttcatctaactgaggcctcatttctgttgaacacattcatgaatttactttgcattaagaatttactttggtcaaagtggctttcttgtttgctctccaaggaccaatcatgagtatctttctcgtctgtcttctggtagactttgaataaaatcacattctgtcatatttagtcatcaagcaagttagttagttatgtttaacaaccttcaataaacatttacagtgtgtttatgtggggattatacttgacactgggaatattaaggtgaatagtgtatgatcttcatcgcaaagatcacataagctagtagggaagatagacaaataaatataataaagtattgaagatgcaatgccagaaggttgtaatcaggaaataaaggtaagagcagtcattctgctaagtgttgtggtagccaagaaatgctttggaaaagaagatagttgtataaggaaaaaaatgtgagtattctacatgctgaatgcgaaggagtaagggatggaagaataacatttcagaaagaggttgctatgattttaagaagcaacacatgggtaggtaagtcgttggaacataaaagtgtgtatggggaagggatgagagtttggggtgggcgatggggctggtattatagaggtaggtagaagccagatcatcgcaaagcttcaatgccatgttaaaaacttgtactgaagtcccctaggcaatgggttttaagtttaagaaagatcactcaatcattgaattcaaattaataatcattaggtaacctaaacaattttattttttaatactgggttcctctgtattagtccactgaaaatatttatgaagcacctactctgttctaggtgccatgcgaggttttgtggagaaatcaaaggaacaaaatcttctaagcatgtatggtggagtttggcaatgcaggaaacaaggcataaccacacaaaaagctgaagaataaaaaagagtcaataataaagaaatagtagattggtgttacaatgaagtatggagctaatttcaaaattacataaatgtgttaagttcactgaattaaatgcattaggttagtggttgaggaagaccatacagagagagtgctcttgaagcacaggcagaattccagcaggtaagggaagaagggtgttacatcaaacagaaggaacagtgtgcacagtcacagaggtgaagaaatatagagaaatgcaattttgggagtgggagcagcaaacagaccaatttggctggaacagaggctctttctatgcagacttttggtagttgtaaggatcaacagttttgtctttaatggttgtttgttctcagcctcaaagcgtggtgatggaccctgatcattttgtgggggtgttgtcattacaatctggctgttctgggtcagcccagagaaagcaaggtgatgtacatgtctgtgagagatatgggttcgttcaaaggtgttctgtatgctggagaaaggtataggttctcattttccaaggattgagtgtcaaggcaagtctcagcttcacaaccctaccttgccctattggccttgtggggttgggtgtgaatgcttctttggtatgagggttatacaaatgcccaaagtaggaggtagatcttgagatacttctcaatgaatgcagaggagagcttcccacagcaggtgagaagcatgtgaaacagttgctattatattagaaagagcacaggtttcagagtcagtctgatggaggctggagttccagttctagctttgtgacaccagctcttcaatgtcttggaacttcaatttccttgtctgtaaaatgtgtgtaataatctattttcccgggctgctctaaggaagaaaaaggattgtgcatggtgagtggccatcccttgacacatatacatttattctccttgtctaagtgtgttttgaaactgtatttgcagggtttctcttttggatttttttttcaataggaaaggttttaaaaaaacttttttgttgccatgtgaggctgtcttttatatccctagtaggtttctaatagagcccaaggatgattgataggagagtcatttgatcatttttcattgtaatagaaaaacttcagaattttttttttttttttttgagaaagggagaagaggctgggcactgtggctcatgcctgtaatcccggcactttgggaggccaagaagggcggatcacctgaggtcaggagttcaagaccagctgaccgacatggtgaaaccccgtctccacttaaaatacaaaaattagctgggtgtggtagtgcatgcctgtaatcccagctactcgggaggctgaggcaggagaatcgcttgaactcaggaggctgaggttgcagtgagccaagattgcaccatcgcacaccagcctgggcaacaagagcaaaaccccatctcaaaaaaaaaaagaaaaaaaaaggcggggggagaagaaaaccgtgtacaggggttgaatgcctttagccaaagaaggtgaggcatagaggtctcttaccactagggaatatatctgagtcacacagcaccaaagtatattagcagtagaaattatctgagtcacaagacaccaaagtgtgttggcagtggagggtatccaagttacatgccaccaaaatatgttactgggggcaaatccatatgggtctacagcaagacccatatggattttcttcttgtgtcctcagaagaaaaatttatctgaggggcataaggcagaaggagagaccgaggcaagttttaaagcaggagtgaaagtttattaaaaagctttagaggccaggcgcggtggtttacacctgtaatcccagcactttgggaggccaaggtgggcatatcacaaggtcaggagatcgagaccatcctggctaacacggtgaaaccccgtctctactaaaaatacaaaaaattagccgggcatggtggcgggcgcctgtagtcccagctacttgggaggctgaggcaggagaatggtatgaacccgggaggtggagcttgccgtgagccgagatggcgccactgcactccagcctaggcgaaagagcgagactccgtctcaaaaaaaaaaaaaaaaaaaaaaaaggaaggaaggaaagtacacttgcaagagagccaagcaggcaccatgaaagacaagtacgaaaaatctcaaacctcagatcctgactgctaaacaaaataaatatgaagaagtagatactagatcccctctccctctggactttatgatgccctgttccatgtgtgtgtagtctgacaaggcaaggtatgaaagactgtggatttgtaatgtaatggctgggggtaatagagaaaacctggtttctactctagtagagaagatctacttaaggagactggaatgtaagaaaatagagaagaatatataatggcatatatttagaaattagtctattcattataactctcctcccctcgccaaatgttcccatctgcaataagtgagaatctttcataattttcaggttacttttattatttaccaggataaaagtatctagaggagcaaattatcctgtagaaatttggcatggacatttgaccacgtatataagttgaccaaggatttggggcttttctttattcaatagcagaagatccaggtatgtggtagatagattgttggcttaaaaatcagacacccaggttctttttgtgattctcccttatgtgattctgattgtattactagtgatgaagataagttaaataagtatttgaaacaattgggatgtgatgggcattattagattcctagataattttttatttttataattcagtagcttttagtataatcacagaattgtgcattcatcaccacaatcaattttagaaatgctcattaccctcaaaagaaatcccataccttttagctgtcacccacaatttccccataagctcccaagccttaggcaaccactaatctactttctgtctctgtagatttgcctattttggttatttcatataagtgaaatcatacactgtgtatccctttttgactggcttctctaacttagaataatgctttcgaggttcattcatattgtagcttatgtcagtagttcacttctttttattgcagaataatgttacattgtttggatataatacattatagatatccatttatcagttggtggacatttgaattgtttccactcttggctattatgaataatgctgctatgaacatttatgtacaagctattgtgtggacatgtttttatttccttgggtatatgactaggactggaattgctggatcagatggaaactctgtttaactgtttgaggaactgccagacttgtccaaagtgactacactgttttacattccccgaagcagcgtttgagggtttcgatttttccacatccttgtcaacactagttattatctttctttttgatgatagacattctaatgtgtatggagtgataccttactgtggttttgagttgcatttgcttgatggctaaatgatgttgagtatcttttcataagcttattgacgatttgtgtatctttggagaaatgtatattcagataatttgcccacatttaattggattctttgtctttctatcattgatttgtaataatcatgtatgttttagaggcagtcacttatgatttacagttttttcccccattctgtgggcgatcttttcattttcttggtggtgtcctttaagcacaaaggttttaaaatttgatgatgtccaatttttttttattttttattttttgtgattctgatgtcatatttttgcctaattcaaagtaatgaagagttactcctatgttttcttctaaaagttttataggtttagctcttacatttatctcttagatatattttgagttactttcttctaaaagttttataggcttagctctcacatttatctcttagatgtattttgagttagtttttatatatcatgtgaggtaggggtccaactttattcttttgcatatgaatatccaattgtttcttcaccacttgttgaagactgcttttcttccagtgaattgtattggcaccctgttgaagatcaattgaccataaatatgagggcttatttctggtctcttactgctatggaatctttggggtgttgcttttctgaccagaaacctgtggctggtggtgcctttgcccgagttttgctagggcccactgggctcgttctacccactcggcctggcaggctgcactcagctcatggtactggcctaggtgtcatgcctccaagggagatgggagtcaggcatggagcagcaaggggtgtgtgagtgagcaaggggtctggcccctgcacattcagatacaccggctgctgccacggggtgggcagctccaggtaccggcagggttaccaactctctgtgaggttgtggctggaccaggtacacctcaagcagcttccaccagcaccggggaacacggtggcacctggaagcttggagacaccaggaactgcaaggccccaaagagggagtcacagccctggctcggggagcccaggtctgtgctccccaaagggctgcagctcttctcttctctcctctttgcccccaatgtggcaagcaaggagaatgtttcagtcctgtttgtgttacatcttttttagcctcattcagtgagtcccaagttcttgtcctgcaaccaggaagaatgaggtacacagacaagtggagagtgagcaagatgaagagaagctttattgagcaatagaacagttcagtcttccacaggagtagctcctttcctcagccagggtgtcccaacaggtgttcagctcctaatagagaggagaccctggagtaggaagctcctctctgcaggcaggtcctgctgttgtctctgcagctctcagcagagaggaggccctagagtgggtggcttctctctgcagcgggttatcctgatgtctgcttaagtttcagcagagaggaggccctggattgggtagctcctctctgcagctggtccttctgatgtctgctcagctctggctgagcctggggcttatatgggcctcagaggggaggaagtgcatgccagttggcccatgggcagccatggataggcctcgaaaaggcactacaagttcccattcctgtctgtggcactggcagccatcaggccctccctggcctgaaggcgaagcctcactggggagccagccacttccacccaggaactgtctacctcctgctgacattcatggtgcccagactgcaggtgccaagggatacctgcaggcaaatgctgagctgacttcagcctcacctcagcttccctcctatgctcattggtgcccaaaatccagagagggctaaggtggcagagggctggtgtgtcagcactgccctgagtatgtgcacacccagccaggctgtgacagtgccggaactcggccccgactttgctcaaagattggtgcaggtgcttatttcagacagaagccaggcagtaggagcaggcatttctgagcctacaagtgcagtggggtccttcccaggtctccaagagtgcagggatgcgtgggcccacagctgcagctgtgaagggaagggttggggctcttgcctgcttggtgaaacaggaggcctgggtctgcagccacagtttgggcagctgcagctgagcccagcgaggtaggactcctacctgctctgtggagtgggaggtctagatctgcagccatgacttgggccctgctcctgcctgctctacggggcaggaggcctgggtctgtagctgcaagtgggcggctgcagctatgcctggggaacttctaccccaacttggaaggggcggggcttctgctttttcaaggctcccagtggctccacaaagcctgcaggcctggccacgcctccctgctgcacctggtgtgatggtagcggctgctccagacagcctgccgctactatcattacttctatttcattgatctatatgtttatccatatggaagtgctgtttgattattgcagttttgtagtaagtttggaaattgatgaatcttccaagtttgttcttcttttcaagattgttttggttattctatttcccttggattttcatatgaattttaggaccagcttgtcagtttccgcaaataagtcagttgagattttgatagagattgtattgaatctgtaggtcgtcagtctgaggaagcattgccatcaaaacaatgtcaaataatttgattcctgaacatggggtgtctttctactttctcaggtcgtctttcatttctttcaattttttttgtttgttttcaaaatctaagattttcgtggcttttgttaatttattcctaggtgtatttttttatgctatcatacatggaataattttcttaatttcaatttttggttgctcattgctactgtatagaaaggaaattaatttttgcctattactttgcatcctgcaaccttggtaagcttattgattagttctaatagtttctagtgaattccttagaatttttccatataagattatgtcatctccaaatggagattgttttatgtcttcctgtcctacctgctgcctgttagttcatttttataccaaattgccctggccagaacttccagtacaatgttgaatagaaatggtgagcagatatctttgtattgtttctgattttaaagggaaagctttcagttttcaccttgaagtatgtcagctgtgtggattttcacaggtactcttcaccagtctggaggtttttttttttttttttctatttgtaggtgttctttatcatattggagaagtctctttctattcctagtttggttagtgtttctgttatgaagggtgttgaatttcttcacatgctatttctatatctactgagatgataacatagttttaatcttttattctgttgatgtagtgtattatactaactgattttcagaaagctataccaaacttgcattcctgggataaattccacttggctatgttccataatcctttttctattttatggattcgatttgatagtatattgttgaggacttttgtatctatatccataagtgaggtattggtctgcagcttgctttctttccatgttttaatatgattttgatatctttcttttgagttttagctgatttttaagctatattgaatagcttttttaagctaacatttgctgattgcataccacgtgccaaacattaattttttttagatgatcccctttgacttgttaggtatataattgtgtaagctgaaaatattgaaaatttttcctttcttcaatttcaatatttatattagcgatttctttttcttgttttatgatatggtctggaatctccataatagtggtaaataatatatgaacaaatcaaaggtgttcattaaagtcaggaagagggcaacagataatccttttttctttccaactttaataaggtcctctgtttaataaactgtctagtagtactttctaatatctatcactgtttctatctgtctttatctatctagtcatcatgtaaaggaaatctaattttattcctattttactgaaagattaaaaaagaatagctgttatattttattaaatatcttttcagtgtgcattttgagatacttttgtgtctgcccccttttatctattaacataagtaattacattaatagaatctataatgttgagctatttctgaaatccttgaataaacttacattaactaatgctttagttaggatctttgtatcattaaataatgatagcaatagcaatattaataaaagcagtagtagtaactacattagtttaagcactgaagaattataggcattgttttaaatactttaaacttattaaacatttaaatgttttaatacattaataagtgagatgccatagatttttctgtgtatttgagttaattcaaggctttttgaattttttatgtgctagactatttaaaaaatatacattgtatcttttctacaagtgtttctgatagaatgagcctgaaaatagatgcaaatgtaattagatgtaaataattacatgtaaacataattagaaaaggacagaaaatattttgtatagaaaatatttgggctgaaaagtacaaaaaatatttaggctgataatttggtcttggggaagctggaaaatattttattattgaaatgttcattttccacttcttttgtggtatggtttctatctaattacttttgagctcttcttgggatcaatttatgtttttaagaatcctatatttcattgatattgggatttttttggcaagtagttggacgttatagtctcttttacttaataaaatttttatatttgtgatttttatctcattttatttctaatgtgtgatatgtgtgttttcttcttttcttggccaggctcatcatgggatcatgtaatttattgatcttttaaatgaaacagttcttagttttattgatcaagtggactgtttttcatttcaaattcattgattcctacttcttaccttatgttggattatcttgttggtatttttactagcttcttccatgtttagttcatttgtcttcagtattttctgtttactggtaaaaccactgatggttttatgtttccttgtgaatattgctttgaatacagcccactgatattgctatatagtgtttttattttctgtacttttctatagctcttaatttcattttggcttcctctttaaccctggttaaagcagtgtttaaatattccaaagtgattaaattaaaaatgcttaatgggtgatttctggttttattgttaattgagggcataaaatatgtgcgtcagatttttagatttttgagttgcagaattttttttcctggtgatctttcacatgctcaatatttttgatacatttaaaaataatggattgcttttgaaaatgtatagataaatacagacatatgactttatatgtagcaactttgagttgtgttatttaacttctatgtgtattgattaactgattgattgctcaatccatgacagtctgagagaagtaggttaatggctcctattgtaattatgtaagcatcgtaggtattgtaattatcattttttcatagtctccttggataggtttaagggtcaggctgaaaatgtcatgtataatctgtatcccatttcattgaacagtactgggaaattcagcctagcattgtgccaaggatgagagaacatggatattggaaacattaggcagtctctgtcttgattggttgaggtgttacctattgagtctgaacccaaatacgtggaaatagcataggtaacagactgcctcaaataggggtttctccaggtaataatctcaagcacatagtatgcactcaataaacacattttaaatgaaaaaaggatttgtcttcttcatctccagttagagctgctcagaattttcatgactagtttcaaaggttcacatggaatacattgtaccagacaaaggtattgccctgggtgtgctacacatgggaggctgtgcaggatagtgaagggggcaaaggttttggcatctggaggctgaattgataatacctggtgatttttctgaggattagtatttgtaaaatacctagcatagtgcttggcatacaaaagaaactcaataaaaaagccataatgatgatgatgctgatgatactgataatgacgatgttatctagatggaaatttgatgctgaggggagacagggtgctgaggagtggccagatgagaaaatagtcatcccacacaccacccccagttcggtgattaaaggaaaataatgactatcacccaaacctggtaatgttcgattttcagttaaaagtcatctttgctgatgaagcacaatgagggaacagcattctggatctgatcaccttccctaatcatcatgagcaccacaggaagtaatcatgcccctgccttttccaaagctgtcaaccagagaaacttcatttactgttttggaaatcactgtttccaatctctgctaggcttcgggctactctcaggcacagccattattgaattagaagacttcattcagtggctgagttcccttctggccaaaggcagacatctctctcacctggtgggaacccagtagccagagttagaactcttgggagtttgtgtttctttaaacgaggagtgaacttcttggcaaagcagtatctggaaactccctaggtaactgagccaattgagttcccatggatatcttaagtgggcagataaaacgaaacagaaaactgaaatataaagactattaaaaatgtacctggaggtagtaattgaaataggctcttttatgtaatggaatgggtactctgttattaattccaatgtatatttctaatgtgataaaattattttttacagtagcaatagagtgcattagcagagcaacaaagatgagtctgtcttgctgaactatcttaatgacattgcagatttaatgtttattttttcggattcaaatgtgttaatatagagctttgttaaaatggaaagcttaattaatgcagattaaatctaattgaacactctgccagtatatgtaactctataagatataatggtaaatcttctgttttttaattttatttctaaatgatagataaaattaagttgaagcacaattagatgggaagttgaaagctagggttctaagaaaaagcttcccatggaatccttttctgaggagatgaagaagacatttttggcttcctaagaaggcatctccttttttttttaaacaaaatttttgtttttcaaaagatactcttcagttttctgagctctcatggtggaaataactttctactgtgatgccaagtagacttgggttcatttcctggatctatcaattgctagatgtttgagcgtttgcagttatctttaatttacctcagactcagggttcttctaggtaaagtgaaggtatccattgattaccacatcatagagttattggaaggattaaacaagagcagttcctcatacatctcgtatatcaaggctctcagtaaatgtcatttttcttcctgtcctcatggctgctttagatatttcctacttcttcctaaaattcttcataagggaagaaggtagatgttgggaccgtcccaccatttgaaatagtaattagcttttcacatcaagatgttgttatagataatctaaaacaatgaattgcccaaatggaatgcattctgtaattcctaaaaaagcatgtttaccttcttaattacagatgacttaagctcatatttaaattattttgaacttttataaaattgattgaagaatatcagaatgtagggtaggaggaaaggggagaaaattccagaagtatgttacatggtttgttgaagccatgtaactttctccttgggtaattctttcctcaatgagatacaacattggcttatattattataaagtagatattttcaattattaaattactttcatttgggaatgaagggagcaaattggagacttgccctaaaaaatctatcctgcttttgaagtatgcaagcaagtctccacacttcaaacaaatattgggtgtctatgattagagagtctttagagttaggactatgatccgagtagaccgtaagctgtcttgtcagcatcattctggagataacaatgcaaaactatcaaatactgtgtggtcatagatgctgggctacaattgtgagacatacaagagtggagacagtcaaagaaacactgccaagtattgttagtgccctgataggaggaatacagggagcaaggcaccctacctcgaccaaaaggagtcagaaattctttccaccaagagttatgcttaatatgttaaatagaaggataagcagatatcagccaagatgaatggaagagggttctgaatgcagcatgagcaaagaggtgagagatgagggatgacagtgcattaaaagaactgaagaaaaatttattattggagagtggagaaagcataggtaaggaagaggcaaggtgtgtcaagaaataaacctggggaggcaggcaagaggccagattgtgaataggtttgtaagcaatgcgtaatggtttagcctttaggcccagggcattgggagccatggaaaggatataagcacaggcttggtggcatgattagggtggtactttagaaagaccacactggctgcttagtggagaatggcatggagggggcaaaattggagacataaagacaggaggttgctggccgggcgcggtggctcgcgcctgtaatcccagcactttgggaggctgaggcgggtagatcacgaagtcaggagatcgagaccatcctggctaacacggtgaaatccagtctctactaaaaatacaaaaaaaattaggtgggcgtggtggcgggcgcctgtagtcccagctacttcggaggctgaggcaggagaatggcgtgaacctgggaggtggagcttgcagtgagccgagatcgcggcactgcactccagcctgggcgacagagcgagactccatctcaaaaaaaaaaaaaaaaaaaaaagacaggaggttgctgcagtattctagaatcgagatcctagataagaggacagaatcctgcactatttcagataatggtggtgccaattgagggaagttaattctggagtagactggatgtagttctatattaggggatagagaaggaggagtcaagggtgatgcccagggttctggcttgtgctactggaagttagtgtgccctgggcagatagagtggggtggtgaatagcttttttctttaatcattgtgctgtgtgtgtcatatggccaattctttgcatttactttgtccaagttttcagttgaataaattaccacaaatacagaaaagtagaaaggagtaataatagatgggatgtattttccagtaaatggttaaaagctgaaaatgtgggccatctagagatgctgccaaatgctaggagacaagacatctggattctgagattccatcatttttatctttatgcctagcacagtgtagacatagcttcaaggaaacgtttaaaggatgtatacttgaggatggacagttaggctatggtgtgcattgggaagtagcaattttcaggcagaaatgaaaatgagtggaaggatctgatgtccagaaaatgaggatgttttctgcaacacactaattaagtaaaatttaaatcttcgtcagaagaaatgaagctgttcagatgacttttgaccttaattgaagccaagaagtatcatagcaatagaatataatactttgggcaaattgctcttgcttgtatatgtgcatgttagattttggattgcctagtgtttgagaaatgaaaaaacagctaatgtagccattaacctttacttttttagtataaattcacaatttcattaatatttttgcataaaatcatttaagctcaatggaattctcctagagaatttaaaaaaactcttctttgacatcctttggaattagttgtgaaacacttgcatttctgggtaacatgcattcgttcatttggttctgtggtgagaaatgtggacagaatgttgttgctgatgaaagatagatttaactcctgacttgctgatttctgggtgaaaggcacctcaggctgtcagaacattggtgagggtggtgcaatgacagtgattctgggccaggagtcagaagacctggactcaaggctctgctttgtcaatgaatatccatgagaccagacaggtcctccctggacctcagtttacttctctgtcaaattatagttcattaattattcatcagatactaatctgctttggacacttatctgtgggctaggaacattggtggattctttagcagcgaaggtgtgtaaggggcctgtcctcagggagcttttattctagtggggtgagtcagatgataaatacggacaaaattaaacctaatgataaacgtcatggaagaaaataaaacagagggatgagggataggtcagtagagaagagaagctggagagggctttatgaagataggacgtttgtcctcaatctaaaaaagaggcagctatgaaaaaatcagaaagatgagtgtcccagatagctgagacagtaagtacaaagactctgtgaaggatccagtttggtatgtttaggagacagaccaagagctagtgcatttaaaactttgttagttgagggtgatgaaagggagtggttttagatgaggagatgctgacagcaatagcttccttgatgatttcacagtgtgagagaccgtgtatcatgacaaagtgtgatatttatacaaggccatattatttcaggacaacagttacttactaagtgcaggctatgtgcaaaggaagtctacccatccatccatagtgttccttggaaatccaaatttcataatttataaaactataacaattacattttttagagcaaatgcacacactttttttctaaaggacattttagttctcctttcccccttcttattgattgacttgattataaataataataatactttggtaggagtgaattggtagttcaccatttgaagcattatcagttcatctggagacagccagaagtatgtatgtgtgtatgtatgtatgtatgtatgtattattactattatttttagattcagggagtacatgcacagagttgttacactgttatactgcatgatgctgagggatatggagatatgaatgactttgggatacagatggtcccatcacccatgtggtgagcatactatccaataggtagtttttttagcccatatccccctctctccttcctccttctagtagtccccagtgtctgttttgctcacctttatgtctatgtgtattcaatgttttgttcccacttataagtaagaacatgcaatatttggttttctgttcttgtgttaattcacttaggatcatggcccccagctgtattcatggtgctgccaaggacatgattttgttcttttcaatggctgcgtagtatcccatggtgtatacgtactagattttctttatccaatccaccattgatgggcacctaggttgattccatgtctttgctattgtgaatggcactgtgatgaacatactagtgtatgtgtcctttcgatagaatgaattcttttcctttgaatgctagtgggattgctggttcaaatggtagttctaagttctttgagaaatctccaaaatgctttccaaagtgattaaactaatttacattcccactgacagcatatagacatgtccttttctccacagtctcaccagcatctgttatttttgacatttaaaaaataataggcattctgaagggtatgagatggtatttcattgtggttttgatttttcacttctctgattattagtgatgttgacttttaatatatatttgttggctgcttgtatgtcttcttttgggattgtctattcctgtcttttgtccatttttaaattggattatttgttttttgcttgttgatgtatttaagttccttgtagattctggatattagacctctgttagatgcagagtttgtgaatattttctcctgttttgtaggctgtcttgccaataatagcctctcctgagaggtggagagcctcatctctaagatgggtgcagcacaaaagtgggggaagtaggtggtgtgtgggaatgagaaacgatgaggatgtgcccgtggctggaaaatgcagcctgcagggcaggaactgcaaagagatggggctgatgatattgagagtgataggcatcctgtctggatttgttaataagcagtgactaaatgttgaaactgcaggccatagttggcttgtagaagggctttccttggttgtgatggcttccacagtatccttccacaattaaaaaaaacaaacaaaccatgagttagtttccaacatttgaaaattgaagtgatttggtctaaaaaatccagctttccaccttctcatcaaaaataggtatgtatttttcagattgccacagtccctagttctctcagttgtcttcccatcaccataaggtcatgtgtcaattgctgctgtgtggtttcctttttaatgaatgtaaagttaggagaaaagtgaaattcttaaactcatttctttattcaaagaagaaaaataaagggacttaaaaggtagcttgttttttaaaaaatacgttagacttctagcctacttctgtcatgtaagatgctgcctggcccctgtagccactgaagattttgactccctctcaaggttatacagatacaaaatggcagagccagaatgcaaagccccatctgaagattttgccctttcagaccttttgcccatttttaaatcaaattattagattttttccccatagagttgtttgagctccttacatattctggttattcatcctttgtcagatgggtagtttgcaaatattttctccctttatgtgggttgtctcttcactttgttgattgtttcccttttccgtaaagaggttttttaactttatgtaatcccatttatccgtttttactttggttgcctatgcttgtagggtagtactcaagaaatatttgctcagtctaatgtccctagagagtttccccaatgttttcttttagtagtttaatagtttgaggttttaggcttaagtctttaatgcattttgatttgattattgtatatggcaagagataggggtctagtttcattcttctgcatctgctggtccagttttcccagcatcgtttattgaagagactgtcctttctttcccaaatgcatgttcctggcaccttcatagaaaatgagtttcctgtagatgtatgaatttgttcttgtgttctctattctgttccattggtctatgtgtctgtttttatgccagtgccatgccatttgggttactatagctctgtagtataatttgaagtcaggtaatgtgattcctccagttttctttttgctcaggatagctttggctattctgggtcttttgtaattccatataaagtttaggatttttttttctatttctgtgaagagggtcattggtattttttataggagttactacattgaatttgtagattgctttgggtagtgtggacattttaacaatattaattcttccaatccatgaatgtggaatgtttttccatttgtgtgtgtttgtcctcttcacattcttttatcaatgttttcaagttttctgtatagagatctttcacttttttggttaattcctaagtattttctttttgtatctgatgtaaatgaaattactttcttgatttctttttcagatcgttcattgttggtgtacagaaatgctgtttttttttttgtatcctacaagtttactgaatttgtttatcagttctaatctttttgtggatcctttaggtttttccaaatataagattatatcatctgtaaacaaggataatttgacttaatcctttccaaattgtatatcgtttgtttctttctcttgtctaattgctgtagctaggacttacagtactatgttgaataacagtggtgaaggtgaacatccttctcatgttccagatactggagcaaaagctttcagttttttcccattcagtactatgatagctatgggtctttcatacatggcttttattgtgttgagataaatgttccttctatccctagttatttgagggtttttatcatgaagggatgttgaatttgatcaaattattttcagcatcaagtgaagtgattgtataattttttccttcattctgttgatatgatgtatcacattggttgatttatgtatgctgaaccatctgtgcatacttgggataaatttcatttggtcatgatgaatgatctttttaatgtattgctgaatttagtttgctagtattttgttgaggattttttgcaacaatgttcatcagtgatattggcctgtaattttctttatttttttacatgtctttggttttggtattagggtaatgctgccctgatataatgagtttggaaaaattccctcctctatttttcaggatagtttgagtaggattggtattagttttttttaaaatgtttggcaaaattcagcagtgaagccattggatcctggacttttctctgctgggagatttttcattacatcttgtatctcattacatatcattggtctgttcatattttgggtttcttcatggttcaatcttgggaggttgtatctgtctaggaatttatccatttcttctaggtgttcaaatttattggcatatagcagcctctaatgatcctttgaatttctgtagtatcagttgtaatgtctcctatttcgtctctgattttatttgttatctcttttttctcaattaatctggctaaagatttgtcagttttgtttatcctttcaaaaacgaacttcttctttcattgatcttttgtattgtttcttcgtttcaatttcattggtttctgctctgacctttattatttctttacatctactaactttgagtttggtttggtcttgcttttctagttctttaagatgcatcattaagttgtttatttgaaatttttctatttttttcttttgatgttggttttgatggttaataccgagtgtcaacttgattggattgaaagattcaaagtattgatcctgggtgtgtctatgagggtgttgccaaaggagattaacattagagtcagtggggtggcaaaggcagacccacccttaatctgggtgggcacagtctaatcagctgccagcatggctagaatatgagcaggcagaaaaatgtgaaaagagagactggcctagcctcccagcctacatctttctcttgtgctggatgcttcctgccctcgaacatcggactcccagtttcttcagctttggaactcggactgactctccttgctccttagcctgcagacagcctattgtgatacctgatgattgtgtgagttaatatttaataaacatatatatatatattccattagttctgcccctctagagaacccttactaatacattggtgcttatagctataaacttcctttttgctactgcttttgctgtatcatgtaggttttggtatgctgtgtgtccattatcatttgtttcaaaaatttttttcaattttattcttaattgtttatccatttttgagatggagtcttgctctgtcacccaggctggagtgcagtggtgcgatttcagctcactgcaacctctgcctcctgagttcaagcaagtctcctgccttggcctctcaagtagctgagactacaggcacgtgccaccacatctggctaatttttgtatttttaatagagatggggtttcgccatgttggccaggctggtcttgaactcctgacatcaagtgatgcacctgcctcagcctcccaaagtgctgggaatacaggcaattttattcttaatctgttgatccattggtcatttaggagcctattgtttaatttccatgtgtttgtatagtttccataattcctcttgttactgatttctaatttttttccatcttgggaagagaagatacttcatgttatttcagcttttttgaatgttttaagacttgttttgttgtctgttatatagtctacccttaagaattatccatgtgctgaggagaagcatatgtattctgcagcctttggatgaaatgttctgtaaaaatctattaggtctatttggtctatagagcagactaagtccaatgttttctttgttgatttctatctgaatgatctgtctgaaagtacggtgttcaagtcttcaattattattttattgagatctctctttgtttttaggtctaataatatttgctttacacatctgggtgttccagtgttgggtgcatgtatatttacaattgttatattctcttgcttaatctttatcattatataataaacttctttgtcttttttatagtttttgccttaaaatgtattttatctgatataactatagctgctcctgttcttttctggtttccattggcatggaatatctttttccattcctttattttcagtctatgtgtgtctttataggtgaagtgtgtttcttgtaggcaacagattgttgggtcttggtttttgtttgcttctgtttttgtttttacaactcagccagacacttcatgtcttttgaataaagagtttagtccattcacattcaatgttaatgataaataagcatcattaactgtgttcctgccatttgttatttattttctagttgttttgtgctattctctttcatctttctttttttcctgtcttccttttagtgaaggtggttttctctggtggtatgttttaatttcttgcttttaattttttgtgtgtatctgctgtgtttttagatttgcaaataatgtcttataacccattattttattttaattattattattttttgagatggagtctcgctctattacccaggctggggtgcagtggtgagatcttggctcgctgcaggctccgcctcccaggttcatgcctcccgagcagctgggactacaggtgcccaccaccatgcccagctaattttttgtatttttagtagagatggcatttcaccgtgttagccaggatggtcttgatctcctgacctcgtgatccacctgccttggcctcccaaagtgctgggattacaggcgtgagccaccgtgcctggccaacgcattattttaagctgatcacaacttaacaccgagtacataaacaaacaagcaaatgaaaagtaataaaaactgcactttaacttcatcctctcactttttatcttgctttgttttatttatatcttattgtactgtttctgttttgaaaagttgttatagttattagttttgcttggttcatgtttttgtttttctacttaaattataagtagtttactgaccacaattccaatattataatatcctgtgtttttttgtgtacttactaataccagagagttttgtaccttcagtgattacttactgcttattaatgtcctttttttttttttttatcagattgaagaactccctttagcatttcttataggacagttctggtgcttatgaagtccctcagtgtttatctgggaaagccattatttctccttcatgtgtgaagcatttgtgtgtgtgtgtgtgtgtgtgtgtgtgtgtgtttgtgtttgtgtttgccagatatactattccagaataaaagattttttccttcaacactttaaatatgtcatacttctgtctcgtggccagtaaggtttccactgaaaagtctgctgccagatgtattggagctccattgtatgtttgtttcttttctcttgttgcctttaggatcctttctttatccttgacctttgggggtttgattactaaatgccttgaggttgtcttctttcagttaaatttgcttggtgttctgtaaccttcttgtacttaaatattgacaacttcctctagatttgggaagctccttgttattatccctttgagtaaactttctccccctacctttctctttacctcccctttaaggccaataactcatagatttgccctttcgaagctattttctagatcttgtaggtgtgcttcatagtgttttatttatttatttatttatttgtctcctctggctctgtcttttcaaataccctgtcttcaagttcactaattgtttcttctccttgatcaattctgctattaaaatactttgatgcattcttcagtatgttaattaaatttttcaactccagaatttctgtttgattcttatttcaatctttgttaaattaatctgataggattctgaattccttctctgcgttatcttcaatttctttgactttccttaaaacaactatttcgaattctgtctgcaaggtcacatatctctatcactctgggtttgatccttggtgcattatttagttttttttttttttgttggggtcatgttttcatggatggtcctgatgcttgtgattattcctcagttcctgggcattgaaggtatttattgtagtcttcacagtctgggcttgattgtacctatgcttttgtgaaggctttccaggtatttgaagggacttgggtgttgtgatctatgtttttgttcactgtagctgaatctgcattaggaggcaccctaaacacagtaatgctttagttcttgcagactcatagaggtaccaccttggtggttttggatgagatctggagaattctctggattgccaggctgagactcttgttctcttcccttattttctcccccaaaaaacagagtctctctctctctgttctgaggctgtgggtggggagacacagcaccctgtggtcaccaccactgggactatgttgagtcagaatgaagccagcacaacactgggtcttgcccaaggcctactataaccgctacctgtctgctgcctatgtttgctgaaggccctagggctctgcattcagcaggtggtgcagccagccaggtttgtgttcttcccttctgtgcagcaagttcccctgggccctgggtgggtccagagattccatctgggagccagggcctggagtcagaaaccttagaaatctacctagtgcattatctacctgtgactgagctggcacccataatgtaagacaaagaatcgtcccagttttccttccccttttcccaggtggaggaatcttttcctctgtccaccaccaccacaggcccatggaagtagtgccaggctaccactgatgttcccttaaggcccaaagtctcttcagtcagcttgtggtaaatgctgcttggcctgggactcatccttcagggcaatgggcttctctctggcccagcttagttccagaaatgccatctaagagccacagcctggaattggggaccccaatagcctgcttggtgctctatcccactgtggccaagctggtacctaagctgtaagacaaaatcctttttactctttcctctgcttttctcaagtagtaggagtctctcctcatagctgtgaatgtgctgggtcatgcctgaagccagcatgtctcagagtctcatccaaggctcatccagggtccgtgggctctttagtcagcaggtgatgaatactgcctggattcggtcctttatttcaagtcagcaggttcccctctggcccaaggtatatctagaaatgtcatctgcgagctagggcctggaatgggggcctcaggactctgcctggtgtcctatcctactgtgactgagctggtatccaagttgcaagacaaagtcctcttcactcttccatttcctctcctgaagcagaaggaagcagtctttcttggagctgtgagctgcactgcctggggttgggggagggctggtgcaagcactcccttggccacactagctggtgtctaactaggtcacatggcccccaggttagctggctctgagtgcagcacagtattaggacttgcctacgagttgcagtccttgtggcttagactgcctttcaggtttatttaggaacccagagactttaacccatggtggtgaggcttgctgaaactcagattctgaccattgggattggggattcccttctagctagagcttgactaaatgctctcactgtgggcattggctgaattctgcccgttggcagcgctgagttccaatgcaaagtcccacaatcattgtactccctctctccttagtgcacagattctttttgctatgtggctgctgctgggggctgagggagggatggggtcagcaattcaagactgtctttcctaccttcttcagtgcctctttcagtgatatgaagttaaaaccaggtactgtgattggtcacctgattttgggtttttataaagatgcttttttgtgtgtgtgtagatagctattaaatttggtgttactgcagggaagataattgttgtaggcttctattcggtcatcttgcttcacctcctcctgaagaatttgaaataggattggaagggcacttggagatttttaccagtgaataggggtttgggtgttggtgaagtgtttttgtttaagtagttttattattgatattctaactgaatcaacaaatatttttaaaatcctttttaaaaaagtatggttggcacataattgtacatatttacggggtacaatgtgatgtttcgatatatgtatacattatgtaattatcaaaccagggtgattagcatatcaatcatcttaaacatttataatttctttgtgatgagaacattcaaaaacctcttctagctattttgaaatatacaatacattattgttaagtttagttatccaactataaaatagaacaccggaacttgttcttcgtatctagttgtagctttgtaaaagttgaccaatctctttccctctctccttgcttctccttttcccataatctggtaaccactcttctactctctacttctctgtgaacagctttttagattctacatgtaagtgagatcatgctgtatttgtctctgtctaccaggcttatttcacttaatgtctttcaggttcctctaagttgccacaaatgacagaattttattctttttttatggttgaatactattccattgtgtgtatataccacatattttaaacacatttattcattgatggacatttatactgattccatatcttggctattgtgaataatgctatatgggagtgcagatatctctttgacatactgatttcatttcctttgtatatgtactcagtagcgggattgccggatcatatggtagttatatttttagttttttgaggaacctccatactgttttccatgatggctgtactaatttgcattcccaccagtagtgtgtgaggattcctttttctccacatccttgccagcacttgctatcttttaattttttgagagtatccattgtatctcattgtagttttaatttgtatttccctgatgattagtgatgtcaagctcttttttttttcatatatctgttagccatttgtatgcaaatttgagaaatgtctactcaggtcttttgcctatttgttaactgggctttaaaacatttttcatttattttatttatttttatttttccataagttattggggtacaggtggtatttggttacatgagtaagttctttagtggtgatttgtgagattttggtgcacccattacctgagcagtatacactgcaccatatttgctgtcttttatccctcaccccctctcactcgtctccccaagtccgcaaagtccattgtattattcttatgcctttgcatcctcatagcttagctcccacatatcagtgagaacgtatgatgtttggttttccattctgagttactttacttagaataatagtctccaatctcatccagatcactgcaaatgctgttaattcattcctttttatggctgagtaatattccataatatatataccatagtttctttatccatttgttgattgatgggcatttgggttggttccatgattttgcaattgctaattgtgctgctataaacatgcatgtgcaagtttcttttttgtataatgacctcttttcctctgggtagatacccagtagtgggattgctggatcaaatggtagttctacttttagttctttaaggaatctccacactcttttctatagcagcattactagtttccattcccaccagcactgtagaagtaactgggttttttttttaaatgagtttttgtagtttcttatatattttttatattaaccccttatcagatgtatagtttgcaaatatattctttcattttataggctctttgctctgttgattgtttcctttgatgtgcagaaggctttagtttgatacaatcctatttgtctgtttgcttttattgattatgcttttgagcttttatccaaaaaatccttgccttgaccactgtcatggagatttctcacgtgttttcttttagtagtttcatagtttgggtcttctgtctttggcccattttgagttagttattgtatacgttaagaaataacggtctaattttattattttgcatttgggtatccagtttttccagcatcatttattgaagagactgtcctgtctccattgtgtttactcaacacctttgtttcaaatccttttccattgttgcatgtctgtttttatgccagtatcatgttgttttggttatcatatctttgtagtatgttttgaagtgaggtagtgtgatgcctctagctttctttttgctcaagattgttttggctatttgagattttttgaggttccatattaattttaggatttttttttctatgtctgtgaagaatgtccttagtattttgatagggattgcatggaatctgtagattactttaagtagtatggacatttaaacaatattaagtcttccaattaatgaaatttgtccttccatttttttgtgtccttttcaatttctgtcatcaatgttttatagttttcattgtagagttcttttacccccttggttaacttttcttctgggtaatatttttggtagttattgtaaattggattgctttcttgatttctttttcaaataatcaattattggcatatggaagtgttactaattttgcctgttgattttatagcctgagaccttatcaaatttattagttcttatagtttttgtggtgatgtctctgaggttttatataatatatataaaattatgttgtctgcaaacaaggacaatttaattttctctgttttagcttggatgctctttatttctttattttgccttattatttaggctaggacttccagtaatatgttcaacaaaagtggtgatagattgtccagattatcttgttccagattgtagagagaaagctttctgcttttcctcattgtgtatgatattagctgtgaatttgttatatatgacctttattatgttgaggtatataccttctatacctaatttgttgagaattttcaacataaaggagtgttaaatgttataaaacacgttttctgcatctattgagatgatcatatttttttttcctccattctgctcatgtgctgcattatgcttattgtgtttcacatggtgaaccatccttgcatccctgggatgaatcctacttgataatggtgaaggatcttttttgatgtactgttgcactctctttgacagtattttgttgagaatttttgtgtctatattcatcagggatatgggtctgtagtttatgttattgtttttgcttttgttattttgtatatgtgtatccttttctggctttgtcagtgtaatgctggcctcatagaatgagtttggaagaattccctctaattcagttttttaaaaaatattttgacatgaattggtattaattcttctttatacagtaaagcaacatgctaagatggttatttttagagagagctcttaggtagttgtgcaaataattaatttagcatgctggcatttatgttgttaattaaaggaggaggtcagttcagaaatcatggtttggattaggtactcttcaaattgtacctaaaagaaatagcagaggggccgggcgcggtggctcacgcctgtaatcccagcactttgggaggccgaggcgggcggatcacgaggtcaggagatcgagaccatcctggctaacacggtgaaaccccgtctgtactaaaaatacaaaaaattagccgggcgaggtggcgggcgcctgtagtcccagctactcgggaggctgaggcaggagaatggcgtgaaccccagggggcggagcctgcagtgagccgggattgagccactgcactccagcctgggcgacagcgagactccgtctcaaaaaaaaaaaaaaaaaaaaaaaaaaaaaaaaaaaaaaaaagaaatagcagaggaaagagatggaactagctgaaagctaaattgattccatgtatcacaccttcaaaacagagcttatttttgaagcttcattatattgttttctgcaggttactccaaggacatttcatttttcttatgaccatgggtgaccatattttctaaagtcagagtctggggaacatatactctgataaataattttaggctgacgttagagataattcttaatccagaagattgggtttagtctctgaaatcatggaatccttgggatgtgttgttcactaactggaaaataggacaatacattatcctagaataactttccttgaaagtctgtatagtcattgtaggtttagcagaattggccctgtagaaatagttagtagatatacatgatgagtttgaagaggacgtgataaaaaaaaaccattgctggctcatttgtctcttttagttctgctccgatttgattctgggtactcagctctcagctttgggaatatggaataatttatctctttctgagtattatatattcagtgtcttgagtttatcttgattcaaaccaacaagaggtgggaatgctccttagctatttccagcattcaaaacatgattatgtatttgttaaaaagagaaaatgaattcattttgtgcctttttactccagcattgttcacagatgaatcttgagctaaaaactggagctgttggtctgtgtacccttaagtggtatcagctttcagggtgaatttgcacttctcttgagacataatgaaaagggaagtgaatttgattgatccttagtatctattaataattttaccttcattctctaattttgtctttatcacaaccaagatatgtaggtattttttaaaatttcaacttttattaatttaatttatttattttgttatttataaataaatttatttatttatttatttatttttttgtagagatggagtcttgctctgccacccaggctggagtgcagtggtgcgatctcggctcactgcaagctccacctcccgggttcatgccattctcctgcctcagcctcccgagtagttgggactacaggcgcacaccgccacgcccggctaatttttgcatttttagtagagatggggtttcaccgtgttagccaggatggtctcgatctcctgacctcgtgatccgcccgcctcggcctcccaaagtgctgggattacaggcgtgagccaccacacccagcctaaaatttcaacatttattttaggttcatggtctatatgtgcaggtgtgctacattggcatattgtgtgatgctgaggtttggagtacaactgatcctgtcacccaggtgctgagcacagtacctactaggaagtttttcagcccttgcctccaccctcccaccgctctaaatagtccccactatctattgttctcatctttgtgtccatatgtacccaatgttcggctcccacttataagtgagaacatgcagtgtttggttttctattcttgtgttaattcacttaggataacgtccttcagctacgtccatgttgctataaaggacgtaatttcattcttttttttatgtctgcgtagtattccgtggcgtttatgtaccacattttctttatccagtccactgttggtgggcacctagattgattctatgtctttgctgttgtgactagtgctgtaataaacttgtgagctcatgtgtctttttgttagaaagatttgtttttgtttggatatatacccagtaaagggattgctgagtcaaatggtagttctgttttaggttttttgagaaatcgccaaactgctttacacagtgactgaactgatttacattctttacgttctcaccagtagtgtgtaaatgttctcttttctctacaaccttgccagcatctattatttttttgactttttaatagtggccattctgattagtgtgagatgggcccattgtggttttggtttgcatttctctctctgctttttgtttgtttgtttttttgtttgagacaaagtctctctctgtcgcccaggctggagtgcagtggtgtaatctccactcactgcaacctccacctcccgggttcaagtgattctcctgcctcagcctcccaagtagctgggattacaggtgcctgccaccacacctggctaatttttgtatttttagtagagacagggttttgtagttttagtagagacagatttgatgttggtcaggctggcctcaaactcctgacctcaggtgatccacccgcctcagcctcccaaagtgctgggattacaagcataagccaccgtgcctgcctgtggtttgcatttctctaatgattagtgatgtggagcatttttgcttatgttttttggccactcgcatgtcttcttttaagaagtttctgtacgtgtcctttgcccatttcttaaatggggttgtttttggcttgttgatttaagtcccttgtagattgtagttattagaccattgttagatacatagtttgcaaatattttctcccattctgtaggttgtcttttacgctgttaatagtttatcttgctgtgcagatgctctttagtttagttaggtcccacttgttaatttttgtttttgttacaattgcatttggggtcttagccataaattctttgccaaagtcgatgtccagaatggtatttcctagattttcttctaggaattttataatttgaggtcctacttttaagtccttaatccatcttaagttaatttttatatatggtaaaatgtaggggtcctgtgtcattcttcagcatatgcctagtcatttttcctggcaacatttattgaatggggagccctttccccattgcttatttttgtcaactttaccaaagatcagatgattgtaggtgtgtggtttcattttcagggtctccattctgttccattagtttatgtgtctgtttttgtaccagtaccttgttgtttttattactatagtcttatagcatagtttgaaatcaggtaatgtgatgccttcagctttgttctttttgcttagtattgttttggctatttgggcctttttggttccatatgaattttagtaatttttttcaattctgttaaaaatgacattggtcgtttgttaggaatagcgttgaatctgtagattgctttgggcaatgtggccatttaaacaatgttgattcttcaatccatgagcatggaatgtttttccgtttgtttgtgtcatctatgatttcttttaacagtgttttatagttgtccatgtagagatctttcgttttggttagacttattcctaggtattttatatttttgtggctattgtaaatgagatttagttcttgatttggctctcagtttgaacattattggtatatagaaatgctgctgatttttgtacattgattttgtatcctgaaagtttactgaagtcatttatcagttataggagtcttttagtggagtctttagggatttctaggtatggaatcgtgttgtcaacaaagaatttaaatccttcttttcatatttggatgctttttatttatttctgttgctagattgctctggctagaacttccagtcttatgttgaataggagtggtaagcatgggcatccttgtcttattccagttcttaaagggaatacctccagtgtttacctgttcagaatgttgttggctgttggtttgtcatagatggctcttattactttgatgtatatttttttccatgtctagcttgttaaaggttttcattatgaagagatattggagtttaccaaaagcctttgctacgtctattgagatgatcatatgatttttgtttttagttttgtttatgtgttaaatcacatttgttgatttgcatgcattgaaacaactgcatctcaggattaaagctcacttgatcatgaagaatcaagttcttgatgtgcttctggtttcagtttactagttttttgttgagaatttttacatctatgttcatcagtgatattggcctgtagttttcattttttgttgtgtctttgccagatgttggtatcagggtgatgttgacttcttagaatgagttagggaggagtccttcctactctagtttttggaatagtttcagtagaattggtaccaactcttctttgtatgtttggtagaatttggcagtaagtctgtctggtctagggcttttttttgcttggtaatttttttactgactaaatttcagatcttgatgttggtctgttcaggatttcaatttcttcctaattcaatcctgggaagttgtgtgtatccaggaatttatccatttcctctagattttcgagttcgtgtgcataaaggtgttcataatagtctctgaggatcttttgtatttctttgatatcagttgttatgtcacccttgtgatttctgtttgtgcttatttggatcttctcttttttttccttgttagtgtagctagcagtctatcaatcttctttatcctttcaaaaatccaatctttggttttgttgatcctttgtatggattcctggatctcaatttcctttagttctctcctgattttagttacttattttcttctgcttgctttggggttagtttgttgtcgcttttctattcctctagctgttatgttaattgttgatttgaggtctttctaacttcttggtgtagacatttcctctttatactgcttttgcttcctcccagatattttgatatgttgtgtctctgttttaaagattttttttttgatttctgccttgttttaattgtttattcaaaagtcattcaggaactagttgtttaatttccatgtagttgtatgattttaagaaatcttcttggtattgatttctatttttatttcactgtggtccgagagtatcattggtatgacttgctttatggaaaagcatgtggttgatcttagagaatgtctcacgtgcagatgagaaaaatgtatattctgtgtttgatggatggagtattctatagatgtctattagtttcaatcagtcaagtgttgaatttatgtctagtatttctttgttagttttctttttcagtgatctaatactatcagtggagtgaagtccccaactattatgtgtgactttctaagtctttttgtagctctaaaagcacttgttttgtgaatctgggtgctccatttttgggtgcatatctatttattataagtaagtcttcctgttgaattgaacttttcagcatacgtaacgtctttctttgtccttttttaatgtggttggtttgaagtctgtttcatcccatataagagaagcaacccctgctttttttttttttttttttttttgtcttcggaatcaggaaactgctattcagagaaattgagtagtttgtccaaagtcatacagatagaaaatggcagagccacaatgcaaaacaaaatttgaagattttgaaatcagattgggaagacatttaatatttgaactggtgagttatctttaaatatcatttctcatctcttacctttagtattacttcatggtagtaattacagttttgctgagttggatatgttgagattgatgtaattctagcctgacttagggcacttatcattgtctagcttggggagcttcccaaatgggtcccaagggccactgggcatgtaagccgcccttagaaaagaagagttataagattaaatacatttgggaagcatgactctctttcttggaaaatcacaataaatattagcatattgagagctcttcaaatcatgtcataaagtattagtccctgtgctaggtacttcaaatgtgtggtggcatttaatctgtacaaaacagtaaggtattattaccctcgcatcacagatgaggaaactgaagcacagattgttggctgctttgccaagagtcacccagctagtaaagtgatggatctcagagtcaaacccaggtatctggctcctcagcacattttcttaaacagtatattttactggctctttaaacttacttacccagcatttcccaaacttacttttatcatgcagtgctttggtggtatttttaatgccatttatttgacctagcgtgctaacaaacactggaaaatgctgcatgtacagcattgattcgaggccatgatggactttcagtctagataaaagcggcagagtcttggacccctgaacatagtggaacaggtgaggttgtcagagaacagtcagtgagaggaaaggcttggtggcgtttaacccaattacagtgttgcattcatgattggtacctgtactttgtctttctgaggtcagtaataaaacatctcctgaaaaaggccgttgtttacatgctgcaaagatgtccagtgcccacttgggcctgtggtccactgagggcaatgtgtgggagctctctacttgtcaagattcagaggcagaaagggggctggacaactgcaatgtctgtttctaaattgttacatgagacttttaaaattgtctaaaagtttcagatgagggtaagataaataacctctgagctgtccagtaaatgaaaaatataacattcagcctttatcgataagttccccttctttaagccagtgtagaccccagaaatgggtgggttatatctggttgaaattcaggcaccttaaaacttgaagaaagccatgagaatttgtcaatatctttacccacttttttgcaaaggatttgaaatatggtaagtacagcaactccaggggttaaaaatagtttcatttttcatctttcagaggactctggggacataaagcactattaactgtagttgtatggtgcctaagggacaaagagatgatccgcttgattccttgagctcctttcaggcagacttcaggaggatctttagtaagtcttactggagagtgagataaggttctcaatctagactgtagtgacaatggaacttggaccctatatcagttttgaaggctggttttatggccccaaatttctggttacaggaatgttaagcagcatttttcagtgacaactcttaatgctttgttgtttctgggagactagaatagttgcttattcttgtgcttggagaacagtgatgttttgaaagcctgacataaggtaaccacaggtatatacagaatgtatgaggctaatccttccctgacaaatattagtggaaggcagacagtcctgtatgctctggaggcctgtggccggtttacacccattctgctcttttcttctctaaaatgttattaaatacctattataaactaggtgctgtgctaggagctggggagattgagatgtacccttgtgagaggcaggtcactcaacagttacagcacaccataatatgtgttacaaaagaaatgagtaatatcatgtcactcctttggttagcactcttaaatttcttctccactaattcataataaaatccaaagtccttaccaaggctgtgtttctgtgagatctggctctttcctgcccttctgacttcatctcctgcccctactacattgtcactgagctcagccacagtggcctccctgttgttcacaggcatgtccagcttcctcttaccctgccccaagccctttgtacctatttctcttgtcaaagaatagaatacccttttcctcataggactcattgattacttattcagacctcctttcacagatttacaccttattagagagccttccttgatagctgtctctagcgtagccccttctctgcccctgccatgctatatccccattaccctgatttatgttttataaacttgtcacctaacaatatatatttattttgtttctttctcttttctgttagataaacaactcaagtgcagaaactttatttggcttgttcactgctatatcccaagcactttgaacaatgcatggcaccttgtagatgccccatcaatatttgccctattgagaagcaggaagagaaggaagccattaacccttccagggaaagtcaagggaggctttatagaggagatggcatttaaactgggacttgaagcatgagtcagagtttaccaggtggagaagttgtgggttgcagaggtaggtggagggagggaacgattatggtcatgatatcaaagacaaaggcacgatgcattactcctttccctcctccacccttctccttcctctacctgtctctagaatacaaattactatccagcttaatttctgggagagtttaccactgagcagcttgctctcaggctcctacactacagtaagatgtgtcaagtgcctgattgagcttaagtatgattatgatgaggttgaggaaggtgtggatgtattcattcttctgcagtgacattatcagctcataaccagctccttatatgaagtacacagggatttcacatgctggcagagggattgtaaaacatcttgaattgattgtagggtaataatgtccatctccaaaaggacttgttatgattataatatgtccaactgttttcatatgtttaaaactcaggatgaagttagatctccacttggggctttttctcactctgacacattggaattttaatagagcctcagcagctagatctttaaagtgagataatgttcaaacactttaattaaatttttgaaaagggcagcaataacttacataccaacaggctcagcctgggttctgtagtgattcacatattgcttaatctgagtaccagggcttctctcttgttcatttgtatgttactggggagcacttgcttagcaaatgaagaagagccatcagaaagctcttatttaataccctcaaagagattagctgagggcctctctctagttcccactgggtaggcagtagtactacgtccagttcttttccatttttctcttttcttctgaaaggcttctaccaaggatattaaagtgcttaatcaggccactgtgtttagttaagttcatactgggtccctgagtgtccccaagtcagtctaggagtggacaggagcagatgataactagcagtgaagagtagactgagggtcagggggcatatacgagaatgactcataggcaaaatagtaggttggaaaccaggcagacagactccaggagacacgcagaagttgaagaggtaagctcaagggaatggcttggtaaactggcataatcaggactcagagagcacttgggtaatagacattaagtcctcacagaaagaaatcaaatagatggtatagcagatggaagccattagcaatcagatgatcaaattttctaccttcatttcctggcagggcttgatatagcataaatgcctagtatattttggttgaatgaatgcgacaaactttttttttcttcggagacaggaagccttttgtagagcaagagtcattcttggggcaggtatgcccagggcctgcaggtgtgggtgggtgaaacacctcagagatgttttaatagattcatctgtttaaaatgaaaattgtggagcttgatttttggcagattttgacagttcaccagtgtcaggggtagcaaggtagttcttacagtccttcatgtggatgatgtaggtgagtcttgaagagtgggtatgatttgccaggtgtccaggagtagaaaaacattccagtcaccaggaacagtggttaccagtgcaggatggggaggtaaaggttggagagaacgctggaagattggaggtggtaagatcattggaagtcttatgtgctcagctttgcttaaagaccttggtcttgtagtaagatagactgaatgaatgaatgatgcagtggggagtaaagaggtctaaagtaagtgtagtttgcagtggggagcatgagctctggtggtacacctaagagcttggcttggaaagctgaagagaacagttctgccagtgacaagggtcataaatgaaccatgaaggaaaacagtacagtaaacagcagaaaatacaaggtctgtatattagtctgttttccagctgctgataaaggcatacctgagactgggcaatttacaaaagaaagaagtttaattggacttacagttccacatggctggggaagcctctcattatggtggaaggcaaggaggatcgagctgcatcttacatgaatggtagcaggcagagagaatgaggaagatgcaaaagcagaaactcctgataaaaccatcagatctcgtgagacttatatctaccaccactagaacagtatgggcgaaactgtcgccatgattcaatgatctcccactgggtctctcccacaacatgtgggaaatatgggagtacaattcaaggtgagatttgggtggggacacagggtcaaaccatatcagtctggaaggggcagcagcagtaggactgcagggagggtcacatggaaacattgagtctttttccacacatgcagccaaatccccttggacttcagaaggcacagaagacatggctgaatattttaattgcttggagagcttttaaatataaaattcggaaattgttataaaatctcctgaatctgagtgcttgggaatttggtctgggaatgtcagttttaaataagtttccaggtgattctaatgcaaatactctgccaagtatgtgggaatcacaggagggtagctatactgtatgccctctctcaaaaaggccatagagaggaaacagccacccaaccagtggtggaaggcgagccaaggctcatggaaatccttcagaaatgcccctgcacctgccccgaagaaagcctcacacaatctaaattggttaggatacaggagtgactactgaagcaaatactcaaacaacaatgatttaaacaagatggaagggtaatactctttcatgcagcagtttgaatgtgggtagttaatatggtctggctgtgcatcctcacccaaatctcatcttgagctgtaatccaaattgtaatcccatgtgttgggagagggacctggtgggaggtgattagatcatggaggtgattccccccatgctgttctcatgatagtgaatgtgttctatgagatctgctggctttataaggggctttcccccacttcgctctgtgcttcttattcctgctgccatgtgaagaaggacgtatttgcttctccttctgccatgaatgcaagtttcctggggacttcccagccaagctgaactgtgaattaattaaacctcttccctttataaattacacagtctcaagtatgtcttcattagcagtgtgagaacagactactacagtaaattggtgccaggagtgggttgctgccataaggatacctgaaaatgtggaagcaactttgaaactgagtaacaggcaggggttggaacagtttggagggctcagaagaagataggaaaatgtggtaaagtttggaacttcctagacacttggagggcccagaagacaggaagatgtgggaaagtttagaacttcctagagaattgttgaatggctttgcccaaaatgctgatagtaatatggacaatgaagtcgaggctgggatggtctcaaacagagatgaggaacttgttgggaaatggagcaaatatgactcttgttatgctttagcaaatagactgttggtattttgcctctgccctagagatctgtgaaactttgaatttgaaagagataatttaggatatctggcagaagaaatttctaagcagcaaagaattcaagaggaagcagaacataaaagtttggaaagtttgtagactgacaatgcgatagaaaaaatccattttggggagaaattcaaaccagctgcagacatttgcataagtaacaagcagccgaatgttaatcactaagacaatatggaaaatgtctccagggcatgtcagagaccttagcagcagccactcccatcacaggtccagaggcctaggaaagaaaaatggttccctgagccaggccattgcttcagagggtgcaagccccaagtcttggcagactttatgtggtgttgggcctgtaggtccacagaggtcaaaaattgatgtttgggaacctctgcctagatttcagaggctgtatggcaatgcctgcttatccaagcacagtttgctgtacggacaaaactctcatagagaacctctgctagggcagtacagaaaggaaatgtagagtcagagcctccacacacaatccccactgggtcactgcctagtagagatgtgagaagagggcaactgtcctccagaccccagaatggtagatctaccgacatcttgtgccatgaacctggaaaagttgcagatactcaatgcctgcccattaaagcagctgggaagggaactgtaccctgaaaagccacaggggcagagttgcccaaggccatgggagtccacctcttgcatctgtgtgacctggatgtgagacatggagtcaaaggagattattttggagctttaagatttgattattgcctcattggatttcgaacttgcatgggcctgcagcctctttgtttttgctaatttctccctttggaatgggtgtattaagccaatacctgtacctccattgtatctaggaagtaactaacttgcttttcattgtacaggctcataggtggaaggaacttacattatctcagataagaatatggacttggacttttgggcaaatgctgaaataagttaagactttggggaactgttgggaaggcatatttgtgttttgaaatgtgagaaacacatttcaaacctgggaggggccaggggtggaatgatatggtccggctctatgtccccacccaaatctcatcttgaattgtaattcccatgtgtttggagagggaccttgtgggaggtgattagataatggaggtggtcccccatgctgttcttgtgatagtgagtgagttctcacaagatctgatagttttataaggggctttccccactttgctctgcacttcttcttcctaccaccatgtgaagaaggatgtgtttgctgctttttccatcatgatcataagtttcctgaggcctccccagccatgctgaactgtgtttcaaacctctttcttttataaattacccagtctcgggtacgtctttattagcagcatgagaatggactaatatagtagtccagagtttatgtgacaactttacaggaccgagaaactaggttcttctatattatggccctctgcctgtagtccttgatgattcagtcccattacctcactatgccagcatgaaggagaacaagaagaagtcaagagcattctccttacatgcattactttcactcatgtcccactggtgagagcttaatctcatgaccacgcctagctgtaaggaagatggtgaatgtgacctttattctagatggccgtgtgcttcactaagattcaattactaaaggaaaggggagagtgcacaccaggggacagctggcattctctgcctccaacattcttcagattttcactcacagggtcctgaactcctctctggacactcctctctggttaattattttttattgcacaattctggattaggaaccggctgggggattgacaccccttcaggaaaatcacccaaaggctgacctatagaagctggccttccctgaagttattgccataaaaacccctccaagcaagaatcagccttagtggaactaatctcggtatttgcctgatacatcttaaatttgcttgttcaggtgaacaagacctttgcatggaggagtgagacagactggacgtcagtagagagattatatttagctgagttgaagggaagggaactaacatttgctgaaggtatacttttgtgtgttaattgttttcgatatgcgataacacattcacccagaagacctgagtgtcagatctggctctattgctcactggcagttagtttaactataatacctttgagaggtttatgctggaattgccaagacacagccctggttttgcaataggagtgcggaaagaaccatggcttggtttatctgagtcgaaatattttcatgtgttaagatggggattctaatagtgcctgccaagacacgaacattaatgtctaatttccaattccatggacccccttatactatgattggaagagcctgagtgaccagtgtcaaagtaaacttatgtttttattcttgtgccaaagctctgtagatactgtcagtgctcattattgtgttatcaaatgaagcaggagaaagtaagtctttctttctgtatggcttggagggattttcaaggcttataattaggaactatttctcattgacggttttagctagggatgtaccatatttatatgttgctcacataaaagaccaattcaggtgtttctggctaggtatctgtcctgggaagctcttcttctagtggaaagttagaggcctagactctgtccacttcgtcattcttccatcttcaacatgtggtattccaggtgtttctgagggttgtctttattccagcaaccagaaagaggattgcatgtaggaggtttagggtcagccttggaagcagtacacatgtatcaattacttctgctgacatttcattgtccggaactcaagcatatggccacacctagtattattagcaagaaaggctgggaaatgagtcctagctctgtgccaagaagaaaagtaaattggttatgattttcttccaccctaagttaatgtgtactatcttatttttaaaaacacaatattctctgtgggggagtgatgaggttgtgcaaaactgtttaagtgacttccttctgttgtgatgggcaccatagattaaaaatatcttagtcccaaagggagactgctaaccgctgttgactctatgctacctactcccaacagcctcagcatctctttattggtgctagaaacttcatttcctttacaacatcctagacatagtgtcatggagcagaaagggcatctttagtattatataaacttgggtttctatcttggatctaccacttactggttgtattttcttggatgactttatatctttgaacttcagcttcttcatctgtaaactaggtataatcatatctgcccaatgggcatactttaaggatttaagacaatgtctggcacataggcactcaataattgtcaaatgttattattatttagatcccacgctttctgtcctaagtttaaagggcatgatttaaatgagatattctgaatatcttgttaatcttgcatgttctactcttggaatatctattaaaattagccatatttgaaatgtagtctccacatataacttgcaaacactagaaacccagaagagagttaataattgaaaaaactctcaagtttgtcattaccttaatgattggtatgaggagccattttcctagcacttttctaaaatttaacctagggagcttgttcatgctcaattcttgtttgggatcgctgcaggtaagggatttgtggaactgtcttggggttcctcttacccagtaattcatgatctactatattctgacttctgcctgccttctggccttcccactctgagatgtccacccagtctcacgtaggacaggagaactcaatatttttaatgctgttttatgctcatcatttgttttttcttttcagtcagttttagtgtctcactttctatctgttcttaagttttcatttttctgcaactgtgacaggtagaaggtggatttcacaattctaacctgggtgaatggatggcttctgttaatttattataagaataactcaatccgtgaggaagatgagaaccatgagccaagattttattgggaaaaaactatgattcaaaagagaaagtccagaggatccagtctttccttttttgcaagtccaaaagataaaatacatttttccattgggatgtcgatcactggtttggcttccttggctaggcctcttaggagagaagacagtgatttatttttttaactttttcttttacattaattttaggaagttgcaaaaatgatacagcaagtcttgtatatctctcacccagtttcctctaatattaacatcttacgtaaccatgataaaattatgaaaatcaggaaattgaccttgctgcaggactatttttttttttttttttttttgagacggagtcttgttctgttgcccacgctagagtgcagtggtgcaatcgcggctcactgcaacctccacctctcaggttcaagcaattctcctgcttcagcctcctgagtagctgagattacaggcacccgccaccacacctggctaatttttgtattttttagtagagaagaggtttcactatcttggccaggctggtctccaatgcctgacctcatgatccacctgcctcggcctctcaaagtgttgggattacaggtgtgagccactgcacctggcctgctgcaggactattaatcaaattccacatcttgtttgaattttgccaggtttttttttaatgaatataggattttttctgtttcaggatcttgtccagcccacatttcatttagttgctatttcttcttaatctcaaaaatgttacaatttgtcagactttcctatcttcatgactttgacacttttgaagagtatggccagttattttgtagaatggcccttagtttgagtttctgacatttcctcatgattaagttattattatttttttttggcaaggataccatagaaatgatgttgctttttctctgtgcatcacgtgaaaggattccttatattgatatatcttattactgatgatattatccttgattgcttggttaaggtggagcctgccaggattcttcactgtgaagttcttatttttcattttgtaattaaagaaattagtagtaaaggattttggctgggcgcagtggctcatgcctgtaatccccccaccttgggaggctgaggcaggtggaccacgaggtcaagagatcgacaccatcctggcaaacatggtgaaaccctgtctctactaaaaatacaaaaattagctgggtatggtggtgcgtgcctgtaatctcagctacttgggaggctgaggcaggagaattgcttgaacttgggagatggaggttgtagtgagccaagacccagactggtgacagagtgagacaccatctcaaaaaaaaaaaaaagtttttttccagccctcaactgagaaactgcttttgaatcactgaagtgagaaggtgtgttcctgtgggtctgtttatggaagaaggagaaagaatggagagcaacacctcagtaatacctggtcttctttttgctctctcttctgccctctgcctcctgggttcaagcaactctcctgcctcagcctcccaagtagctgggattacaggtgtgtgccaacactcctggctaattttttgtatttttagtagagacagggtttcaccatgttggccaggctggtattgaagtcatgacctgagatgatctgcctgcctcagactcccaaagtgctgggattacaggcatgtcaccacacctgactcctgaaatagcttttgtagactcttggtgtaataaaaagaggggaactcttttcttaagaatgcatttccaaggtagacagggatatattttatgtgatttgtaaaattccttatgtggaaaacaattattctatcacaaatccatcactaatctgttcctgtgagaacttttccagtctcaggatagcgagaactcactactatgtgaaaggcacccattcatttatgagagatacacccatatgatccaaacacttcccactaggccccaccccccaacaccaccacactggagatcaaatttcaacatgagttttggtggggacaaaccatatccaatcatagcaatcacctttttagggaacttgacttttgaagctttcttagtgtttgagagtcattgtttggcaaactctctcagagaaagtttgcgtcactgtttcaaactccactgaacatgtgagtaagtttctgatatcttcttgcattcttatgtccaagatcagagaagaataccttctaatatctaggaaatttcatctccagttcaacctgcacatcttaacaatcgtactcatcttgtaagaccttgctgctcatggtgtggcctgcaaaccagcagcaagaccatcacctggggcttactagaaatgccatatctcagaccccagcagaccttctgaatcagagcctgcattttgacaagttgactcatgtgcaccttcacgttcgaggaacacttttaaagtgtttacaatggctctgccttcttgatacctgaatgaattgagcttatcaaaaatttgataaaggcagcttcatgatgatggtggccaggaagctctttcagctcttagtggacattgtggagatgaagaacataacaggaattatggtagcacaggataagttgattaattttgaagcccactagttgttttggaaggtgggggggaccctggatatattagctttctagggttttattgacagtgagagaaagccctatgacacagagccatctcatctacttttttgaactgctgcagattgggcttaggtgtttcaagtttgcccaaaataaatgattctaaaatcaatttacctaacggccagtttacttaatggtaatttcccctaatagtactattaacataaaaattcatgtttgtgaaatttataagaattcacatgtgataggaaggtaaattggtttttgtcaaatttggtttcagatagagctgctttaggcaaatgttcacttacatatattagctctaggcaaatagattttatagatgaattcacctgatccaggtgtcctctcctgaggagggaacagggaattcagcgtagggggtgggaatgtttagtcattatttccactagcagtgatactgggtgtggaggaggctcctgtaatagcaagtgggctgggtgggagcttgctacactggtcttactaatggccccctgagatatttactacatagccctcacctgtttcagtgtctcactatgaatgaccgttaccacttaggcccatctgggctgcatcttctaagctcattcctaagcactgttcttcttagtgaccgtacacttttatgagactcttcacaatgctcatgtttagcctgggcttttcatgctgggttgctttatcccagtgtgacttaaactgaaccaggctttgtcacagaaccatgttctgttctctcgcggtacttatccgttttcaattttacatttattagtgtgattattttgttaacatctgtctcccactggattgtaagctctgtgaacacatggatcatatctgtttttgttcatcattgtgtctttagaacctagcaaagcacctagcaaattgtagagacttaatatttttgaaataaatgaatgaataccttaatgaacctctggcttttattagcagtaataaattacatatggcacatctcacagatgatggtgatacatcaaactgccttgacatagaagctgagaatcactgtagaaaataaaagtttcttatcaaggaggcaattcaggaaaattaacatttaaataatgatgacaataataatagctgacatttattgagttcttatagcatgctagttatgataagtactttaccataaaatttatcttactatatttattgagagctcaagtcttcctaacagaagcagccactagaacacgtttcctacaacccccactctcatcctccagtactgtggagccgtcagcaccaggaacaaaggagggttccatgttggttctgttaagggtagttcatttccagctcatggtggctggcctcatatcccactgaacgctctgctaatgatgtcagccttcccagtgactcttatgggtagtggaaatttcagttatgggacagagtggtctgtgttgattcttatagttctttcttccaagagggcctggcttaggcatcattgtcctagttttgtgtctttggtcatcatttaacttctctctgacttgctttcttcactaattaaatgaagatgataatagtacctccttctagagggttgttccaagaatttacttcaatattgtatataaagtaataactaaagtggtatgtggtaagacttgataaatgttagccattattattattattattatttaaatggtgcttttactgaattatctccttgatgagtaacttgttttctataagagtgactgtgaactgcaatgtcacaaccctttgttgtatcacaatcagcactaaggcatgccacctgtaatttgttactgttactacaaaccagatattactatatttattcatttattccaaaaatatttattaagtcactacaagtatgctaagtgttatgctaggctctgaagataacatggtgagaaaaacagatatagtccatgtgttcctaaagcttatccagtgggagacagatgttaacaaaataatgagaaaaatatttaagtacagagatagctgtgaaggaaaggagcatattcttatttaaaaaaaccctatgtggtggtggggagtgcaagtcaatggacttcctggggaggtgacatttaaagtgagagctgaatgagtagaagttagctagggaaataatgggataagagccttccaggtagttggagcaagtgcattgtagtgggagggatcgtggtatgtttgaagacttgaaagaacgttggtgtgtagagggcaagatagagagtgagaaagctgacactggaaagataggcaggggctaaagcatgtagtttcctgaagcgcatgcctaagacttctaggcttgagctcaatagtaataagaagacactgatggattttaagcttggaagtgggggtgcttggaagaagtcgataatatgattggattcttgttttaaaaaggtaactttgtctgtagaatagattggaatgggccggcgtggattcggtgagacctgataggaatctatatagttgctagtagtagatgttggtggataagataaggatgatagctgtgaaggagatttggaatggataaatgtggtagatactttggaacagaagcgatagaacttgctgatggtgtgcacatcaggtgctggggagagaaaggtgtcaaagacaatgcttaggtttttagcttctgttctgatataggatataatggatgaggcccaggttttggggaaagaattaggagttatgtgttgcgagtattgagtttggggtattccgggagagatgttgagtaggtagttggttatgcaagtaagcagttcagaagacaggtctagactggagatataaatttgtgatttatttatgtaaaaaagcaccctcctggctaacatggtgaaaccccatctctactaaacatacaaaaaaattagctgggtgtggtggcgggcacctgtagtcccagctactagggaggctgaggcaggagaatggtgtgaacccaggaggcagagtttgcagtgagctgagatcacgccactgaactccagcctgggcaacagagagactccgtctcaaaaaaaaaaacaaaaaacaaacaaaaaaaacccaccctaacttattagagtggagtcagggtccatagagccactgatatgatgcactttctgagaagtggagaaaggactggagttagaggtaagaaaacaaattttgcataactggtgacacccgtgggagtgtttgaacattacctgcctatcagtcctaacataaaatggtttgagaactgctaggctgtaggaaaagggccatatgtcagtggttggttctatgaatctagccccaacttacctttctgttgcttcacaactcctctgatctgtttgtgtacatcgtcagtgctgttcatacctcttctttctttgttgcctgagcatgccagacacatttcttcctccatgtttttacattttccccactcctgaagcacttctcttacccatctcactccagtttaggtcattcttctacatctagcttctttttgaaacgttctcacatcaccgttcaagattggatctcctctcctcgttttaaaggtcaaggatgtattgttgtctatctttccgtaagtttttattttatcgagtgacatgtaaattctttgacaagaggcatactttgtattaagtaagtgcttgttgcttacttatctttacacttagtgccttctttgcatatatgattttcaatcttgctttcacagtatgtaagcctggcttagccttgagaaaatgggcctttacctagttgtaatttgaatttgtgttgtagataagtgagtgattttaattttgagtgggagaatatgtatcaaattgaaaacagtaaaaataaagaaaatgctctgtgtataagaaagttttcttattacattaattgaaaaaagtatggaacagtgagaatactctgctaccatttgtgttaaagaggtgggacaaaatagtatgtttatacttgctttcatagcataagaaacctttggaaaaaacgttcttttcttcctaaaaaatgatgcttgcacaatgggacattcgtattcaaaagaattaactggacaaagaccctatgccttttacataaattaactcaaaatagattatgtactttactgtaaaatgcaaaactgtaaaaatcctaaaagaaaacataggagaaaatctacataactttcggttcagtgatgagcttttaggtacaacatgaatagtatgatccatggaagaaaaagttgttaagttagatttttattaaaccttaagccttctgctctaccagaaagattattaagagattaaaaaaacaagttatagattgggagaaatatttgaaaaacacacatttgaggaaggatttatatccaacatatataagaacaattgaaactcaacaataagtaaactcaacaataagtaaacaaaccaatttttaaaaataggcaaaatatctgaatagacatcttactaaagaagatatgtgaataggaaataagcatattacaatgctcaatatcatttatcattagggaaatgctaattaaaacaatgatataccattacacaccaattagaatgggtaaaatccaaaaaaaaaaaaaaaccccaacaataccaattgctggtgggaatgaatagcaacaggaatccttgtttattgctggtctgagtgtaatgtagtgcggcccctttggaagacagtttggcagtttcttacaaagctaaacatagtcttatcacaaaatcaaggaattgcacttctaggtatttactcagttgatttgaaaatgtattttcacaaaaaatcctgcaaacaggaagcaaccaagtccttcaataagtaaatggataaactgtggtacatgtatatgatgaagtattactcagctataaaaaaaaacaacgcatgattaagccatgcaaagacacaggtgaaacttttttttttatggctgatcctatttggatgaatctttaatgcatgttactaagtgaaagaacccaatctgaaaaggctgaatactgtatcattccatttatatgacactctggaaaaagccaaaaaaaagattaaaaaaagataacaaacagattaatgatttccagggctttgggagttaggggagagctaaataggtgaaaaacagaggaattttttaggcagtggaactattgggtgtaattctgtaatggtggacacatgacactatgcatatgtcaaaagccacagaaccttacagcacagagagtaaacctcaatgtgtacatatttaaaaaaatcatttaggaagttaagagatcccaggatggaattcagaatgtaacagaatatctaactgtattataaatgtgtgaaataacctcaacaacggggattggggaaataggagctgacttccggaactttggaaattaatggcgtatgtaggactaaaggcggaaggaactgtatatagacacttcacttgagttgataaagttgtttacctgagggtattggttaatgatattaaaaccactatacgtgtatacagaaagtgaataattaattaagtaaattgatggtagatcatgggagattacagataagcatgagacagagactagaattatctatgtgataacagattagagtttaagacatcagtatgaattcatgtttagcttactttagatacaaatagatacatatagaaatatttatagaaatatttatagatatgtgtatatatactgattgttatacacacacatatatttctttgttctgttggctgagagagctcagaagcagcaataccttgtagccatgagcacacatagtggccaaatcttgatttcgcataccattctccagtagaaggaacaagccttccttggagagatggttgattttaggattgggtcaggaaatatataagatgagccttgagcatcttgtagtactagaaagtaaggaaatgctcaaaacaaaataaaacaaaacaagaaacatgatgggagtaaatcaaagaaactagctgaaaaacgtccaacagctaaagctggaacaatttgagcaaaaaaataaacagtgttggattgtaacccaaagtaaaaaatgataacccatgagtctacactgatataataagtgtttgaataaataaataaatgagaatagataaatctcccatgcagtaaaattctaagtaatttatgtaaaatgaatcttttcatttcaatattccatcctcaaggaggtggaatataactccccactccttaagtgtgagctccacagggtgtcttccttccaaagaggacagtataaaactggtagggggaagagtatttttataacagagaaaactgaccaacacttagccagggagatgaaccctgatagtaacatcaatagtgatgtcatgtagtagaatgcattcttagatacgatactgtgagaattgcacattacttctatggcattcctccccaaaagtgacaaccctagtataattatgagaaaaattagacaaatcccaattgtcagatattttaccaaatatctggccagtactcctcaaaaccgtcaaggtcataaaaaaacaaggcaagtctgaactggcacagctataaggagcctgaggaggcatgacaaacaaatgtatcgtagcatcctagataagagtgtggaacctaaaaagggtattaggtgaaaactaagaaaatctaaataaaatatagacttggttaataatctattaatattggttcttaatagggcagactgggtgtgggctatgtggaaactctatttttgtaattttctgcaaatataaaactattgtaaaagagtttatcataaaaaactttgtacaaatacatgggacgccaacactagttgcctatgagggttgttggatactgagaagactgggtacaggatgggagggaaatttttcactgagtacctttatagatatatcagtttatttctcaacaatagaaataaaaaaatttagaaaactgaagattatatttcttgtttgggaacaataatatttcttctttaagcattttagataaaatttagaaacaagtatagaaagtgctacatatgttttggtcattagtacaattaccattaccactacaactacaaccaccactatatatttagtgcctatttcctaaatcttgctattcataaacatcttaattttgagttcctggagatccaaagttataccttagtcttaagatgcagttgtgcaattccaagcttagtgccttcggcttggttgcttaataaatgtttttatttgactttatttgcaggccttgacaatcaaaaccaaatgattcctctccccttgtcctgctaaattagcttattttttttttaaagtgtattctgccactaattttatttttctatcttaacttgcctgaagtttcatgtatttttcctggttctctagggaatttagaagccagcctttactttgttaaatacagcatggctaataccatgtggatttttaaagagtgtaatagaacagttttgaatgggcataaagagcctgaattttacatttcatttaacagtgagtgttttattttcaataacaaaggcagtttgtaattgctgtcacgattaatctcttgctatatgtttgctaagaggattgagtacagaactaatatgtaactttacaactacaagtaaaaatcaccaggtctagtctaaacaagagaaagggagagacagaaaagcacttctttctaagaaaaggcagaatgcgtatgctttcagcagcatcacacctttgtaaggcagttaattttcatgtatatagaaagatgaagggaaatcataatcagtgttggatactaggcagtttgtaaggcaatttacaaacgtatgtcattttattctcaaaagaaatctgtgaagtagatgtttattttcaactagatgaagaaaagaaggcttagggaaatgctgtgtcctgcccacattcacacatggattgaatggcagaggggagggattgatcacaagatatctgggttctgaagcctctttacatctggcatatttttttctggtatatattctgtttccatattgctctgaataaaggaaacagaagttgagagtaccagaagtttgtctgggaaaatcaggactttagtttagtcaaatagctctgtagccttaaagggcacatggacctggaacccaaagatatctgatttgtgaaagaaccaccaacggggccacttccatttgtgtaaacaagaggcttgaggccaaaatgtttgggtttgatacaagaaaaataatagattaatgagaaaggtatcaaagtagtcctaaggtatttatttctttaagtagcttctgaaaaccatgtattttaaaacatataatggtttatttatattaaattacatttttggtagaattccatttttataagttaaaagaaaatgtatagttatatatctgtggtgctatttataagcagaaaatcaacattttgagatttggttatctggccaatgacccaggcatttagtagaaacatacttaagttatagtttttatttttaaaggtataataaaaatctgtatacctgaagttagagtgttccagtttctattgatgtataaaaaaaactaccccaaaacttttgctcacagtttctgtggatcaggaatttggacagagcccagaaaagatggcttatctctattctaccacttttgtggcttcagtgagaagagtggacagctgggcaggccagctggaggtgttttcactcataaagctggtgtttataatggctgttggctgggatcccagttggggttgtcaactaaagcacctacatgccacctccccagtacggtctggacttcctcacagcaaggtggcctcagggtagttggacttcttacaaggtgacttagggattaaagcacaagtgttctggtaaacaagacagaaactgcatttttacatttatggaattcaccaagcattacttttgcccttaaagtacttacaagttcatccaggttcaaggggaggagacacagttcccacctttcaaggtaaggaatgtgaaattcgcattgtagaagagtatgccagatgggagatattgtgtctcaaaatacagttttcccaacagaatattaagccatgtaattcaggttatctgtgatacacaggacaggagatgacagtgttcatgcctgctgccatttctttttacttatagactagcaataacttgtgcccattgttacttttcagcacttcttctttttgcctttcttcggtttcatgtttctgtacctctctttactgactcaaggtagactagtaatctctaaatttcactggttattatcagtaaaagtttatttttgtttacttcccagttcaatgttaatctgcgtgaggaaaggtatctctgctccatgaagtcatttatagacccagactttttccaccatatggtgccaccacccaataaggcctcagaattctccactggacgtctgctacttgtgtggataaggcacatcctctcttaactgttttggcctggacataatacacagcacctctgctcatgttttttttttttttttttggtgacagctactcatgtggtccctcctagattcaagggaactggggaatatattttagtatgtgcccagtgcccagggagaaggcggggtatagatattggctacatctgctacacttacctctccttcctctctcctccaggctgataaggagtcaggagcctgaatgctgacataatatcaggaatagaatgaaacgaattgaccaatcagatgcaaattagcataagaattctaggaatttagacctgagctggactttaaaaattatttagttcaatagtttaaaactatttttggaggtggatctcttttagccagaggaaatcttacaggaaactccaatttatgtaatagatggcagtgaagttgctctggttaaaaaaggttataggcctcatcttttccctctgccatacactctaagagccttttgaggaatcctagggctttgcggatcagatataattagtttatttaagacacattaaaaaactgagacacagaggggcagggacatgatgtgccaaaaattacatggtttgtctggcaggtttaagattgcaactcaagcttcagtagtcccactactatttacttaaaagctgtggtactgcctctttttcaggacacatagccattgagacccctggtctaaggtggggcacggtatacctgccttgtgttgttggcttaatctctttattagccaaacagtggacttaggaccaggaaagagacaggagcttcagcatgggctgggtgcggtggctcatgcctctaatcccagcagtttgggaggccgaggtgggcggatcacttgaggtcaggagttcgagaccagcctggccaaaatggtgaaaccctgtctctactaaaaatacaaaaattaaccaggcatggtggtggggtgcctgtaatcccagctactcaggaggctgagccagaagaatggcttgaacatgggaggtggaggttgcagtgagccaagatggtgccactacagcctgggcaacagagtgagactccgtttaaaaaaaaaaaaaaagagcttcagcatgaacaactgtagcatttctttccagagtgatgagattagcataaagaatgagggctggcacctgggtctgcagtagtctgacttggcagcatacctagactgagggcatcatgagaaccatgaatggaggctgcctgagttcacttgaactgttttgtcctctgactctgatgtgatcatgccactgtacctagtgagcctggaactagactgcttttgtttaaatcctgaatctgttcttatctacccatacaaagttgggcaagttatttaatctttctgtactttggtttcatcttttataaaatagggatgataatagttggtaatttttaaggttgttacgaggattacatgagtaaatatttgcagactagtgcctggcccatagtcactactatagaaatatttgttaaaacaagtaaaatatcttacaggtttgtggtaggaattattttgatatgaaatatacagacctaaaggcagttctcctagtaatgattagtactcactaagtattagctattattacataaataatgttagctatattgtttttgttatcatagttattattattgcccataaaaatagagttaccctttattgaggtcttacaaaattgtaggcactatgctgggaaacttatttttttcatcatctttaggattttccaggatttgtggaaatgatctacccaggtactctctctctatatgtggtggcttattccttttatagaaagtagctggacacctgcctgggtttctctctatctggagagtcctgctaggggtacacgctgggaaagggtatcttcttgtttcccaaatccattttgctttgacctccccacccagactcctaggaagcaatggtttgttcagggccacagaaaaatcattgttggaatgtaagcaggtactgcactaactctggagctctttgggtgtgatatatttctctgaatagctagtatatatccttgtagaataactggaaaagagaccttttctaagaaatgttttacctttacttgtgatttagtgctggatgctatctaaaattaacttttactgttttcactcttgtacacagaagccacctaattcatccagcaataatcactttaacattttgaatatatctagcccttctgttctatatataaaatataatatattttatatattatataaatataaaattttatataaatatatgaatataaaattttattataaatatataaatataaaattatattatatattttaatattatgtatgtaatctcaaaataggatactttggtatcaattttggggaaaatgataaaaattttaataaaaataacttgattgatctttatctacctatatttttagaattattgttcctgaatttatttccagatctactaaggaattcagatagtctcatgaaaatcgacttcagttcatgataatactgattgtacctgatacccaagggtggacctttgaggaattatgcatgttgattctgggtagggtctaccttgcacttaagcaaaggcctgggcttacagaattcagctaagtaaatacaggttggaaaagatttgccttcataacattttgtgttcaaggtcttggggtgttagttgatgggaaagtcagtgtaggcgtagttgtgcacagctcagagcaaagcaggtgatagtgtcactgtactttgcattagaccacatctgtacaagtgcctttattcctggatgctgtatttaagtggaaaattgattcatttgaccatgcctagcgcatggtgaccaacatggggaaggctgcaaagaggaagaaggcagaatccttgtccaggaggggctcatagtttagatggagatgggagtataaaggaaggagccagggaagcttggcttgaaacagaagagggaatatcactgctgttttccgatatttgcaggatgagcagacttttctgggagcgaaggcagtttgttggaacaacacacttggctgaggtccaaggctaagggcttgcaaaatcttttgcttacaaaatctggcttataattttatcatttatacagctgccctccccagagactcttgaaaagaccccaatacacctgagtcctgaagaatgaggactggtgaggggtagattgctcactagatcagcctactgtcacttccagtgtcctccttctacctggcagcgccacgtggctcctattcacttgctcgtagcgtcagacttctgctcccttcatcaagaccagctggccaggaagtaaggcaacacctggcatactactatagtgcttcttaaacacagatgtaaacatagaacatgaatcatctgggagttttgttggaatacagattctgctgcagtagaccttggggttatcccaataatctgaatttccacaggtgatgctgctattggtgttctacagaccaccctgagtcacaaggttctactagaaaacatgagtcttccctccaggctacagccaaatcccatcaggccaaatgactttctgctcagagttgcctcacatctttatttgtagagcattactgcctggaaatattgccttattttcctcctagccctcatgaaagaattttatccagatgtcacttagccatccagtgtttttattattgctaaggctgcttcagcagttatctgacatgtgttttcaaaaatatatcatcttgattttcatccaagttgcatgagatgcagcactttttgaatatgtgcaggatgtggccagaaactttagtctaagataaaagtatcatttgcctgacattaggacagacttcttttctcctagctatatatttgtgattaccccaatgtaatcactgactccagtgctttataaagtgatctttaagagatctgtttataatacattgaacacttgctcaatgaggccacaaccccaagaataatgatgaaatctggttaaatgtatttgcctccctctttaatgattccagcaggtgacttctgtgagtatttctaattgtcattgattgaagccctttcaaggtcatgtcccttccccaagtaattgcttattggtcaaagtaaagtaattgagagatttctcatgatgtgtgaatcctggtaggatctcaaatataagctcgtggtgcatttctatacaggtgctaaatggtcttgggcaagatacttaatatctttgatcatctataaaatagggataatgaaatctaccttaaagaaattaaaaagatgatgtctatgaaagcacttgccatattcctggcacatgacaatcattcattaaatgacttttcttgcctcctcatttgttccttttaggccatttttcaccctttttttgggggggccgtggggagggacatattttacttccttcttcactagttcacaaagcaccttcagacatgggatatatattttaaacccctttttagtttttcattatgtgttcagtaaagacatattgaatgaattaatgaatggccaatagtctgtaacatcttcttgacctctaagttctccgattgtttgattcttcagtgttctaacaacttagaagaaactggagaattcccttaaaataaatgtcttctttgttaaagcatttccttttgtgcagtcttataaagtatgtattacataaattattactaataagtatgaacctgggcctagaagctggctgctatggtataaataacctcttttagtttatgaccttgggcatgattctttgtactggtgcaaatgaggtgggtcagaggctggtcttgactctctgcttgcccttcactgtttactttggaaagatctgtgaaagatgagcaagaaatatgtatttgttctttggcatgacttttgggattcaggcacaatagacgctgagtttcctgatatattcatttcattcctcatagaagatgcattttgtcttttagattaaataccctttggcttgtggggttagccagctcagtggattagaatagaagcagcaggcccttccaaatctaggggttaagcctagttacctgtctaggctaatcgctctggagttgaccatatgaatgagttgttggagttagtgcctggtgaggctatcctcaccactttgtcatcatgcctctgggatgggcaacaaactggcagaaagtgcatacactgtcaaatttagatctaagtttaagtctggtttgggtatgtttaatccttaatctcagtttttaagttttttaaaaaagataataccagtctcaggttttttgagtgataaattagtatatgtgaaatacctagtgcaagccctggcagtgagatcaggcccaacgttgatgacaatgacacatttcagaagagaggcataggaaacaaaatagttttggcacctgtgaaagtactagccctgttgtgtgcctgaggagtgtcccaaagttgcttgtagcattttatgactgaagtgcagaccacagtggtaaggctaagaatttcttatgggtttgaaaaacaggatcataatcctggaaaagaaaaaacttaattgcatatttcattctctgataatttgaaatactaattcctatgtgactagcttcaaccttttctcccctactcattatctaggaattgttattcaattatatctttttgtctacagagaagaaaaaagactaatcttttcattctgacaatgtatttcaatccctgatgtccaacatgacttccatttccctttaattcttgaaaaggtaaagataatagttctgaaaataaccatcaatagatccattccacatgaatggcctgttttagacattcatggaatgagggttctgatttgtactttgaagtatttaagaaacactgcactgagttttgctaattagctgtggcttgttacctcatggtggaccaattgatctctgtttcagaggctcaagatgttgccacgagggttctcagacaatagattcattgggtgtcctacagtgaattgacttgaggtcttggctctttgtgccatgtttagctaattttagattgtgagagacctggtagtaaggggttgagggattgatgatggctgtgatatccagaactaaaataaaacaaatgtttgttcctttacatacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggtatttctttgtctttgagtgttgctgattctgcccttgaaatcaagcaatggaaaaggggaaaaaatatcaaattccttcaagacttgccaggaaacaaacaccaagggaccctaattgtaatttaacctaccaaatgggaccttaggcatgctgaaatgaccaactgtaatatgataagaaaacagttcattaagatgaaactgtatcccgtgattaggagcaaatgtacaaaaggttgattgcagattgggaaatagtaagtgcacctcagtgtgctccaggcactggctggaattccatggagctgtgatcacagttaacggtgatgtattgttgttgagttcgttccactgggaagcgaataagcttgtctaccctggaatgaatctgagaagcctgtgccactgaagcagctaattctatttcacttcatcaagctcacctttgcttaaatatcttttccaaatggaggcttcttaaagaggctgttctctgagccttttggaattgatgccaggtattttctccagaggaatgagccttccagcttgtcaggggatggtgggaccagggggtttcacaggaggttttgggttggggtgggatggaaatgttgtctcccttgtctgtcactggagccaggtttaatgaaaattgaagaatgagggagtccattggtttctattggatcatttatggctggacagctggataatggtgttcaaggggaaagtttttatctctccataacccactgaagatccttatggatagtgacccgagtccaattacagagtttttttttgcattctgagcagtgcccatgcattgttgattctcattaatgatgccatcaaagttaaaatgacttttcagccacacaaggcttgctcccttgaacccaggataaagaacaggcatattggggatagcctcccttccaaaaaccatcaagaggagagatattccaaggtcagtcagcttcagaccgcatttctcatgaggagatgcttgaatatgcctgccactctagctctgcagtctcttttagaagagttggaagggcagggaactgttgtcaggctcaagggaaggtttgccatcttgaggtgagtcttggtccattttgatatgacctatttaaggtgctttttagacttctgaagaattgtggtttccaccagatataataaatatgtctggacagagtttccatagaaaccactagctcctttgtacactgcagactggggctgggcagcctggataaagccaatgcttagctgctatatccattttcactttcaagagctcattgcccccttcaattctctagaattaaagtggcctgtccggcaacactcctatgacccactgtgacctaccacccacatgctgtctaaatgggattgcagaggaagagccctgcttgtccttctaagccacaggacagaaagaggccacaaaaccctagtttcgtaatttccaacttaagagtcctggagatactgctgttttcttgctatgcagttttttgtttcttccttctaagagttttactctgtttcctgacattcttctctctggagcagttcttaggtggtgcttggccttcagtgctcagtctacatttgtggtggttgttgttatttactctgcatatcaatggcagctctttgaccctgccttcaaactttcatactctgtatgtccttcatggaaaccatgacctctctaccaggagagtgagaagaggataggagatctgtagttcacagtattctttagagtcattgccatttataaagaattgactgagggtattccaaatattccttctgttttcttaatatttttcatactttggcttgtggcataacatgtcctttatgtaagatcttggagggaaaacttatgaagttgctgctagttaatgattcgtagactctaaacacaaatacatttttcaggtaggtcaggagaaaaaatggacccaaagactggtcataagaaaagtaaattttgattttcatgtaggaaaaggctagaaacatggttccaaaatctgactatacctaagaattacctggggaacatattaaaaaaatggataaccaggctttgcctctgacctactggattagattccccgagggcggaacctgagaagcaatatttttaacaagccctccatataggttccatgcgggcagtctacccttggtgaatggactggcatttccaaaccactggtttagaaagaggggaaggaatttggtggagaggctgggctacaacaaataaatgaagtcgtggaagaccagttacctgaaggagggtaagaaggagaaaaggattaaggagagggtagtgtctaatgcacgaaacaaactttaccttcttcacaagtttcttcccagccagaacttgccaactttacagtagcagaagctctgtcccatatatcaagatgctggttctatcacttttagtctcagccaccctcacagagagtgaatttcagctatccattactactttgtgattcttattttttgatccctgttactcttagagtttttctcaacctctcacccagtagtgttctgctgattagagtatgaaaggagatgatgttagataacatttgatgttgattgtgctaggcacagtgctgagtactttacatagattaacttattccatactcattctattagtttttcctctttttaagatgaggaaactgaggttatatatttgtctgtaaccctgctactaataaatggcagcaccaggatttggacccaagtttgacctatgagtgtctgcatctagctactactaagctatttagcccaatagtggggaccattgacactttatttggtacatgagggaaggccaagattcaatgtgagcagtttgttcctttctaatatttccctgccacatgtcttatattgctaatcctgggagctgcttggaaagatgtgaaatctaattgatggaaccctttactttggtgctggagaagggatatacatttattgagcctctactataggccaggtaatgttctagtaatagtattccttaggataaccatatggggacagttttactagatgcattttgcatatttggaaatagaaaagctcaagataaataactaggtgtcaatcacataatataataagcatataacccaaactttgagtctgaaactatctccaaaaccttagtctaacccaccctccaggtcacctccatagtgtgctaatgacatgtactgccaaagacaaggtcacaaccacaccagggagtcttcccaagggagagatactacagaaggttcagggaccatgagaactctaaaatcgagaagaaatttcccagataattccattgctctgaggaatattaatgtggcaggatttcgcacattatttttttaggtcagaattgaggaacagctttttcagacctaattgtacaaattgtcacaagaaaagcaaacgctattttagttggtagttcaacactttctgcttgctacggagacacttttctccttgtttcagctgtttagctgggcttagttagaagttcctgatgtgtggatagcagattacctcaagctagaaacatagaaggaaccattcagttgggtggggagactgattatctccattgccttgggtttttctccggctaccttttatattaagagttggcaacaaagcctggaatggaacctgaagaaaccttccttagattcaccctctcccttctcagctcactttacagcctgtctctattactcaaaggacagaatccaccaacatctgggattcagtgcataagcaacctttccctttcacaacaaaatgaattttatttccttctctttatttgtaacttttaattttcattcagcccatcaaatttatttattgggtacactatctctgccaggctgtgtaggatacaaggaaataagagtccttgccaccaggaagttcttggcttattcatttagtcattttaacttcgttctgaaaccaccagagcccctcacagtgattgggcctagtccctgggtatcagaggaagcctggatgcagacaggagccctgtaagcaggctgatttgataactcgcaatggcagctgaacagtggaaagaactggaaacagtgaactcccagcatcttggtcctgaagtgacagtggagctgagctcctcagcagctaagagatggatggcttttaattcacccagcctttggccagcactttttgtaatatgccggcatccctaccctgtgttaacctccttatgcctcattgctggaaaaattcagctcttaagtgcagtctatcacatttcaacttagctcttattttttcagacttgttcaaatgtgtatggcacatacacacacatctgcagcccgattgtcaccttgacagagagttaacaagtgattagtctagactagactaaacatacttatcttttacttttaacacatgctatttattatccatagagcacatccaatttttgcatacaactgatcttgaaaagcatgcagaatccaaaactaaacttgctacaaatcaatgaatgagtcagtaatttaaggtttctatctaaaatttcagagtaatttcaggatgtgagcatctgtttatatgtgtagacttttcataatgaaatctgttgatatggcatcttccttctagagagcgccacaactacttaccaacatattatttaaccttgtattttttgaggtggttaaatcacaagtataatgcatgacattggttttatacaagcatatctgctgtagtatgcggagggaaattaagagatgactatcaaaggtctcagctttcaagagagccaggctgagactctcaatctcctggttctccaactgatatgttctttgcttcataaacagaaatacaagagcacaactcattatcaaaattaattaaaataaaattggaagctagcatatgcctcatgtcaaactaacaaagcagcttcaggttgtctaggaagagatgggaagcaagctaggaagataggacatattcatgtgtaaatttaagtaacagcacaaggtaagagatgtggtaaggcagtcagtatatgatgtattgctagattcctggtagaggcaatcaggtctgggagatcacagtaggggaagctcctgggggacttggagtaacctctcaatttcttaccagcctaggtgaaaatgcatgacaatctctacagctttatagtttcaccattatgtgatctgaatctgattctgtaccagtcacatgagtcaggcttagaacaaggtttatctcacaggcataacagtgccaattctagtgtggtgagagaaaaccatgtatgggtaagtagtatcgagttggtagtgagggaaggtctgtagggagagacagagaaggaagtgtgggaaaggagaggaaaaggaaagatttgtcttccatgtttcatatttgaagcatttgcgctccgtggtttaatctagatggaaacatattttggaccctagtcttggttttgccatttataaaatgtgatttttatgtaacgatgcaggagtgtgaaagcaagaaatctatgtctaattttctcattcattcattcattcactcattcatatgccagaaactgcgcttgcatctgtaaaatggcagtaatatgaattcttctaccatagggttgtggtaggaatttagctagagggtataggccaaatcctctgaaaatgttaagcttctgtatgaacatataacatcattaagcacaacagatgtataccatcatatagagaaggttttaatatattgtactgaaaatgggtaacatttagtcaaatttttacctctgtaaaaatagtggcttatatcccatggattcaggacataatgtgtaatgtagattcactgaacaatgtgagatttctgaggttattctactttccagatcctaagcaaggtttgccagtagtttgtctttgagttctctggtctgtagtgcagcacagtattgcatgctttttacaccaatagaatcactttaaaaatttgtaactgaggcagagtggggaaggaaacacctcctcctgtgtaagattttttgttgatcctggcagggctttgagaaagtgacatgcccactttccctttttattcctgtgaggagtggttcagaaacttactccccaccactcatgaggcaaaattatcatggcttttatgaaaggatgtaaagttttgactttacaaatgagggaactcatttgctctaattttctggatgtcctaaagcccacatggatgagcaaaatatgtactatttgcctctctactttgaaagtctggctttttagctcaaaaattctcttgactgaaaacttgaactgaaagaaattggtattaccctgggcaagtccaagtcctttactgtctctgggctttagcttcctaagtataaaatgtggggctaggactagatgacttttaagtcttcttccacctctacccttctgggtgtacctcctgattctatctcatcacaagtcttatttcagggcttgcattcccctccccctttagcaccatggagagcaacttagcttgtccttttcaaagtgccacttctgtagtggacctacaggggtttgcagtcatctgaatttatatgtgagttggcagtgcaacatgctgctgatgagcaaagaccaaagcccacttctcctggatgctcactctctctttttcttttttaaatcacttgctggagtagatactgaatatgtacttttggatgctaatggatgctggccttttcttctctccaccttgtgctctttcttcctgagttctctgcctcagacatgtgacagtggacagcctgtgtgggatgcaggcttttctggccatggaggccttggtagctcggtgacctacaagacagagggcagtgcacagtagcaagcagatgatggatagttgtgctgtgaaagacatacatcctctgaatgctgaagtaaaagaagccttggatgctgctaagtcacagagatttaaataacaggaaatagagttaatgttaaagatatagatggccaatataatactttcaaaatgagattttcaggcaaaatagagagtgtctgcttaattgctaaggcagcctgaccattacagtgttggatatctcattctgacttagcccccacatttctactcatgctatgtaccctgtggcgtattcatatcaacctcgctaggtggattccaagttaaccttgtcctatgttctattaacatcagtagcagacctatttctaatttttaagaaccttcaactttttcttttttttttttttctggtgggtttaaatatgcctttcgttaacgattgcctcaatggcaaagagagatagaaggtgaaaggattaattgaaatggaagatgagagagtgatctgcatttttctccatccacttgcactcctgggctttcaagtttgcaaatagaaagaactgggaaaaaatacaatagactctttcctttatctgatggtttgttggctacctgaggcgaggagtggattaaaaagaaagcattttgttgcatacatgaggcctgagatgtgttagaatagagaggaaaataagacttcatttccaactcatagtgatttcatctacctgccttcagtcacatctcatgttgtcattgtattacatggacatgggtctatatagatgaatggagggggaaaataggctgcaagagaaaaatatattttctgataggaaaaatattgatgcttgcatcttaattgttgtaattttactctatttttgatggatatgcatggttattttttaaagagaaaagcaaggaaagaaagtaaaccagaacaatacacctggtgaaactctgtttgaaaaaaacatatacacattcatatattagttttctctgttccttttatgcttcacttgttggaaaagatcattggggataaaaaatgcatgagccatgaggactttttaattgaaaaaacaaaaacaaaaacaaaacaaagaattccaaacagtgcattagttttccagatagatcagggatgctgatgtcgttgaaaagaacggattttctatactactgtaacaagattcatctatctccttggaaactttaattaaactaatgttataaataatagcagccagagctgttggacacaagaaaacagatttatagctgcatctgctcagctattcctcttttaggtggtatattggggttaggatgtgaggatgaagaggcttgcacggaaaatgtttctgtgcactctttttcctgcacaaaccccaaatctaggtgacttttctctccagattatcctttttagtttgttgtgagtgtttctgccagcaagggttgtagagttgcagagccagccagctaatgtgcctggacccacacctgagggttttcattggcaattagagtggaaataatttctcttctctttaaagggcttgtgtaatggtgtctctaactctccctcaggaatgccatgtcgcatccctactcattagagtctattagtctgagggtgtcacttttctgacagcaaatttcacacatttgaactaacaagcttcaagttgtggccatcagctggcttctttgggacacctagaatgcctgtattacccagaatggaattttattatcattggaggtaaacagccctaggctgtgattagtcctggtatatcctcagcaaagcagttgactgactaatccttccatgtacttttgctaatatctgctttccaggtctgatgctgtttttggctgaagtacaagcaagaaagaggctggggaaatgctgattcaaatttcttgtattctttgacattttagcctcagaagcataacaccacgctaaggaaaatgtagaatttttgcttaatcattagtgagttgaggttagtgtcttatgtttctctagagatgattgatacattcacttgatctttatagctctgtgagatggatgtgattgcatcttatagatgggaggttttgagatgctaagtgtaaggtacatggatgtgctttggtcaagaataggctgaggcagacatctgggccagagtgactcagtgagtttggagtacaggtgcataactccacttgttatataatcacagccataacatgggaaggctcatcgctattattgtttgtaaaaggtataactgccctgctgatgctgtgcatacagcatgcatccagagggagagagggaagctgttggccgtataagggagagccagccttgcaggccagggaatgcagctgtaagcatgggagcggcaggagctgcagaaccagagcaggcagccgagataaaggcaaacagtgtgagagagctgctgatgagagagtcgctgaataaaaccgtatttcacctgcctatagccccccgagtgttctttcagccattcaccacccatccactcactcccctcgaacctcagcatgggctgcaacctaatatctggcatgacatttggcatagctggcaggagaaggtgagtggttcttcagccccgaggctcccagctcggctatgtgacctcagcatgggctgtggtacccagtggcagtggtgctgctttgatgatccccagtggaaatgtgagaggcagtgggcaggtctcctgtgagtgtggagaaagcactgaagcagctggaaggacacagcaccaagaaggaacgcatcttcaccggcagagttggatgggtgtttctgactgcactgtgggaagtacatgctcagtctctgcaggacgctgcccaggtttagaagtgacagtgctccttatgcctgggattgagatgatgcaggtgagagagtctttctggcagccagcaggcaattcagcagacacaagccctacgggtagttagccaggggtgtccatttaaacgtgatgtgcatgtgaccacagatagtttcagttagggcctatagcggtgcatggagcactgaatacaccagtaggctttgggtcgcaactatggaagggagccaagctccagtattccttgataaagatgcagttagtaactgcatatgctgcccttcaggctcgtaagaacgtaacaggacgggctacagttgtcatgtgcacagcttacccaatagcaggatgggtgcattcatgggtaacaaccccacaggctgggacagcacagacatccactttagcaaagtgggacacctacttagagcagtgaagtactctacaagtcccttagcagcagagttacaagagatattgaagcctgtagtcctaatgcaagataaggccatggagcctgaggtacccctagaccctgagccatcaccgtttaaggaagtgcacccccctatttctgatgaggcatagtatacagataggtctagccagagcactgctgctacctggactgctgttgcagtccagcctagtactgacactataaagtttgataccaagtgttggcaaagtagctaatgagctgaactcagggcaatatggatgatgatcaccaaggaagtaatacctatggtaatctgcaccgatagctgagcaatttatcaaggtttaaccttttggtaaatcacctaagagttacagaattagctagttagtcaccaacccatgtaggaccaggccatatggctggatctgtgacaggaaggatgaccttctccaaccaggtatgaggacaatgatgatctgttgttgcctgctccaacacccctgaaggcagagggaacagaaaacctaatcttatccataaactctccaagccgctgtttgcagatggttggctatcatagccccctgggggtggggagggactgcagtataacttacatggtactccttgggtatttaatgtgtggcctccacaattaaccgtttgtaggggaatggccaaggaagggatcctcctccagggcacatgtgtactgtctgtgtggcctattagaagctcccctgtgactttggcacaggtacaggatccaaaagaaccatggggaactgataaggtgtaccattgcccagggcagaaggccttggcggctgcattattacccagagatgaaaaattagcctgcattttgcctgaggaacgtgatttacccctgttagtacctgtgcctgcttcgtcatttcggctgtaggttgacatgctccaaagcattgtggactaggcccacacctacactgaagtgaccaaagtctcaaactgttggatctgcaccacccttccaacagcagctgcagacagcttgccctggcatgcacctccagcttccgtgaagaactggacatagctagagacttggggttccacggacattggttaggccaaaatccaccttgttataaattccaagtatagctgatcagttggtctttagatgctagaaggcttatgtgtgttgtttttagattcaaagactccctctttcctggaatttgaagtattgataggttcatgacttcaacactacagagatacggcccattgtccttgtaagatttgtatgccttgtgtgggtctcgatgctgatgtgtaatggccagggacataatcttacatcacgactgactgcaaatgagccattcagccatttcttcaaatgtggagtagacgttacactagtctccagtgttacgtatgtggttttacactgctccaatataaattttgatattcgctacctcaaggtgacaaattctctgtattctttaaggggactttgcaattgaaggtctcattataaactactggtggtgaaatcaagggttgggcagtaggagacccccatttaggagggcatttgtcgttattgcttcttttattggcacctaattagatatgtactagagcctgcaggaactaataagagagcacaggaggtaggcgaacatattgaattctgagtaattttcatggatggcaatttttcatggacattaggttgatacataatgacttaacactgcaaacctggtcatcctattccctacccactccaacacacaattacgcttgtttaatagcctctgataagctttaggataaaggtcacaatccttaatatagcttacaaaaattgtgtatagtctagtccacgtttccttctgtagtttctccttgcattggtttctgcctttttctgattttgagttctttagaggtatcatattcacttaagccacagaacctctcttcacaatgctgtttctaggatgtcaagttcactcttatacatccttaattttcaggctaaaagaaaggggcctcttgtgttttacacttttaccataaaatagtgtttgcttttcaacacagtaatttttgatcatttgattgatgtctgcctttcctatgggctgtaagcaccctatgagctcaccattgtttcacaaatgccaatcatagagctgccacctaataggtaatcagcaaatatttgcaaatacctgaatgaatgaataaatggcaaagcttctctaggggtctggattcctagcttgtggccactgatcctcacattctcgatggcttcattagtgaattgttatttctttgcctcagtctcctcatctgtgtaggcatcatttctactcagtccacctgtacagggggtatcatgaggttcaaatgagggcctgcatgtggatgtgtgctgtaactttcagtgtgctttatgaatatcaggcacaaggaaaggtgaagacgaagtaatcctagcagtttttgctttgaacttttgagtattgttctctttctcagggaggcagttaatttatataaggcttttggtgatttcctggtctgattaacagcacaaggtgaaccgtgccttgctctcaagttgaatttacatgtggcctgtgtcagcgggagctctggcaggcatgaaggagtggaggagaaggtgatttacagatagagtacaaacataaactgatcacaggtggggtgaagggatgtgtgcccctgctggagaacaaacagagttgggtacttgtgttttgcctgcacaggacatatctccatctttaaattctgtggatctgtttcataaaatttgaagctcacagtaagggcctcattcaagcccattagactaacctctttgggcagggtttcatgactcccaggctatattggtgtagccttagtgtgaagatcaatggatgtgtttttctttaatttttaaaaattatgtaaggtgcaaagtatttaaagatatacaatacccattgccctgcccttaatcgtattgcacagaagtggtcattattagcagttttatttctgttcttcagatattttctttgcatacacaaacacattttttttctccataatgatatagcattgtacatattattcttcaacttgcgttttcatttaacggaatatcagcctgattcactattgatctgcagcgggaacatattcaggaggaatgaggctgctttgtttcttgcagggtagcctgggactgctttgtcccttggtagtgtgtggagcagtactcacctgcaagcctctagcctcctgctttgggctacaatacatctctctttcctgtcacacagcagtgactatagaaacagggcagggagccaagagcccctgcccttgaatcagcatgtcctgtctcagctgcatagctaggtgagaccacggcaattatcctgcactgagatgggagtaacaagattgaactgggtttgtgatgagggtcaggtgctctgagcagggtcataatgctaaatcttattttgtgtggctgaaatggagctagtgctggccagggttagacatcaggtgagcacaatgagagacagtgtagtttagtggttccgagcatgagcttttggagttgggcagaactgaatttcaagtctggctctgccactagatgtgctacccttgccaagttacttagcttttctaagtctcaatcataagatggggacagagtacctccctcaagtgattgtgagaattaaatgtgacagtgcatttagatcaaataggacactcctggttgctaataacagtggctgaaactataaggatatataatgtttactttagaagtttagataaagccgtgcctgggatgagtcagtagctcagaagtgacatgcaggagggacaccctatgtgtcctttgattctgccttccttggcattgtttctagatgcttttctctggaaaattagcactgtgtctggtaagtaagtgtttaatatgtgccatcatgatgattcggatgctaaatctgactatgattctttctcatctgagaaaagcagaagtgaactgaaggacaaaatacagaagctaataccagtatctggttattcaagagtcatttttttttaagcaattttagttctgttttggcatagcaaaattgaacaggaagtacggagagtttccatataccccgtcactacacacgcacaagcttccctttctgtcaacatcaaagcacaagagtggtactttgttacaactgatgaatctactatgacacattattaccacccaaagtccataatttacattagggttcattcttggtattgtacatttgtgggttttaacaaaggtatcgtgtcatctatacagcatcatagtaacgtacagaatagtttcactgccctaaaaatcttttgagctgctgctttttttttttttttttttttttattgatcattcttgggtgtttctcgcagaggatttggcagggtcataggacaatagtggagggaaggtcagcagataaacaagtgaacaaaggtctctggctttcctaggcagaggaccctggccttccgcagtgtttgtgtccctgcgtacttgagattagggagtggcgatgactctcaacgagcatgctgccttcaagcatctgttcaacaaagcacatcttgcaccgcccttaatccatttaaccctgggtggacacagcacatgtttcagagagcacagggttgggggtaaggtcatagatcaacagcatcccaaggcagaagaatttttcttagtacagaacaaaatgaagtctcccatgtctacttctttctacacagacacagcaacaatctgatttctcttttgcccacctttcccccttttctatttcacaaaaaccgccatcgtcatcatggcccgttctcagtgagctgttgggtacacctcctagatggggtggtggccgggcagaggggctcctcacttcccagaaggggtggccgggcagaggcgcccctcacctcccggacggggccgcagccgggcagaggcgccccccacctccctcccggatggggcggctggctgggcgggggctgaccccccacctccctcccggacggggcagctggccaggcaggggctgttctccacctccctcccggacggggcggctggccgggcgggggctgccccccacctccctcctggacggggtggctgccaggcggagacgctcctcacttcccagaaggggtggctgctgggcggaggggctcctcacttctcagacggggcggccgggcagagacgctcctcacctcccagacggggtcgcggccgggcagaggtgctcctcacatcccagacgatgggcagccgggcagagacgctcctcacttctcagacgggatggcggccgggaagaggcggtcctcacctcccagactgggcagccgggcagaggtgctcctcacttcccagacgatgggcagccaggcagagacgctcctcacttcccagacggggtggtgaccgggcagaggctgtaatctccgcactctgggaggccaaggcaggcggctgggaggtggaggccatagctagccgagatcacgccactgcactccagcctgggcaacattgagcactgagtgaacgagactccgtctgcaatcccggcacctcaggaggcggaagctggcggatcactcgcggttaggagctggagaccagcccggccaacacagtgaaaccccgtctccaccaaaaaaatacgaaaaccagtcaggcgtggcggcgcgcgcctgcaatcgcaggcactcggcaggctgaggcaggagaatcaggcagggaggctgcagtgagccgagatggcagcagcacagcccagcctcggctgggcatcagagggagaccgtggaaagagagggagagggagactgtggggagagggagagggagagaatttttttatttcgagagtcattttttaacaattaaaaaaattttttaaatagaaaattgtatgtatttattgtgtagagcaggctgtttgaaatatatatacattgtggaatggttagaactagctaattaacagatgcattctctcacatagtaataaattttgtggtaagaacacaacatctcttctctttgcatttttcgaagactgcaagatacttcattaattctagtcaccatgccatactatagatcttgtgaacttactcctacagtctaactgtaattatatatcctttgaccgacatctccttatcattttgatacatggctgttcctgccatcagggcatcttcaaaagacccagggccttgatcaaagaggggaaagagtatgagtgggtctgagaggccagagtgcctcctgcctccataggccatcgtcccaattggcaggggtcaatcttgttggccttcactttcggaaacctggcctctacctgtctgcctgttgctgctgccttctcaaaggccctttcaacacaggtcttccttatacataaagggccatggcaggcccagctaagccagagcctgattgcagcttttacccaagcctgacttcacacttacttttatctcctgatcctgtcagctcttgcctttttagttcaccaatccctagattttgatactgactcagtttggcaacttgcttggattccttccctgtttactgacttcagagcttcctggctgctcctgccagtcctcctgtacaacatcctcattggcaggacagcccttcctgacctcaggggagattctgacctttgctttactagtctccttgaccttgactttttgatacacactgatatttttattttcctgccctcctttaactgcaagttggatccatgacagttttggggggttgctctggacctctctggagttagagctatgcagcagtggaaatctctatctgcagttgagcttaaggcttcacttgtaggagctctgaaatctagatttcagtttctagagatgaagacgaatacaacttttgcaggatccacgaagctgttaaatgcacaaattatatgactgaggcttgctgtaaagctcattcctgctaaacaccacatgaaaaaggtgacccagtatttgtaagatgaaaaatcactaggattaaccaaaatgtcacctccttcaaaagagggtgtgctcaggtatcacctgcaataatccctcaagtgggaggccgggtgggatgctggaaaagccttggagtctgagctgagtatcttctattggcttctcgggaaacattctctcccctcccttcactctactgtgtctgagcaggctgacctgcatgggctgcatctgtgggcttctttgccatctggattttttttgaattttattaggaagaacaggcaggggaagggaggaggagaaggtatctattcccctgtcttcttcactgtggggtcaccttgggctggctgtgacctttgactgaaagccacaggccctattaggtggttctttttggcttccttgctctttaatgccagaaagggaagagcttttcccatcttctttttacacactgtgaggtgccaccatccctcacagtttatgtactccttgcctgtacttctgtaaacaatgccgtttaatctattattctctttgcaaatgaccaaagtacagtatactgagtttcccacaggaccctgactgttacacatcctaagtcagaaaccctggctcactctctggcttcaccacttcctagctgtgtgctcttgggtgtatttctcaactcccttgaatcttgggtttcttttcagtaaaatggggatggcagtcattcttgcttctgtctataccaccctcctgccccctgccttcaaggaagaagacaaagagtgtacaaatgttatgtaaactgtaatgtactgtgcacaaaggaggagttaccatctctgtgatgcgcaaggagcttgaagtgggaattggggaaagcagaaggctttgaggctagagcattcaggtccccagatgggactctgcatcctcacctgctcctcagcacagccaatgagaagcacatctggcaggagaacaggacctaacaaaataccctccaaagctgaggccacaggaccgcctgttctattcaccttagcccacaggtccaactcatctggaaaacagatgagagctcctctaattacagacaaattatgtagggatgacattagactctggtaagatggactctctggtaaggcctttggaaaataaagttatgtggtccaaaaggaggaagctgtcaaaatggtgctgagaaacagatgaaaaggccaatttctggccttttgtttttcaacattcacagaatacagtattggcaagagtaaatcctgttatttgtgtctggataatctgacacttgttgctaaaaggaaatggccatggcatttatattggaaatttccttggaaggccttgtgcatgagcttctggagggaggtggcaccccctctagcagatgactctttatcacgtcaatcacctcatcttcttttattgtctttgaaggactattcattgtgtaaaattatcttgatcagttacctgtttacaattttatgatgtctctcattctttcctacctgtaacccttgcctccaataaggaaatcagctcctcgaacttattttaatgctgagttccaagcacttggctaaatgcctggcacagagtggacattcaacaatatttgttgaatgaataaatgagagaaggattactatgcatagctggctatgttgggcacaagacagaattctgggtctttaaggagctcacatctaacgtctaatatctttccacaactttggggcaatggacataaacccacaactccaagacattaaatactcagggccccaaaagaagcaaaggcacagatcaactgttataggattagaaaatgggagacttgacttccagtggaaatgaggggaaagtagaatgaacagaggtttaagagaaaggctgtgtttatattcagatccctaatttctcaatggtttccttttgcttcagttatttgggccacagttttctcattaaaaaaaagatgatgattgactctacgtcatgggtttaactgaagtaatgcatggaaagcagctgggcacatagtaagcagtcagcaaatgttaattattattattgttagcagcagtagtaggataaggaggaggagaaagaggaggaaacgtttatgaacgaaaattcagtgaatcctggccagtggatgagaagacttgcgttccagcttttgtcttgctattcaactctgtggtgatgtttgaaagaacttccgttttctgggcatcatttgcaaaatgaggagtttgaacttgctgatctctgggtatcctcaaattattattagtttgcatagagttgggcttgaaggatgcatagtatttgtgtttaagagcatacggtgtgcatatggaggaataactttccttcttatttttatttgtttctgcctatgccaaaaggttatttaattaagagaaaataatcacatgtctcttgagatccttctactccagtacctgcacactttggatacagaggagcaaccaatcaaatattcgttggttgcttggctgacttatttggttggatattagaaagagtctcaaaattccatttttaaaatttctaaattgtgaatgagacatttatttattttaccctcactcatatatacttaggtaaacacagagaaatagagggagggtggaagagaagaaagaggatgtcgaaaaggaccgaataatatttatcagttgtttacagtgtgtcaggggtttacatatagcatctcatttgaccttcagaacaatcctgtgtgatgtgagagcagatgtttttaaggcatcttcatttccattttgactttgagacagtaggatcagggaggtttaacctgtttaaggtcctagaagcaggaggcatgttagaggtgggattgaaacccagacctccatgactcccaagccatcatattctcacgtgctaagtgaaataagccagtcacaaaaggacaaatattataagatttcatctatatgaaatatctagaataggagcattcatagagacagaaagtaaattagaggttttcaagtgctggggggagggtgaatggaaagttattgcttaatggttatagggtttctgtttgggatgataaaaagttaaggaaatagatagtggtgataattgcataacattgtgaatgtaattaatgttactgaattgtacaattaaaaatggtgaaatggtaattttttgttataaacatcacaatttaaaaaattaatgttatatatcaaaaacattgaaatatatagcttaaatgggtgaattgtacatgaattatatgaatgagtaaatgaaataattatatttcaataaagctattaaaaatcgcaatgcaaggaaataaaagaaaacccaaatatacatattgagtaggtccattataaatctgggaaaatcaatctgtaaaataaactctgagatatatcctcataaaagtattaaattttatataaaagagaagaaatttcatgatcttaaggcaaaaagacctcacaaaggaaaaaaattcaggttgccatcagacattttgacagcaatgtacaaaacaaggcaaaagtagcattttcaagaaaactcgaggaaagattgagtgggaagcagttccctgtttgacagctgagttaagtgttggtgtattatatagccagtgaagtgctaggaaggtgtctggaaccaagggtccagcggttggaagcaaaagagtatatgaaacttttgggaattgcaaataattagcaattcagtttctgtaaagtgaagtggagaggctcataaggccttagatttcatcaagtagttcatttattcatttgtttacttaactgatgtttcttgagtgtgttagtattaagtgcctagtaatgcccagtcagttatatgttactgagagagagagagcattgtttatgatatctatataaagggaggaggagaggttaaagagactaggggaatgtgcatagaaattttcatttatgcatggaaatgtatggcatttacttgagtaattcttcagctattccaaacatcctctttcaaatgaaaatttgcatttcaaccttttcatcaacctagtattcaaagtgctgatggacaattaatctatgtaagaggcagagacaactgagccagttcatccatttgatcaacattgtacagttgtagggagatggctgtgtacaggaactgatcagatggatacaatttgagtgcataagtgcaaaaataggtgaaatgagaactattcttgagcatatattttgtgacatgagctgctttaggtactggggataccaaggcaaataagagctggtttctgcttttcagttgccctaaatctataaaatgctgattacatcacagggtgtaagtaaggtaagtaccaggtatggtgagaagaacagaattgttatctttatgtgtactgctgagtggtcatgccaagacttatcatagtgcttcatctgagtttagaattgcttgccttatagcgtatcttcctgcatacttttgtgttagttaggatgctctagttgtaagtaacagaaatcaacttgaataccttgagcaaagaaggtgaggttactaaaaggttaccagattatctcatggaatggacataaggaaaaggatgtagctggatcaatggaaagatgtggaaaatcagtaaacattcaggtgactcagtatcacttcacttatgcctgtttatgtttgtattggtgacattttcaaagcagttactgttcatggcctcattgagcctcaacataaataggtaagtagggcaggcatcattttctttatgtaagaggtaaggaaataatccaggaaaaggaaatgatttgtctaaggctacatcccaagttcagtggttaagtccagaatttagaatagcagtctctaactcttgggtttattctttacccattagttttcttcaaaactttgtctcactactatgcagtttttttccttcttcgaattctctcacctttttaatttttattttatcattcatttggtcttggaaattaaaggagtcgcctgtgtgtccttaataataggcttatttgagacatctctggcaactaatttatattctgtaacctgaacatgaaggggccaccaagaaaggagataattaaagagaggatgggagatctcagtcatctcagtgattttcttattatcatccatgaagtaccttaccagacatgggccattatagtttaaatgatgagttggagtttgaaaaggatttggaacttcatcagacactttccgagcttgtagcccattgttttccaaacttcaatttttcttccacaatgaacaataactttttgattaaacagctggcagttactattgaatgcctcacatttaataacaaaagtcttccttcagaacaggaaattttatctaaattgctttgctcttcttccatgattgtgaacttctaaagtctgacaggactgatagctggaaaaaataaaaatttctttcaagaagatgatgattgctttttaaaagaaagagccccaaactaaatgaataattcggtgtgcttgctacaaagcagaagtcaaggcacacaagttatcctctctgtaaacattattaaaaaacaatcaagtttgtattggcacatttatattgggaagattgtagacagcagctgagagaaagagtaaaaaaagcaccgcttggtagttagggaccttcttcactttttgtttttgttcttaatagaagtagctaccattattcagctaatactgtgctatgcccttaatatattaattaattagtactccaacctgaatcccttcctgccctcctgctagtacttccctttgactgaaaccaagtggaaccaaaaggagaggaacttttgatacaggtcagtctcctgtggcccaaagccaggcaaagaggggtggagagtgtatctggctgggacacatggagaatattcagctcgccttaattttataataaataaagtcatttgttttgctgttcatctgccctataatgcagtctctaagaggacagggatataatattattttcaaaataaatttactggtgtctgcctatatattatctatctatgtatctatctatctaatctatctaatctgtctattcatccatcatccaaacaactattattaatggtcatagtcaggagaactctttcatttctttataatgctttgcaaaatggtgggacactgcaggaatttttcttttatttgtactactttctcattttttttttattcatgtagaaaaacctctagaaactgtcctgcagaggaaaatcccctccctatgcctcttactttgcctcggagatgctttaagaagaggccctgctgggcgtggtggctcacacctgtaatcccagcactttgggaggccgaggcgggcagatcacgaggtcaggagatcaaaaccatcctggctaacatggtgaaaccccgtctctactaaaaatacaaaaagttatccgggcgtggtggcaggtgcctgtagtcccagctactcaggaggctgaggtgggagaatggcatgaacctgggaggcggagcttgcagtgagccaagatcgtgccactgcattccagcctgggcgacagagaaagactccgtctcaaaaaaaaaaaaaaaaaaaaaaaagaagaggcccaactacttccatcataggcttgcttggagctatatcctgtggctggggcaggagctcccagccaagcctgactctgctgctcaagggcagataataccaaatgagtcctctatcagagatttttttttttttttttttggagacatggtctcactctgttgcctaggctggagtgcagtggcacaatctgggctcactgtagcctcagcctccctgggctcaggtgattctcccgctcccacctcagcctcctgggttactgggaccacaggtacctgccaccgtgcctagctaatttttatatttcttgtagagatgatgttttgccatgttgctcaggctggtctagaattcctgggctcaagtgatctgcccaccttggcttcccaaagtgctgggcttacaggtatgagccacatggggccaggctggcacctataagtctgatttcgtgaggggcttatgaatttgtatttttgaaaagcttatgaggctatcctactgcctagtaaagtttgggaattgccaagagacctttggtggtttccaaagtcctgaaagagtcagaaagtcaaagaatactaatccctgcttgaatgtggagatgccagtgtttgaggtgtgtgtgtgtgtgtgtgtgtgtgtgtgtgtgtgtgtgtgtagtctatgctgtacaaagacttcatggagagggagcaaaataattcctgtgttccttaccataactgctagtccctgatatattttgtatgggttgtttgggaatggtcaatcatcaggcctttagagagacattcatttgctctgggaagctttaaactagtacatgaggatgtcacacatgctcactgaatgacagatggcttttggattcttacatattaatataacaagtagcagatagtggttggatcagaagaccttcaatgtcctttccaaccctgagagtcctggttaccaatgtctgttttatgtgagcagcaggcttttgatttattatcactggaaactaacacctaaatcttcatctaggtgaataataatatgggtttgcactaaattatcacccatttgtgagcatcagcaagtgttttggaggcagccagcctggggtataattgaacactaggagcagcacattttgctctgaacctctggaaaagatgggaccgacgactgtggccttgatgtaacctcaatggcgccatctagggagtgatttcacaggttaatgctcccctctcttcctataagattgtggcttttaagcacctcttttatagaaattgtgaagctaacactagatactatgttctaaccagttgagccaagtggcttcaatgaggtttttggtattttgtctgaaaatatttcaaactaaaatgtcttttagattattctgtgaagataaaggcattgatctcacctaaaaacattaataatgttctgtttgtgaaaagcattttagactttacaaagtacttttacagagcagatgatctgttttgtgcttacacggaaaatcctgtgtggtagatgttgttattaaaggtttacggatgaagaaacaaaggactcagagaggtttagtaacttgtcccaagtcacaaaacataaaagtaaaggtaagacacaaatgggaattttctggctctagtctgatgatctttccctggctgatgctgtttgtgtaacccactggttgaatatttgactttttttttttttttttgagacagggtctcactctgttgcccaggcagtccatcggtgcagtcacagctcaccgcagcctcgaccccccaggctcaagggatcttcctgtttcagcctccccagtagcttgggctacaggcacacaccaccatgcccagctaacttttttattttttgtagagatgtgggtcttcctatgttacccaggctggtcttgaactcctgggttcgagcaatcctccctccttggcctcccaaagtgctgggattgcaggcatgagccattgaacccggtctgagtttagactttttttttgagacagagtttccctcttgttgcccaggctggagtgcaatggcacgatcacggctcactgcaacctccgcctcctgggtttaagcgattctcctgcctcagactcccgagtagctgggattataggcacatgccaacacacccggctaatttttgtatttttagtagagtcgaggtttcatcatattgatcaggctggtcttgaactcctgacctcaggtgatccacccacctcagcctcccaaagtggtgggattacaggtatgagccacctcgcccggcctagactttttaatagcagaattaattgagggtttttagccagtgtggcatggcagaagtttacacctggatttgaatttagaattcaccatttactgaatagtatttagtcgagtcacttcatctctgtgaacatctgtcaattgagtatagcaatgcttgtcttttagggttattgaaaggattataaagtctgtaaacttttggcctataggaggtgctaactcaaaggcagctcttataaattttgagacagtgcctctccatctctctgagtttgaggctaattgtccttcatcatctgctgaaacacccttcagagactggaagttcactgccttccaggagtgccccttccctctgtatactatagttctgactgctagaaaattttctctatcttgagctcaaagtgcctccttatagcttccacctgttggtatcaattttccctcttggtgctgcacagagcaagttcaattcctcttctacacgatggtcttccaaatacttgaagaccttattatggcctccctaatctttacttcttcagacagaacatctctgttccttcaactgttcatcacttgatttgtctcacaatgccctcacaatcttttctgattccttctgaagtatgtctgtttattatctgagaagttcctagaactaaatgcgattatctctggacagattgactcagaataaaatgagataattactttcgtctcatggtacactttaagatcacaacatcctttttgacagctgatcttagctcgctgttgaccaaaaaggtgtttattttattttattttaatttttttaatatgtatttctgtttacccttagatctcacattctgtttttaagcagcatatttaccctaactttggacccttttcatttttccgtgtgaaatttcatctgatttggccctaattcctgcctattaatatctcttttaatcctgatagtgttgtgctaaatctgtcatgattgaaaccatcacaccagcttcaaattttccagcatgtttaagaagcctatattctagccaggtatagtagcatgcacctatagtcccagctacttgggaggctgaggtgggagaattgcttgaacccaagagtttgagaccctgtctctttgcatgcctatatcaaaacatctcatgtatcccgtggatatatacacctactaagtactcacaaaaattttaaaaaattaaaaataaacaatgaagcatactttctattattttgtcaaatcacagatacaaatactagtgaggacagtcttatatgatctggttatttgaccctggtacataatcacaatcatctcagaatgatatctggatcgtgaattttaagcagagagaagggttggtaagaagtagtgaaagagtgatattaaggacataaaatatggttaagaagaaaaagcacccttattatcattagagatccagatgaggagagaaaaagaaaacagtgaaattcagttgctgggcaagaaaaagcatgaacgtgacaagggtttcctaaggggatgaagcaggtcacacgcaggcttgatctctgagaagacctctctcctctctgtgaagggtgttgacaccctgctctcaaaccccctcccacagtgtttgctgatctcatttgaacacttctgacttctcatttatcacagcaaaggcatctccttgcagacttcaactgtgtgccttctcttttttgtttgcgtttgtatttacagacagttgttaaggaacctgctgagccttgttatagcccttcttcccatgctctatgtggatttagcttggaattcaatccttacctgttgggggcatactgtattcatccccatagtctctcttcccattacagtctgtgttttctgatataatgcctgaggtgcatttttcaattttgtcattttctgagtgtcatctggatttgttaaacagattggcaggaggagactacagagttcctctttgggccattcctttcatgtcctggtttcagccctgtgtgctgtgtgttccatgtgagcagttaattaacaacatccaggcagcctgatatggaattcaacagatagttcatcgccgggcacggtggctcatgcctgtaatcccagcactttgggaggccgaggcggtggatctcgaggtcaggagattgagaccatcctggctaacacggtgaaacccggtctctactaaaaatacaaaaaaattagctgggcgcagtggcgggtgcctgtagtcccagctacttgggaggctgaggcaggagaatggcgtgaacctggaaggcagagcttgcagagctgagatcgcgccactgcactacagcctgggggacagagggagactccatctcaaaaacaaaacaaaacaaaacaaacaaacaaaaaacccagatagctcatcagtgtacacaattggcaaaaccccctgtcacagtcagtaaactttgaggacctgctctgaagagtataacaacctatggactgaatgctgaatatttgttggtgtcagaaataatgctgatgacatcatgacttttgcttttctagtggggctcaagaaagttacaattctcacatttttcttatgaggctaagaggggaaagggtctgttatgtccccttagcataaggccaaaagaggggcttagcttcatgtgcaaggtcacccattaccatattgggcagggaaaaatggatgggaatgaacttatgttctgtataggaaaatttctccaaggagcaccttgatattcactaatgccagctaaaaggcagtaaagatgaggctctgtataactaaggaaggtcattccaacttttctcttcagcaagagcatgagagcttctcttcaattcttggcaaagcccaagataaatctcttcatttactgtctcatttgggcttcatattgtcttattgaacagtggcataatacatgtcaattcacatgatttacactggaaattcattcttttatataattaggaaaggtactgtggagtctcttcaaaaaccttcctttatccaggtaaataaaaatccagtatttcttcataagtagtgttgttgaaccaccacactgctttgtgtttagctctgagggttttatctattaatgagaaaatcaagttcttcacagaatatagactagtcttttaagcagacaatacacttgttagggagagtgttttaaaccaaagtcacaaattaagagaggttacaccttgggaagaaaattcctaatgtgagcccttgattcaatgattgactttgacaaggagtgtggcagttactctttgccttgtcctctcaagcaggttttacatttgactagatgtttaattttacatggtattatattagaaatgagacacttacactttaaaatattgatcgatactagtggcatgcaaaattcctataattctccccgtacagcttaataggtagcaccttgtaaaggctcaagtgaatacaaagcctgagactcatgtctaatgggaagtgggtgttcttcagcccaaagaaagggtaaatttttgatggttggagagtaaatgcgttgtttgcatctgatagcctataggaatgtgatacatttagactgattacaacataatcagattaagcagtaaatcatgtgcttttcaaaaaacatgccatttgggccgggcgcggtggctcacacctgtaatcccagcactttgggaggctgaggcgggtggatcatgaggtcaggagatcgagaccatcctggctaacacggtgaaaacccatctctactaaaaatacaaaaaattagctgggcatggtggcgggtgcctgtggtcccagctactcgggaggctgaggcaggaaatggtgtgaacccgtgaggtggagcttgcagtgagccgagatcgcggcactgcacttcagcctgggggacagagagagaccccgtctcaaaaaaaaaaaaaaaaaaaagatgccatttgatctaattaattttcaagttgtcgactgcttttcctgctctttctgaaatacatctctctgatttctctgttagtgagttgtctgcctgatagattcaaattttctatctctatctcttttccgggtgagagacagtgagaggagtttatcttgttctttctttggtgcttcttgtataaatctcaaaaggtattgatggtggaggagaacacttgaaaagggttattacatttcactcatctttattgacttcatggatctcatgattatcagcataatgtaaagtgtcacatttgactatttttctcagtcaggattattaatttttgcaaattgctcatcataaagctttgccatagtaggacttttatagctatctgactgtagttctcctgttctgaatacagtcagggaactttcattcatttattcattcagtatctgaatttggctaggttctcttccagatagtagaaatgctgacttgaaaaagacagacgaggctccttatcttaaggtgcttacagtgtgctgggtaaaacaagctaagtgatggagactgaccaggtggttaggagttactttatatagggtgcttagggagggtgtctagtgcaggagatatctaagcaggtacaggaatgctgtggtcagtgttccatttcctccagacccggaagataattggtggtagcagcagtcaggaagtacacacacaacttcaggatggatatgatgggcccaagggtactaggaaagctatttcctccttccttagccaggtgatctaggaaggcaggcccagccactaccagagtcttgaagacccctgtgggtcatggaagctaccgtgtcacatgctgaagagctgaggaatgcgtctgaatggatcgtccaaatggggaggttctgagagaccaggaaataaccaacatatagggtggttagaatgtataaaaataatatataaagaaagaatgtataatgtaagggtagtcctggatgagaacttaaaaatagggcctctgcttactgctgttttcattttcccagaaacattcttcataaattggctaaatccaattaaatgtcccaaattgactagggaaaatgcttactaccggactgggtgaaagtgttaagagtagtgtgctgccgtattttactcagaaaagctaactgatggccaggtgtgtgtgtgggtgtcaggtggggcgggggtttggtgatagtgtgtttaagcacacaatcttataaaatgtttcttccatctcttcctgttgcctgagcctatttccaatcttatgtgagtttatgattaactttccacaaaaataaaacttttataaatgtcaaagaattacatttttggaagaatgtaaaagaaataagatatttacttagaattttgagtaatttacatagaaaagtttacgatttatggccaaaaagagttaaagaaagctgaaaaaaatgatactttaaaacaacaataataaaaatactgaagttttaggattcatagaaagtatactttatcgaaaaattctgttttaatgcaaagtttagtatctaaatagatcatcagttttctccataatatcagattaaacagcaacagaaatgaatttttttttctgttacatattagcttgttctagctttaaagtttataaagggaaaaaagaaacctaagacttaaattttgataattgtcgaaatgtatggcaaaaatagacaatgagttcttgcattgtaacattgaaatatcaaacccttaaattccctgtcacagtgatgtcatttcttttaactgtaaattcaaagcataagtaagcatctaagatattgagacttcccatctcagtgggtccatttggtgagagctacagcaagtaggctggactgggtcacatgacctgtgcagctccacattcttaggtacccatgagacttacacaatgtcagcacagactaagtgccaagggcatgtaatgtattttgtttaatcctcatgacaatccatacagttaacagtaatatccttatgttttaaatgaggaaattgaaatacagagaaattaaattacttgattaaagtcatgcatttagtagactgcggaactgcgatacgaacccaaacatgtttaatcccaaatttatgttgtttttgctacaccacactatctaagatacttcttggctttgtgggcgtgaaaaaggcaacagtaacctttctgtttttcagtgcggtatattttttagggtaaattatactagtcacaacttcagaatatcctctccatctcagtggcttaaaatagctgaattttatttctcatttaaatagagtccagttgggtgtgtctagctgacaagtggcctttgatgtcatcctttagggattcaagattctcggtcttgtagctctgtccaccccttagccctcagagttttctccaggcagctgaaagggagaaagagaaaagagataaagggaaagagacagcatggaagatacctgagggagtttttaaattatttttcggtggggtggaggggcaggcttagaagtggggcacaacctttccacttccattccatagccacactcaacttcaagggaggctgggaagtgtagtaaagctgtgaatctgggaggaaaacaaagtgggttccaggagagctgaccagtcttgccttcaagctttgatacatgaacttgtttccccttttccttctgataagtaagcctagttaggaattttactttatttgaatgagttaggttttcacgttgctctattaggaaataaagaacctgtctgtgacagcaggacatcccaggatatattaatcatgtcctcttttgttcagtgttgatttaaaagttctaccaaattatttactgtttttgttttcctgtattttaactctttgataaatagtagcttggatggggcttttgtggctgaaactgcccttcattgcttgtctagagaggcagtagggcaaggtggtcaatagtacagactataggatctgatttcaaatcccagcggtgtcactcacaagctgcttaaccaaggacgagttatttgaccttgctaagccaagaacacccacctgagggtgttgttatgaggatttagtaaattaacatatagaagccctcaatacacaatgtcggcacacattaagtgttgtataagtgctggctgttatgtctgctctttcagctccactttattcttcattcaaaactcagtgtagtgtctcctttggaaagttttctctgactatggcaggcagaattctgttttgttttttttttccctttctgcttccaggaaacattgaatttaatgcattgaattataaggtgtgtccatgcatgtgtctgtctcaggcattagatctaaagacaagaaattggccattctaaatttgcctgtatgtatccccatagccagcacagcacagcacagtgtcatacacattgcaggcaatcagctatttgctgatgtgaaggaaacctcgttaaccagagtaccctatatatcagaaagctcagtttccttaccacactggagagcaaggagttcactatattagctgtgactttcattttagttgacttgggtgacgccagatttaagtgacagatcactgtgccctacctgcctttttacatgatccagtccacccaaactgtccctcagggaccagcagcctttgtgctaagattctgattttactttggctggcatgtatagctccccttctataggggtacgtgtaggaatgtgataattcaatttcttagtttgtgttatcagcattagtctgtgccgtgcacatttcttgtttcattcattcacttttttcttgcctcaccattcccaccaggcctgtgataggaaaattctgtgcgtatccttagctaatcgataacattgttttgcatgtgtgaatttttagtttacatacattatggaccttgttggttttttctctattttttaaactgttaatgttaatataactttaagctcacagaaaacttataggagtgatacaaggaacaatcatatttgcccagattctgcattatttggaaggaagagaaagcgtgtattcatagatgtgtatacttatatatacaaacagtattgttattttgaaccctttgagagttaagttgtaaacatcatgaccctctacccctaaatacttcagtgcctatttcctaagaacaagactttcacttaagtatatactgcccagttagcaaaatcaggaaattgagtatcaataaaatactattacataatttacagatcttattcaaattttcccaattttcccaataatgtcctttatgggattatttccccctgccctagcatctaatccaggatcccatcttgcgtatagcttttatgtctttttaaagtctctcttttaatctccaactgttgttcagcctttctttatttttcatgacattgacattttaaagaccacaagcagttattttgtggactgtctttcaattgaggtttatctgatgtttcttcatgattagatttcctcctccctcctcagcaagttttctttttaaaaaaaatactgtttttaaactctcttcatgttgatacatctgtatccagtttgttgattccacctgctgcacagaattccctaatgcagactgcctcttggaacagatttggcagggctgccaggaaggcagcatccggcagagcttccttggcatcaggatggtgtctttgtgggggctgtatgacatgggaaatgagaacaccactttgacacatgtgccctgggtcaccctgctttagctggtgatagtgggcctcagatgtttgcttcttcaactatttctaaggcacacggagctattatgctttgcaagataaggtaggataggaagttaatctctttgattgttttttccttcattaattcatgcatttaataaatattgattaagggcctactctgctcattggagcttatcttctagcctattgaatacataaaataaacttttgaatcgaaagctcgtctaactgtgacagaggcaaagttgttaaaattgagcttaaggtaaatggttcaacattttcaatttattagtaaaatagccttatagaaatcatgcttctgcctcgtcacccaaatacagtgatttccatttctccctggcctcttttggtatttaccaacattgaacatcatttgtgcctcattatctctatagggcataaataattttgcattcccttttttccagtgaaaaatattttgtatatactttcccttgtttcataacttgcatattcatcacacttaatgactgtagtaaattctttcaagctgatctataacttatgcatatctcttaagttgtaaatttgccttgtgtctagtttttccactaatgttaggagaaaaaattttaaaggaagtgtgtatcatgctcctgtgttaaggcagttttgacaaatagtttcgtctaaaatcgttcattctaagatacaaaaaaggttagattcctgtaaagaaaacacattctgtcttctttttaggaaaacttattttttcctgattatgttttgagtgtccacttataatggaaggataattagtagagaaagacctgatgtgcttggagctttgccagctgaaaaccttgcatgtattaggaaacagcaggtttccagtggggaatagtagagtaatggactgtgcagctaagatataagactgcagcgcgacagctcccaactgcagcaggctcaccatcactcactttccttgacacaagtggacagtctttcagttcttctgcactttccttgtgagaaccaccggaggaatacatcgccctctggcaggaggcagtcagctccatcacagcagggaggagtgatgagctgtccgtacctctggacacacctaggaatgattccgcagccgttgctcagtcctcagcgaggactcaggaaagcaagaaatggacatagttctcgtttacagatcactgtgtttcatcccacccagaatcttctgagcatccaatgctgagaggtacttgcccggggtgaggttggaagctcgtgatcagtgggtggttgcagggactatttctaaagagggcacgaataaaaagatttgggaccaactaaccggaccttggtaggatggaataactgagacattaattgttcggtaggctctgctagaaacttcaaagatcctaggtagggctctgacatcttctgtattagttatgtgcctgtatggatcagatgaggattttcttcatatatagaatttttatcttacttttcctccatgagagtgggaccttgtgtgtctggtttcttgctctattttctgttgcttagtgtggagcttagagcataaaaagtgttcaataaatatttgttggttggacgatgacttaagctgtgtagttctgtagactaaaaacatgatcatctaggcagctgcaatctacttgtttaaagggttctctcaggttactgcagaaatgagtaggacctaaagaaaccgaagtcggagaatagcagggtgcaaaggaaagtacagtggctttagagccaggcagataagagttcttatcccaactctactactcactgctgtcttcacttggttaactcatttatgattcctaaatctgagctttcgcacctataacatgcgtatcaaaccactttccccacagagtttgtgggcagttcattgctcagagtggacactcaaaaatgtcaccttcttcctccctcccctgccaaaagggagacaaaagcaggaggggcccagatgatgtgtccaagtgttagatctctacattcatgttatctgtcatgtaaagtgtgccacatattggcttctcttcatacagcagctaatggcatgcatacttcaaacagcatatgcaccttttggttctgctttgagcctctctattagtaactgtgttctttgcctttacaggatttatgagcgtgtgatagaccctccagataccaaccttcccccaggaatcaatttatggcttggccagcgcaaccaaaagcatggcttattcaaagtaagcactaacgttctttttattgaagtatatatataggcgatgctcagttttctgtgttatttattggagccgtgtttataattacattagtgggaagggcatggcataatagctactaatgtttattgaacacttactttgtgacacatgcttttttatgtgcttgacatgaataaactggtttacttgtcacagtaatttgtgaagtaggtgctttgaaaccaggcagagagttaagtgacttgcccaaggttatccagttcactctgctgccagggatggatgatccagaaggcaaatgatcctcaaaatgttgacctcccaattctgaaggatttacgataatcttcaaactggtttcccttctcagattatatgttaattcagtttagagtagatgtctagatatgaaaaatacatctctgcttccttgagctttggtttaattgcattactgggaacagaaaaccaaatactgcatattctcacttataagtgggagctaaacactgaatacacatggacacaaagatgggagcagtagacactgtggactactagaggtgggagggagagagggagccatgggctgaaaaactatttggtaccatgctcactacctgagtgactggaccatccatagcctaaacctcaacatcatgcagtatacccatgtaacaaacctgcgtgtgtaccccctacatccaaaattttttttaaaaaaactgcattattatacttcacagaaacataaggatacagtgataaaataaatttaaaaacttaaaaataccatgaaattttaagacagtcttgttctttgaaagaatgacacacttttgcttctggcaatatggcagactagatattctaaaaatccttctgcttcaaaatgactataatgctcgataaaataccacaaaaatattttaaaattcagcattgtacttatacgaaaggaattccttggggaccaaatatatggaggggagagaaagccagaggggtatcagtaccagaacttagagccttaggttccttcttttttatttttaaaaaattaaggtgtaattccgcatgttctcactcacaggtgggagttgaacaatgagaacacatggacacagggtggggaacatcatacactggggctgggagagagatagcattaggagaaataactaatgtaaatgacgggttgatgggtgcagcaaaccaacatggcacatgtataccaaggtaacaaacctgcacgttgtgcacatgtaccctagaacttaaagtataataaaataataccaaaaaaaagtaagatgtaatttacatacaggaaaattcattccatttaatgtacagtgtcacaagttttggaaaatctacactgtattataatcatcattgtaattgagataaagaaccatttctttatctccaaaaatttccatccccctttgtattaaacccttctcctcacccgaagcctttagcaaccactggtctgttttctgaccctgtagttttgtctttaccagaatgttatataaatggaatcatttatgtgtgtgtgtgtatttacataagtttctatgttgagattcaccaagttgttgtgtgtatcagtggttcattgttttctattgctgagtagtattccagttctgttgtatgaatgtatcatattttgtttgtccattcttcagttgatggacatctgggttatttccagtttggaacaattatgaatagaaccactataaacatttgcatacaggtttttgtgtgaacagcggttttgatttcacttaggtaagtgtgtaggtgtgggcttactgggttgtatattaagtgtatgtttaaattcacaggcaactgctaaaccatttttcaaagcagctgtgccagtttttgcattcccaccagcaatctatgaaaatttcagttagagctttaaatttcaaccgtctgtgtgggatgggagaaattacttagatcccatgcgtgactgagtgttggaatggaaatttttaaggtaaagccagtccactatctagcagaaggaggcaatccagaaactatcctgtctgcatctcatctccagatgagaaaaaataatacttcccagagaactagtaaaccacagcacttgaagggttgcagacttgacacccagatttactttacccatgaagctcaataaagtatattaaagtggccctggattaggtaccttgggagtcctgatgaagaaaatacaaattatctttggagaaagtcacttttgatgtagacctcaaaggatgcccacagattaagtccataaaataggagctctaaagccatcacgaatgacagtggaaagaaacaaaaaaatgctcagttagtcctcacagggctacagaaaatgaaattagcaggtaaagaatttttttttaattttttaaaaaacttctgtttaaaatgtttgaagaatcaaaataataaagaatgtatgatgactagagataataaataggcccagagatagttgaactaaaaagcacttccaaaaatgaaagatacagttgttgaagttaaaaaagaaacaaaaaccaaaaacctcagtgaacctgctaaacagattagacacaggtaggaagagcatttgtgaaatggaaaatattgttaaaataattaaactaatagtagtgcttcagagataaagagaagaaaataggaaggaggttaaaatatagaacagatacatgtatataaaaaaagtttacgtatctgtttaatatgtgtgaatatgtatgcatatctatataaaatggctgttctgatgcctctatgttttctaagtggcttcttagatagctgagatagatagcttcttagatatgtatattattataatatacatatatttaaaaattaaggaagataataaagaatatattatgtctatatatgcatatatatttgaaaattccagatagtaaacagagataaaggttatgggcactattataagtataacgggtaagaattttctaaacttaataaaagacattaattctcattactgaaagaacaatgaaataaaagtatatgttgttgatttcacatagaaatcatagaaaacatagaggcatcagaacagccattttatttagctcaaaaaccaatttttttctgctttgacctggctaagctgatacttgttaggctgtctcccatgtctgtggttaattggcatgctagcaggtggcaggatgatctgagagcctcttcacctctctgggggttggctggctgttgactcttgttcctcagttgtcctcacatggtctctcatctccaatggcctagctcagcttatttacatgtcatccctgggattccaagtatcggaagagtgcaatccctaaagtactaatattttcaaggctttgtttgcttgatcacatttgctaatgttttattgcccaaagcaagtcatatggccaactccagagtcaaaatgtaaataaatagacttcatctcttgaagggctgctccatgatatcacattgcaaggatatggatgcaaggagggaagaattttttttggccacatcagcaacctattatacaaatcaagataaatagacagccacacttagatatactggcagaatagcagaactccaaagacacagagaagatcttaaaaatagccagtgacaaaacacaaatttttcacaaaaggataacaaactgaacagctggtttttaaacagtaaaagcagaagtcaaaagacagtagaaaaagtgttttccaagttttgagagaaaataactttcaaatgtagtagtatataccaagcttaattgtcatttgagaatgagtgtgacataaagacattagtagagaaatgaaactctcagtttataaccaatagatcttcatttaaaaaacttcctggaaggaagacatacagtgcaagaagaattggagagcaaatgcatgttgacagtatgcacaaatctcagtgattattattctgaatgattgccattatccttgtttgattaaaatataataatgcttaattttagaaaaataatattaaaaatattgacaatggaatccttcaccatcaaccaaaatatccgggttctgtcatcaaaattgactagaaggctggcgtgactcatggagagaaggaggaacagtgcggtgcgacggcccatctgagagccacacgggaaaggggagccccctccctgcagccaagggaggcagatttccagtaactccagccggagactcagggacagaattcggatttccctgggcctgagcccctagcgggagaggtggccacagtctgtgtggaccagcagacttagcctcttgtcttggtaattctgaagaatccgggcagtctagacgagtaggtttccccccagcaaagcacacccgctccaccaatggccaaaatgcctcattaaacaggtcctgctccctgtgccacccaactgagtgagaccctccaacaggggttgtcaagcaccctatacaggagcaatcctactggcatcagtttggtgtcgttcgaggtcagaggtcccagaaggagcaggaatccaactctgctgttctccagcctccttaagtgacatctccaggcatgggagtgaagcaggtgaacagggcctgaagtgaatccccagcaaactgcagcagccctacagaagagagacctgactattgaaataaagacaagcagaaagtaacagcaacagcatcatcaatgacaacaaaaggcccccacaaaaaccccatccaaaggtcagcagcctcaaagactgaaactagacaaactcacgaagatgagaaagaatcaatgaaaaaattctgaaaacccaaaaggccagagtgcctcttctccaaatgatttcaatgtctctccatcaagggcacagaactggatggaggatcagatggacaaattgacagaagcaggcttcagaaggtgggtaataacaaactcctctgagttaaaggagcatgttctaacccaatgcaaggaagctaagaaccttgataagaggttaaaggaattgctaaccagaataaccagcttagagaggaatatgaacaacgtgatggaactgaaaaacatggcagaagaactttgtgaagcatacacaagtatcaatagctgaattgaccaagcagaaaaaaggacattagagtttgaagaccaccttactgaaaaaagatgcagaaaagaataaagaaaagagaatgaaaaggaatgaacaaagcctccaagaaatatgggacttcataaaaagaccgaacctaccattgactggagtaccagaaggagacagggagaatggaaacgagctggaaaacacacttcaggatattatccaggagaacctccccatcctagcaagacaggccaacatgcaaattcaggaaatacaaagaacaccattaagatactctacgagaagatcaaccccaagacacatgatcatcagcttcacgaaggttgaaatgaaggaaaaaaactgttaagggcagccagagagaaagaccaagtcacctacaaagggaagcccatcagactaacagtggacctcttagcagaaactctgtaagccagaagagattgggggccaatattcaacattcttaaagaaaagaattttcaacccagaatttcatatccagccaaagtaaacttcataagagaatgagaaataaaattctttccagacaagcaaatgctgagggattttgttaccaccaggcctgccctgcaagagctgctgaaagaaacaataaatatggaaaggaaaaactggtaccagccactgcaaaaacacaccaaaatataaagaccaatgacactacaaagaaactgcatcaactagtgtgcaaaataaccaaataacatcatgatgacaggatcaaattcacacataacaatactaaccttaaatgtaaatgggctaagtgccccaattaaaagacacagactggcaaattggataaggagtcaagaccaatcggtatgctgtattcaggagatccatcttacatgcaaagacacacacaggctcaaaataaagggatggaggaaaatttaccaagcaaatggaaggcaaaaaaaggcaggggttggaatcctagtctctgacaaaacagactttaaaccgacaaagataaaaaaagacaaagaagggcattacataatggtaaagggatcaattcaacaagaagagataactatcctaaatacatatatgcacccaatacaggagcacccagattcataaagcaagttcttagagacctacaaagagacttagactcccacataataatagtgagagactttaacaccccactgtcaatattagacagatcaacgagacagaaaattaacaaggatattcaggacttgaactccgctttgcatcaagtggacctagtagatgtctacagaactctccaccccaaatcaacagaatatacattcttctcagtgccacatgactcttattctaaaatcaaccacataattggacataaaacactcctcagcaaatgcaaaagaactgaaatcataacaaaccgtctctcagatcacggtgcgatcaaattagaactcaggattaagaaactcgctcaaaaccgcacaatttcatgaaatctgaacaatgtgctcctgaattactcctgagtaaataatgaaattaaggcagaaatcaagaagttctttgaaaccaatgagaacaaagagacaatgtaccagaactgattatcagagaaatgcaaaccaaaaccacaatgagataccatctcataccagtcggaatggtgattattaaaaaggcaagaaacaatagatcctatgtgaggctgtggagaaataggaatccttttacactgttggtgggaatgcaaattagttcaaccattgtggacgatagtatggtgattccttaaggatctatgaccggaaacaccatttgacccagcagttccattactgagtgtatacacaaaggaatataaatcattctactgtgaagacacatgcggccgggcgcagtggctcaggccagacacggtggctcacacctgtaatcccagcactttgggaggccgaggtgggtggatcatgaggtcaggagttcaagaccagcctgaccaacatggtgaaaccctgtctctactaaaaatacaaaacttagccgggtgtggcggcacgcgccagtaatctcagctacttgggaggctgagacaggagaatcgcttgaacccatgaggtggaggttgcagtgagctgagattgtgccattgtactccagcctgggtgacagagagagactgtgtctcaaaaaaaaaaaaaaaaaaacagacacatgtacatgtatgtttattgcagcactattcacaatagcaaagacgtggaactaacccaaatgctcatcaatgttagactaaagaaaatgtggtacataaacaccatggcatactacacagccatgaaaaggaatgagatcatgtcctttgcagagacatgggtgaagctggaagccatcatcctcagcaaaccaacacaggaacagaaaaccaaacactgcatgttcttactcataagtgggagtttaacattaagaacacatggatacagagaggggaacaacataccccagggcctgttggggggtgaggggtgaggggagggaatttagaggatggatcaatgggtgcagcgaaccaccatgacacatgtcctatgtcacaaacctgcacactctgcacatgtatcccgtgtttttttttttaataaataaaaaaataattaaaattaaaattaaaaaaatattgacagcaataaaatgttagtaaaggtgatctgatttaaagtgttctaaggcctgatttcaagtgttctaagtggtcagaaaaagaatggagaaactgattaactttagactttaagtctacatgttagaattaaaacaatatcaaaataatagaaatcatgtttaactcccaaactctgacatttaagtataagagaaaaggggattttttttaagcctcatcaacccaaaataaggtaagaagagaaatatttaatataagataccatatataattccatttcacaattgttattatcaatttaagtgatttacacttagaatgaaaaataagagtattatattgaattcataaaacccaaagcctgttgtatattgcttacagtgaaacaataaaaaataaggactcataaatgttgatagtgaggtagttaaaaaaaaaaaaaaaagaaaaataggccaaactaaacatgagaaggctggagaaactgctgatttcaaactgcaaggccaaaaaggtcaccacataataataagctattttaaagatgtatgtactgaataacataatctcaaactgtatgttgtagcctggcagaatagcaggcatggatggcctactcactacagtgtgctgggtcaactgaatatccccatggggaaagcactaatcctgaccctgtttcacacaactgataatgcaaaatcaattccaagtgggctatagatcaaaaagttaaactgacaaagcttataaaagataatgtaggagaatactttatgacctcgatgtaggaaaaatactttttaaataagatgtaagaaataataactataaaggaaaagactgatccattggaatatattaaaatttggaacttttctcatcaaaatagatgactaagagagtaaaaaggcatgtcaaggaataggaggagctattcaaagtagttgtgtcccacaaaggccttttatccaagctgtataaaggacccctttacatcaataatgaaaagtctatccaataaaaacatttgagaaaaatgctaccaggcacttcacaaaagggaatgtccaaaaggccagtaaacaaaggggatggtatcaatatgattagtcatcagggaaagtaaagccatactgagatgctactgaatatccatcagaatgggtcaaattaaaaacacagaccataccatgtatttgcaaggatgtggaacaactggagccttcattcactgctggtgggaatgaaattgatttaagtactaaggaaagctgtttgttagtatggttaataaaatggacatatatatgtcctatgaccaagaaagaatactctaggtacctaatgtctaatagagatatgcatttgtatacactaaaaggcatgcacagaatttttaagatttgcataaatttgtggggtacatgtaaatgttgttatatgtatataacgtatagtgatcaagtcaacgtatttagggtgtccattgcctgagtataatacatttttgttaagtatagtcaacctactctgctatcaaacattgaaattattccctctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaagaaattattccttctgtcctactgtgtatatgtaccctttaaccagcttctcttcatccttgctccatgtaccccattcacccttcccagtctctgttatctgtctttccgctctctatctttccactctctagctgtgtattcaaattttttagctcccacatataagtgagaacatgtgatatttgcctttttttttttttttttttgagacggagtctcgctctgttgcccaggctggagtgcagtggcgcgatcttggctcactgcaacctccgcccctccaggtttaagcatttctctgcctcagcctctggaggagctgggattacaggtgtgtgccaccatgcccggctaatttttttgtatttttagtagagacggggtttcactgtcttggccaggctggtcttgaactcctgacctcgtgatccacccacctcggcctcccaaagtgctgggattacaggcctgagccactgcgcctggccagatacttgccttttttatgcctggcttatttcacttaagataatgacctccagttccatccgtgttgctgcaaatgacatgagttcattttctttttttggctgaatagtatttcattgtgtatataggccacattttcttttttttaaattctatgatttggtgtttattttttatatttttaaaaaaatttcactagtttttggggcacaggtggttttttgttacatagataaattctttagtggtgatttgtgagatttttggtgcactcatcacccgagtggtgtacacagtacccaacatgtagtcttttatccctcaccctctctcaccctttcacctaagtccccaggatcccttctgtcattcttatacctttgtgccctcatagcttagctcccacttataagtgagaacatacaatatttggttttccattcctgagttgcttcacttagaataatggtctccagtttcattcaggttgctgtgaatgccattatttcatttccttttatggctgagtagtatttatatatacatgccacaatttctttatccattcattggttgatggacatttaggctggttccgtgtctttgcaattgagaattgtgctgctataaccgtgtgtatgtctttttcatataatgacttcttttcttcttggtagatacccagtagtgggattgctggatcaaatggtatttccacttttggttctttaaagaatctccatactgttttccataggggttaatagtttacattcacaccagcagtgtaaaagtgttccctttttagtcaaattgtccctgtttgcagacgacatgattgtatatctagaaaaccccatcatctcagcccagaatctccttaagctgataaacaacttcagcaaagtctcaggatacaaaatcagtgtgcagaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatattgcccaaggtaatttatagattcagtgccatccccatcaagctaccaatgcctttcttcacagaattggaaaaaactactttaaagttcctatggaactaaaaaagagcccgcattgccaagtcaatcctaagccaaaagaccaaagctggaggcatcatgctacctgacttcaaactatactacaaagctacagtaaccaaaacagcatggtactgttaccaaaacagagatatagactaatggaacagaacagagccctcagaaataatgccacatatctacaactatctgatttttgacaaacctgacaaaaataagaaatggggaaaggattccctatttaataaatggtgctgggaaaactggctagccatatgtagaaagctgaaactggatcccttccttacaccttatacaaaaattaattcaagatggattaaatatttaaatgttagacctaaaaccataaaaaccctagaagaaaacctaggcaataccattcaggaaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggaaacctacagaatgggagaaaatttttgcaatctactcatctgacaaagggctaatatccagaatctacaatgaactcaaacaaatttacaagaaaaaaacaaacaaccccatcaacaagtgggcaaagtatatggatagacacttcttaaaagaagacatttatgcagccaaaagacacatgaaaaaatgctcatcatccctggccatcagagaaatgcaaatcaaaaccacaatgagataccatctcacaccagttagtatggcgatcattaaaaagtcaggaaacaacacaggtgctggagaggatgtgtagaaatgggaacacttttacactgttggtgggaccgtaaactagttcagccattgtgaaagtcagtgtggtgattcctcagggatctagaactagaaataccatttgacccagccatcccattactgggtatatacccaaaggattataaatcatgctattataaaggcacatgcacacatatgtttatcgcagcactattcacaatagcaaagacttggaaccaccccaaatgtccaacaatgatagactggattaagaaaacgtggcacatatacaccgtggaataccatgcagccataaaaaaggatgagttcatgtcctttgtagggacatggatgaagctggaaaccatcattctcagtaaactattgcgaggacaaaaaaccaaacactgcatgttctcactcataagggggaattgaacaatgacaacacatggacacaggaaggggaatatcacacaccagggcctgtcatggggtggggggaagggggagggatagcattaggagatatacctaatgttaaatgatgagttactgggtacagcacaccaacatggcacatatatatatatgtaacaaacctgcacattgtgcacatgtaccctaaaacttaaagtataataaaaaaaaaagtgttctcttttcaccacatccacgtcaacatctattttttttttttttaaattatgaccattcttgcaggactaagatgctatttcactgtggttttaatttgcatttccctgataattagtgatgtgagtattttttcatatgtttgtttaccatttgtatatatcacattttctttattcattcattcattgatgaacacttagggtgattccatatttttgctttcacaagtaaataatatttgctttcacaaatctataaataaaactagggaagtctcctagttttatttacagatctaggtggcacttgcacagtgtttatgtcaagttaattcatcaatatgtacttttatgatttgtgtaactatctgtatatatgttattctttaataaaaatgtttactaaacatatatgcatagtaggtaattagagggaaaatggatacatttgccatcatactgagtgatatttaacatacttctcgcaataacttatagatcaagctagcagaaaagttagtaagcgtatggatttaaacatacttaacaagtttaatggctatatatatatacacacacacatacacactctaccaacaatgaacacatctagcacatggaatctttgtgaaaattaactacataaaagtccataaaaaggaaatctccacaaattacaaaaaatgatacatagaccatattctctgatgacagtgcagttacgttagaaataaatagtgaaaagataactaacctcccacctttgtatgtttggcaatataaacagtatcatttaaagtaactaatcagtctgggggaaaataatagtataagttaataactaactcagaaagataataaatatcacaatttgtgagatgcagctaaagcaattcttagcagtatttatctttaaatgcttgtattggaaaaggtagatatttaatgagttaaacatccaaatagggaagttagaaaaagaacaacagaatgtatacaaagaaagtaaaaggaatgaaatagtaagcatgaaatcgtaagaacagaaattcataaaataatgagtagggtataataggcaagatcaagaaagccaaaatttgatcatttgaaaatacactgggaagtttgagcaagaagaaaatgagagaaggcataaatatattagaaataaaaaaagcatataacaataaatgctgcaaaaattaaaacagtagtaaccatttgttaacaactttatgccaataaaatggaaaattagagaaaaatggacagttttctaaagctacatgaatcgccaaaatggacttcaaataactatggtagtcttagcttcattaaagtgatgagtttatgattgaaagtctattgtaccagttagcttttgatatacagcaaatcaaaacaaagcttaatggcttaaaacaacagcctttatttacctcacaattttgtgcattagcaatttgagctgggcttactttgctggattttattctccatgggttcatttgtgcatctttgatcagctgctggggtttctggggcctagttgtactaggccttgaatggccttagctggtatggctcatctctgcttcatgtggcctctcgatttccagaagtctagcccaaactagtttacatgatcatggaataaagtttcaagagtcagagcagaaatgtgcatggccttttgaggcctaggcttgaaacttgcactagattactttgcttcattatattggccaaagcaagttacaagcccagcttagattcaagtgtactggaaatagatttgaccttttgatgggatatgctacaaattcacattgcacaaggtatggacacagtgaggagcaaaggactgggatcattctggcagtctaccatgtccctccaccaaataaccacgaggctcacacagttttacaggggagttgtagcacacatccaaggaaataattccaatcttaaataaactcttccagagaggagaataaatgagaataccactcatctaattttatgagcataggtcaccttgatttgcagagtagacaaggaccgtatgagaagggaattgcttaagccaatttacttttgaacagattagattaaaaaatttaaacaaaatattattagcaacctgtttattagcagagtgtatgtatgcgtgtgtgtctgggtgtgtgagagagaacaagttgattatttcaatagtgaaaatttgtttttatcttcagaaaatttcttaatgaaattgactacattaaaggagaaaaaaatccaatggtcttctcaagaggcagaaaaggcactagaagaaattcaatactgactcattaaaaattcttagcaaactagaaatagaaggaaacttcattaaattgataaaagtacatgaagtaaacatacatcaaatatcatacttacggtttaaatattaagagaattcctgttaaaatcaggaaccacacaagaatgactattatcagtgtttctattcaacattgtactggaggttcttaccagcaaaataagtaaaaatcttaaggattataatttaaaaagtagttattaacttatatattgcctatatataaaaaatgatcaccaaattattagaattagcaagagagttcagaaagagtactagatgtaaagccaaagataagatcaattgcattgctgagcaaaagcagcacagtggcagctgcaacagcaataacaaaaactgcaattaaatattttatttataatatcaaaaggtgaatcaaataggaacaaatcaaataaaatatatacatgacacctataaagaaaattatgaaattttatgaaaaaccactgaagacctaactggggagaagtacgctatgttcttggagaagaaggcttaaaataataaaaacgtctgcttcttccacattgctctctagggtcaatgaacttgtaatcagttcccaagaggatttttttttttttcctgatggactctgacaagctgatgctaaaatttttagggaagaccagaggccaagaataactaagacattttctgagggagaaaaaggaagggacttagccatccagatgtgaaggcttattgtaaagttatagcaatcagcagagtgtgatatcactgcattaatcagcacatgaaccaagagatcagaatggagaggccagaaatgaccctttcgtcatgtgtggaaacttggaaacttgacacataactgatgtggcattcctgaccaatgaggaaaggatggattcatcaatacatggttaggaaaatcagttatttaaaaacattatatatatattatagacacagacattgagtgatgtaattgatttttgtgtacagtataaggaaaagcttcaaatatatacctggaccccatacataaaaatcacttacaagtacaattgaattaaatacctaactgaaagctcaatgttgaaaggtttagaagacaacataagaacatatcttcacgatctcagtcaggatagagaagttcttagacaagataaaaaaatgcacaagtccttaaagaaaatactgatgggtttactgcataaaattctaaaaagtgtgacaatacatcaaggaagatcttgacaacaattagcaaaaaaaaagtattcattgaagaaatgctgcaaatcaataagaaaccttttttttttaactcaataggaagtcagacaaaagatatagaaggatggttttccaaagtagaaaacataaataaccagtgaacatattgaaagtaattcaagttcactagttatcttggaaatgcaaattaaaaccattatgaaaaaccatttcttcacccattagcctggcaaaagtgaaaaaccatctgacaatgctatgtgtaggggaagtcattgagcaatggattcttacccattgtgttggaaacttgaattggtggaaccaatagagagggaaatttggggatccttgtaatgtgcatacatttggacataggagcccaactctttggtataaacgttgaagaaactcttggtcatatacccaggtatatatgtataagcatcatcacaggacttttttttttgttttggtaatttcaaaaacttggaaaaaacctaattgtccatcaataggagaatgtttaaatacgttgtagtagagacatagaaacataaaaatcagtgaaattgaacaaaaattgatgaattgctaaagtaattttaaatgaaaaagctagcagaaggataaaattacagtattaaatcatgtatatatttcaaaatgcaagataattccatatacagcttattgatacatccatatatatacaaagaaaaatgcatagaagtgataaacactaaatttagaatagtttacttctgagaggaggaaatgggagttttattagggttgtgaacccagaagacttcaactatattgaggatattttatttctcaagtgtttgctatatgttgttttgtacatcataaatattcaaaatgtttaaaatggcatactttttcagggtgataatccacatatatatgtgaatatatgtatatatgtgtgtgtgtatatatgtatatgtatataattttgccatgtttccaagaatgaacagaaattcatccaagtgtctcagtttaaaactgaactcacattcaatgcaatggtgtgtcttgttctgtagctagttacttcctggtgaagctctccttttcttgtgggtcctggatctgtaatgaagggcaatgactggttctcagtcctgaaaagacattaaaatcatattagaagactttaaaaatcaaattattgtgtacacttagacctcctcattgagaatctgaacagtagggtctaagaactgacacatttttttcacaaccttcttattggttttgatttattcagtttgaaggctcaaatttgagtgcactgacatacaggaaatatgtgttgatggcctagattatggttttgccttatctctataaggagcccacaaatctaacatatggtcagtaattagcttctaattagtgactttttagattagttgttctctaactttagattgcatacaaatatcctggaaggcttgttaaaacacaagtagctggatgtcaacaaaatgttagagtagaaaacctgaagctgctgtttctcgacagaaacactgaaaaacaagcagaaattgtcagaaccaactttgttggaacttaggaaaatagtcagaggtttatagcaaccgagtgaatgctgaatcaagaaaaaggcaaccttaaaacagtaggaaagctgtgaggcatgtttacttgccttttgtaccataccatttataacccagtggcagtcctgaaagatttcagcccatgttcctagtgtaggacaacagtctctggttgtggagtgagcagagcagaccttattcacaaattattttgcatatctattctaactatctgggactatgtgaagaactgataaaaggtacttgtaactcagaacgagttagtgggtgcagcgcaccagcatggcacatgcatacatatgtaactaacctgcacaatgtgcacatgtaccctaaaacttaaagtataataaataaataaaaaaaaaaagaaaaaagtggcaggcattgatttattgcatatttcaaaatagctacaagagaagatttggaatgttcccaacacgaataaataactaatgtttgaagtgacagttatcccaattatcctgatatgatcattatatattgtatgcacgtaccaaatatcaaatgtacccaatacataggtacaattattatgtgttaatttaagaaaacatttcaaatctaacaaacaccatgtgtctgcctggggccaaagagtatggttgagacatatagtagatcatgtaaagcaaagagaaaatgctggaaaaagggtttctttggacaattagaacattcaaaatcacctgtgtgttcaaggaatttagaaagccatatgcatgcctagggcaagaggtaaggtcagaaaagacttgagaacacccaaagctttcatctttggctgatccctaggatcagtgtaagcctggctaagtgttgaaggagggtcccagcacggagaaaatctgcaaaggttggaggagtctctctctctttcttgtttttggttgctgacattcaaggaaatccctgtcaaaatttttttttaagtttttttttctttctttcttttttcttcttttgagacagggtctcattctgttgcccaagctggaggacaatgatatgatcatggctcactgcagccttgacctcctgggctcgtgtaatcatcccattttagcttcctaagaagctaggactacaggcacatgtgaccatgcctggctaatttttaatttttttttttttttttcacagagacaaagtctcactgtgttgcccaggcaggtctcaaactcctggcctccagcaatcctctttccacagcctatcagagtgttgggattacaggtgtgagccaccttgcctggcccaaaatactttataacataagattaggaacagagatttcagttactacacatgactagaaatacagtctctgcaaaaatagtttggtaagccactaaagaaatggactactgtagtattcaacaataaaaaacaaagaaaaacaaaactcagcaaaccccagtaaaggggcagatctgttctccagtgttaatacattataacatccaaatgttcagtgttcaaataaagtcacaggcaaacaaagaaagaggaaagtattgtcattcaaaggaacaaaataaatgaatagaaactattcctgaggaagcacagatgttgaacttactgtacagactttaaaataactgtctctaatgtgcttaaagagctagatgaaaacatggataaagaaataagtcacgaaaatgatgtataaaaaaatgagaatatcaatgaagagatataaattataaaaaggaaccaaacagatactctgcagctgagaagtacaactggaataaaacacttactagagggatgcaagagaagatttgagcaggctgaagaatgagtaatggaacttaaagataagatcattgaaattaacaaggctgtggagcaaaaagaaaaatgaataaagaaaaatgaacaaggcctgagggatctatctgtaggacattatcaaatagactaatgtatgcaccgggggtgtctcagatggagaagatagaaagtactggaaagaaaatttggaacaataatggttaaaacttttaacatttgatgaaatatatgaatctatgtatccaagaagtttagcaaactgtaagtaagataaactcaaaggtatccacactgagacacgttatgataaaaccatcaaaagataaacgcaaagagaatcttgagagcagaaagcaagacatgactgtcaaatacaaggacttcttcatgagattagcagtaaatttatcatcagaaaccatggagaccagaaggcaatgggttgtcatatttaaagtagggtcattactactgaccttacagaaattaaaaggattaaaatagaagactatgaataattatatgaaaacaaattagataacctagatgaaatggacaaattcctagaaacacataaccaaccaggactggatcatgaagaagaccggatcatgaagaattagaaaatctgaagagacttataataagtaaagtgtttgaactggtaacaaaaatctctcaatcaagtaaagtctgggaccagatggcttcactggtgaattgcaacaaacattcaaacaagaatgaacatcaatccttcttaaactcttccaaaaaattgaagtggagaaacatttcctaactcattctatgaggtcagaattactataataccaaagcagataaggacatcataagcaaagaaaattacagaccagtatctcttatgaatgtagaggcaacatttctcaacaaaatacaaatgaactgaatccaacagtgtattaaaaggattatgcactatgcccaagtgggatttatcccaggagaatggtttaacataagaaaagtcaagcaatattatatgccacattaatagaataaaggaaaaaaagccctacaggatcatctcaattgacacagaaaacgcatctgacaaaatccaatatcttgtcatgataaaaacactaagaaaatgagcaacatgtggaaactttcttaacgtaataaagggcattaatgaaaaactcagagctagcattatactcaatagtgaaagactcaaagttttcctcttaaaatcaggaacaaggcaaagatatcaccactgctatttaacactgtactggaatttctagccagtgcaaatgggcaagaaaaataagtaaatgcattcaaattggaaaagaagtaaaactatctctactcacagatgccatgattctatgtatagaagttagaccccctacttcacaccacatataaaaatgatctcaaaatcaactaacattctaaatataatagctacaaccactaaatcttagaataaaaagtagaggtaaatatctatgggcttgcattttacaatggattctgtgactccatctcaaaaaaaaaaaaaaaaaatttcttcatcaaaagagattattaaggatgtgaaaacaaaaccaaaaaaaggaagaaagtatttttaaattatgtatcttataaaaatttaatgtccagagtatacaaagtactcctataactgaacaaaatgacaacccaactgaaaaatgggcaaatgatctgaatacacatttctccaaagaagatatacaaatggccaataagcacatgaaaagatactcaacatctttagtcattaggaaaattcaaattaaacctccaataatatatcacttcataccccaccagttataatttttaaataaaattcccatcctattagaaaataaggggaaaataagtgttggtgaggttgtggaaaatttggaactcttgtatattgctggtggaaatataaaatcatgtagcttgatgaaaataccaaaagcaattggaacagaatccaaaattgacaaatgggatgtaattaaactaaagagcttctgcacagcaaaagaaactatcatcagagtgaacaggcatccaacagagtgggagaaaatttttgcagtctacttactgacaaaagtctaatatccagaatttacaaggaacttaaacatatttatgagaaaaacttcatcacaaagtgggcaaaagagatgaacagacacttctcaaaggaagacatttacacggccaaaaaacgtatgaaaaagagttaaacatcactgatcatcagagaaatgcaaatcaaaatgataatgagataccatcttacgccagtcagaatggcgattattaaaaaggcaagaaacaatagatcctggtgaggctgtggagaaatacgaacatttttatgctattggtgggaatgtaaattagttcaaccattgtggaagacagtatggcaattcttcaaagatataaaaccagaaataccatttgacccaggaatcccattgctgggtatatagccaaaggaatataagtcaatctgctgaaaagacacatgcacacgtatgtttattacagcactattcacaatagcaaagacatggaactaacccaaattctcaacaatgatagactatttgataaagaaaatgtggtacatatacaccagggagtactacacagccataaaaagggacatgatcatgttctttgcagggacatggatgaagctggaagccatcatcttcagcaaactaacacagaaggagaaaaccaaacaccacatgttctcactcataagtgggagttgaacaatgagaacacatgggcacagagaggggaacatcacacactggggcctgttgcgggatgggggaaaggggagggaatttagaggacaggtcaataatacatcaagcccccatggcacacgtatacctatgtaacaaacctgcacattctgcacatgtatcctggaacttaaagtaaaatttaaaaataaaatttaaagtaaaaataaaattttgattaaaaaagttaaaaaataaaatcacgcagctgctgtggaaaacagtttgttggttcctcaaaaatttaaacacagaattacatgtaatccagcaattcctctcctaggtttataggtaaaagaattgaaaacagggactcaaacagacacttgtatgtcagtgttcactgcagccttattcaaaatacacaaaagatggaatgaagccaaatgtctacccatgtatgaatggataaagaaaacttggtatatgtatccagtgggatattattcatccataagaaaggaatgaagttctgatacgtactacagtgtggataagccctaaaaactatgctatgtgaaggaaccatgcacaaaaggacaactattctttaattccacttatatgaaatatcaaaaataggcaaatttattgagacagaaagtaaattaatggttaacaggggatggtggcgggagtcatgggagttattgcttaatggttacagagtttttgttgaggcaatagaaaagtttgattaatagtggtgatggttgcataacactgtgaatgtatttaatgccactgaattgtgcacttaaaatgtttataatggaaaattttaaaaaaacaaaacaaaacaggtagcttggtcctatttccaaagtctgattcagtggacctaggttgggacccaaatcttttcatttctaacaagctgccaggtgatggtgatgctgctggttctgagacatgctttagacagaaacataacaagaactccagggccgggaagaagaatcttggtttcaagggatggagatctgagtttgaatcctgaacatacctctttattatagctgttgaacttgtgttgctttgctttttgaagccaatgaagttactctcttgcttaaattcttttagtgactctctattgcatgtcaaaccagcgtaagatctggtccttgctgtcctctgcaaccttctctcatgccattttctcttctgcccaccatgcctcagccacactactctttttacagttccttgaacataacagggccttttcacctgcttgtgcccaggacagttttcattcggttgtttgaaatgttgtcttctttatttttctaaattaattataatttgtattttaagtgctagggtacatgtgcaggatattttcctggagcaccctctctttgcaggtccgtcaccattactgcatatatcggttagctattgctgcacaacaaacccccaaaactcaggggcttatgtcagtaagctcacaggtctgctcaaaaattgtgttgataaggatcggtcttggttgatcccctctagatttactcatatgcctgtagctggctggtggagttggccaaaggctgacttaactgggatagtctcagtgccatggtgattaactcctggctggggcaatgttgacgactggaccatgtgtctttcattatctaacaggccagcctgggcttgttcccgtggtgctcggcaatgtttcaaggtagagtagatgttcacaagacccttgaggcctaggctgggaactggcacaccatcacttccacagtgctttactgatcaaagcaagtcacaagactagccccagacttaagggatggggaaacagactccccctcttgaagtgagggtgtacaaagtcactgttcaaaatgtgtgagtacaaatggggaatcaatttgcaatcattctatcacatactttccaactgaaacatctccatttccggccccgcactcaccacagtttgagagtgtaggcagggctggcttcatgggccatcaacctgagcagtcccaggggggccgtgcttagaaaggtcctgtgattagattactgccctgctgttgccctcttcaattgtttagtaaattttgaacaagggactctgcaaattatgtagcaggttctaagtatagtttatgtgggtgtttatttgttcatcattggtctttctagattgtaggcttcaccagggtcagaactagctctcattcagcaagtgcttagaagtaccaggtacataactggcagacaatatactgttaatgaatgaatgtaccagttatgaatttatcttcttatttgtaaagttccagagatgtctttcctgaaggaaatgcagattatataagaatatgtattaaaagcaacttgcacatagtacatttgtaacacatgtctccatccctttttagtatttaagcacataaaaatgcatttcttggcatttaatgctccctgtatgtttaactgtatactgtagaaatgaaggcactcttcctgtcttttaggaatttctgttttagttatgaggatatgattaagagagagagaacagttcttcctattatctattccagcttgatgagtgtatgattctctgtagatataaagaactttgtgcttgagctcaaatacctggtacagacagataacacaaagaacattcagagacttggacaatcattttgctgcagaggtgggttatgggaatgtagaggacagaaccaacagttattgaatacttcctatgttacagactttggccctgcatatagtatctcagttaattacatttcaccttcagagaaatcctactaagttagtgatttttatccccattgtgtaggtcaggcaattggactcagattaagtaagttgccaaccttatatagcccagaagtgatggaaatgggatttagacccaggtctttatgatttcaaagtctttgctccttcattcaacaaatatttattaagggcttaccctgtgtttccacagttaccactgtgttgattaaggagacatgatatttacatgtggtacaccaagtaccatcaggagacagaatttgtctttttctgggtttccagcttcaaagaataggtgatcccagtggaaacatcaaaaggtgatggcaatttcacccagtccatcttcctagagagcaaggcggttcttcttgcttcctaataggagtggcctcatggaatggctcattacaaagatactttccatggggcagctttcaaaactcatcttctccttagaatcctggatgccaggcagtgcttctggccatccttttatgagaagaaatggctggggtaggggaaatatgtcagtgtctcattacagaaattacctcttgatcaattcaacactacaaaaatctccctgaaaaagaggcagccacttctcaggtgagagtcagcatagctccaggcttttaatatttatcttgtacatgctgcctcatggattcaacaaccacatctgctgaattgctccagaactaaaaatgcttgtgatgtgctttcaggttaaaataacattattctctattttaaatattattatgttgcctttataggcaaagtaaaagcaaaagctcctcacttgtcaaacctaatttctggaccctggtggatccttgtggatagtgcaaaaaaaagtgctgctgattaaatagcagaggatggaatcacttgcttggtgcctggtacataagcctctagcattaggtaattcctgtctgagacacagaacacaagctgggaattttttcacttcaaaacagcatccatttgagaaaagctggccagtagtgataggcttatctgaatcttctgattgtcatagattttcattatcaggatggttgattacccactcaatttccctttgatgcattctgagctgattatgctgttacaatttcagagggtgaaaaataaaaaaatgagccgaggtgaaccaaaataagttataaggatgcttcaggggttgagtgttctgacagtttctaaatagttgaggcctcagggagacttcattccaaagcctttcacagaggccaaggctctcctgtctttgtttctctgtctctgtgtctgtctggtgaacttgggtctgaaacctttcccttacctggacatcactgtctcctctaacagctgaggtgtcactgggaagtgaaattgattacaactttttaaaaattccacagctgtcgtttttacctcagctgcttcccataattccacagatggtaaacatatgtttataggcacattgaaaaagaagctatattggatgcctcccatctttaattcttatttttcctttcatgcagaaagtcaaagtcacagaactggggaatcttacacatttgaagattaatatttctgtgcattaagactttggaaacagcaggacagctaatgatatgctaatgagctgacagtttttattgatcataatgaaagtcgacaagtgtctttcttggcggttttgcatgctggaatattttattaacgtcttcagggcagaagtacatgattggttgcattttgaaaaccctccctgtgagtttacaggtcctactttttgttagcctgtttccaaagcttgagtccctgccagtttataaacagaacacatcttcatccatatatttacatgcccagcaggaaactctcccacccctttttcctctctctttcaaagcaatttgtttcagtattttagcatacaaaaaaatagaaccattttcttcaatgtaaacagagatctgcagggaaataagagcgttaaaaaagaattagcatttgtttggtggtgaagctgcttttgtttgtatcagaaagctctgcatgtttagaagagcttgcttaatcttagttattccatacacaagagggacctaattggataattttctaattttttaattgcatctttctatatttcttaatgcaaaatgagaaacgttctaggaataatagaaataatgggcattagttccctaaacattaaaaatccataatatacaatgtacctggtgcaaatttatttttcagtgcatggtgagctgacagcaggaggtacagggtggcaacaggtggattaaacaaaaggaaaaaaaatccatttttctgccgtccatccgtactaaatagtaagcttattaattttgggctctgcaccttagggatttatttaaggcctcagatcagctgaggttcatcattacactaacaataagaaaatggattgtttagcaaattaatagtgtaaataagattacggggggcggggggatggggggaagaatattaggctacctaaaaagacttctgttttctagcactgaaaaactgtcttagcaaattattattatctaatacaaatagttttgcatgtttgattggtatctatctattaaggcaatcaagataaaatctcattttgataacaagacctctttgtagcaacatgttgttggttcatgttaaggggatcccttaaattatatatttttacctacagcatattgtagtgacccagcactggttttggagtgttaatcgaaaagtgtctggatctgtctctagctaatgataaacaagtctcaatcaatttagaaaagtttattttgccaaggttaaggatgcacccatgacacaacttcaggaggtcctgaggacatgtgcccaaggtggtcctcatgtataccttgctttatacatcttagggagacataatacctccatcagtacatgtaagatttacattggtttgatctggaagggtaggacaaccagaagggtggcagcttccaggtcataggtagatttaaaatttttctgatcggctattggttgaaagcgttatcagtagtaaagaatgtctgggttctgataaggggttgtggagaagaagcttttatcatgcagatgaagcctctaaatagcaggcttcagggagaatatattgtaaatgtgtatcattagacttaaggtctgtgttgatgtaaatgctggagaggtttaatgaagcatgttcaactccttttccatcatggtctgaactagatttccgggttaactctggaatgcccttggcggagagaagggggttcattcagatggttgggggcttagaactttatttttggttttcaagagttagtagccctgtagtatatagcctaggattaaggtatcctttagaaaagctacttagagtatcaaagccttaaatttctcataggtcatatgaccaggtaatctggtcctagataagtagttcttatggaaagtatcaaaatgacctcagacagttttcaaaatagtcatgactgttctttcaacctcttccaaaattctgatatataccctaaattaaaaactattgccccacatgatcttcacagatcctaactgtgctcaaaattatgtggttcagtattgtataattcatagttttcaataatttgatgctttagaatatttattgtgtttactatgtgaaatctactacaataggaacttcaggggatactaagatgaaaatctattatctttggtgtttataatacagtctagtaattctgttgggttttattcagttccaaatcagtaagattttactctatttatatatgagttggatgcaataattttaaccattgtgaacttttaatgagtaaatgctcttgctccaaaagaagcaaatggttgacaataaagcagaatttttcaaagtgaggtccttttaccattcatcagaatcatctggaagaggttttgtttaaaaaatgaatattcctgggcccactccaatcctactgaaacaggatcctttgggttgacacaagaatctgaatgttaagcagatactcaaggtgattctcaggaacttgaagtttgagaaacactgccaaaatgaataatatgaaataaagcatatgtctgaaaaaaggagatcaaatgaggtcagctaatacaggcccagatagagttgcatttttcagttaaatgtagatacatttagagttaaatgaggagaaataataaaaattttgtctttttatcccttatctcctttgggagaagttgtagtgctgaaaggcacattttcatctgtggaaatcctcatagatgatatatatatatatatattttttttttttttttttgagaggaataaggctgattgagctcctttgtagttttatgcattataaaatcccttttgtagttttatgaaggaaactacatgcttagcaaatgcttcttttatcagcaaatgtcctggcagtaaattgtccatatagcaatttaatgccagaccttctgattcttattctggggaaggtgctgggatatacataaatgtgtgtagtcacatgcatacacacacatgcactcagacatctttagattataagtggtatctgtagggtatcaccacttttcttttaatccagcattgacttacaaccattcaaataaattaacattcccatcttgattcatttggtaagaacacattttcatgccagtatgtgggctcacctctatgacctttccttataaaaaataccaagtgctttgggtttttgtgttaatgagcattgggaagctgtcagcttttatttctgttttttgttcaagtcaacatcattgaccttcacctaatgatctatgtaacatacacacgcaggtaccacagattaaaagtggaaagacagggaagtaaggagagatgcccatagaggaaaggtgtgagagcaggtgatttgtaaatcataatgtcactaaaatgagtaagatcacttgaaaaggaaaaggaaaactgctgtgtgctgtattttcttgctttaggattagcgggatggggtattattttaaaatgagttttcagtttggttttggaaaggtatttaacaccatgacacatgtgctccaggattctgggtacccttttccatggatgataaaaataaaaataatctagggtcttctgatgaacaggtatggatcctatccttttctgtacatatacttccaccaattctgcatcgcctggggtaaccagctgtcctggtttgcctaggagcctctgttttagcgctgaatttttccatgttccaggaaatccataagatggaaatctatagttttgtctgtttacattcttttattattattattattatttgaaaagtaatgaaagcatagatgtctaaaatgtgacaatttcagtttggaggcctgtttcattgacctagaacatgagtgctgggtggatctttaggtttttcatctagcacttcttttccagatgaagcaactggggctcatagaaggtggctaacttattgcctaagtctgtgcagttagctggagacagatccagaacttgaaaccaggttccctgacttctaatccatgcttgtctcaaattgccacatgtgcttgaaggtgtgatagcctctcaaagagttaatttgctttgaaagactgagtaatctcatcccagagagaagttaattcatttagattgtgctccattaattgctccctggtattcctctgcaagagattatgaattaatattgaggagcagtggcagaaacttcttccccatggggaggctgtcttctctcataatcgcaaacactgcatcatccttgaagaggaagaggttaataaacatataattctgtggaagaggtgctgtgatcctgttatttctattaatatttccaattaatatttttttcttgaaataataagccaaaaactgcatttgctgattgccttctgctgtttagaagataagcacatatatgttaaatgttactccctctgaaagacttgcagcactctcttaagtctatattttatttatagaataagctcagtattctgaaccagcttctacatcttccatctgttctgtaatatctctgccatcaaatcagaaaaaaccctaacaacagaatcttgaaattcaacttgaaaaattcaaaagtcaagtcaatattttcattgagagatgacagccctgatgactttcttaaatttgagctattcttccagactgaattacagaattaaaagaccaccttttactcttaagactcatcaacaaagactcatgttactcaattagttgaagagcaaggattgttatggaattttcccaatgtctaattttatttccttcgctaaatgaatcagtagaaaaattttagcgtaatatgtttctattatatttcttcccactttaaaaaaatcctgtaaatcagcaatatttaatattccaggatgattagggcattaaggagaatttttattgaatcagtgctttttactgatgtgtctttggtgttataatctataattggcattaactagtggtaactaattggagctttctccacataaatgtacaatttgagattcctaaagtaggatgctttagagtagttcagtatatactaaggccagctcaccctttgaatgaatcaattttgttgaaaaataatctgacctgccaagagtatgtgattgcataggggacatttgagctggtgactgtaatcttgattgccacctgtctcttctattatcaaggggatcatccaagatgggaagatcatctttatgccgaatggatatataacacagtgtccaaatctaaatcacagtaagtagcaacttaaagcattgtgatatattatataacttgttgattgtatcagagaaacacatctggaaagatagacccaaattgtttacagtgttgacttctgaggtgctggagatagtgaaagagaacttattatctacattatataattctgtgtctttaaaaaaatatgtatcatttattgtattaatccgttttctcactgctgataaagacataccctagactgggtaatttataaaggaaagaggtttaattgactcacagttccacatggatggggaggcctcgcaatcatagtggaaggcaaaacaggagcaaagtcacatcttacatggtggcagccaaagagaatgagagccaagtgaaaggtgaaaccccttataaaaccatcagatcttgtgagacttattcactaccataagaatagtatgggagtaactgccttcatgattcaattatttccaactgggtccctcccacatgtgggaattatgggagctacaattcaagatgagatttgagtggggatgcagccaacccatatcatttattgaactaaaatttgaaaagaagagggttacattagcagattctataggtggatatagaaagatatgtttaatatatatttttaaaaactattccttaagattcttgacctggatgagagtttactttttcttcttctatgatacttcacattttttaagttacctccctataaaaatgagagtttaattttaactttaaaatgtcatgttgcctttctttttagttaacaatgcctttttcctgttcctttctttttgcttattaaagtaggaaaagatccagacctgaaatcctctgtgatttcactcaaatttcaaagcaatgtcaaccaaaaaaaccccaaaaactcttctacatagtcacgtatctactgttttaaaattttatttcttatattagcacaatataaatatatatgttttatattttctttattgagcttgcccaacctgcagtgatttcttaagcctggtgcaaggaataatggatttacaagagcttttggccaagatgactgcaaaagtaggtatctaaatttcatttgtgatgtttcatttctttttctgtcctatctggaatttggagtgatatgttataatggaaacatttttagcctcggcatctgctatatgttactacaaaaatgttttattcttactcaaaataggactaccaatagtaaacataaccattcctgtctttgatgctattaagctgtatcataatgtttacttgaaaaatgcttggaagcaagaggcaatatgtatcactgtagattccatgggagtggaaaaggaattttcctattggctattaaagtagtaacactgtaagatgatctatggtcagagccactgctcttataagctaatgcattttggatgtaagaataattgccagtaatcggaaggggcaaaatagctattgttaggaacagattactgtcaaaagaaggcattatattacatttttaatgtataatttatttcaaggctggtcctgagttaaatagcaaaggaggcaaagtttgcctttcaacaccttcggttttataattccgcaccttttcctcctctccattccatcatccacttaacaagcatcttttgaggacctgccgtttgctgggcactgtgttaggcacaaagaggcaatagtgaaaaagacacgctttctaccctagatatgttcatactgagtggcggagccaaatgtgtaaacaactaagggctttaatatatattcataaagtgtatattcataatgaaaagccctgagccttgttgaaaaagacactgaaaatatagaaaatatggctaatgctgttgttatgataccaatcagttgtggacatgagttccagcctagggcgaagaaagaattaggttgggcctaagagacattatactctgcaaaagaagaattttaataacaatgaaaatgatacattaatcctattgtacctgcagctaagactgctccctaccatcagccatggcatgtgcaaaaaaattggtgggtagataagtgtttgcaagataaggctatagtttggacccatggattgtgctgctgaagacaatgtttctatttcaaactgggtttttggctaaggcaaacccctttttgtctggaaaggagagatggaaaacttttgtaagaaaacaattgagactgaggcccagatctgaagcattagcttttcgcttcagagtatagtgggaatgtgaaacgcaggtgattatttaccttcccagcttgtgttatagagaggcttttatttcatattgtctggagcagcttgatctcaatactgttaattatattttagcatgctaccaaagttttggaacaagaaacatgccactctgtctcaggtgattgtggttcttcattctccagcttcgagggcgtcgtttgctttctcattctttcccattgcagagaatgtcatttttctctttttagccacacatcatctaggagccacagagagctctattctcaaaacgttattgtgtaaaatgggcctttgtgaggtaggtatttaattgtgggcagttgcaaacagcaaattttttaatccatcttctaaacctccctttggcactttggcagatttttaggtctgttccttccaaacagtatatagaattacaatttgaaaactgagtacttccatctttgctgtgtaatttgaaatctatgatcatctagaataagcattggcaaactttttctgtaaaggaccagctagtaaattttgggccttgcaagccaagaggcaaaatcaaggatattatgtgtagacttagttcatttaagtataataatttaaattataactattgaaaactataagaaccattcttagcttataggacatacaaaagtaagtagagggccagatttggtccactggccttagtttgtcaaccattgatctaaaagaaatggaaaagtcagtaatacaagcatttactatgtattagttaaaatgcttaagcttttatatcccctgtcactttaatctttaccacaatcctttgagcttgctttaattcattagtctgctttacagatgagatgactgaggtccaggaaggtctgataacttttcctaagagagtagatggcagagctgggacctaaactcaggtagttagatcctgaaagttgaatcatggctgagaaagttcatggtttgacaagaaagggttaagaagagagataaaagctataaatagggagtaatattactctttctaaccctcaccatccactggcaggaggatggagatattaccaagaaagagcaaataaaaaagaaaggaaaagagaaatgaatgtttgatcattttattgagctgaactaaagttttcagatcatacctgtttggaatgaaatgtgtgaacatagaacttgtagtaacttttcaaagaagaaggttatggcaagagcaaggtctcttttttattgtgtgtgttttttttttttttttaagaacagtgtctcttaatgcacgcttttggctatgagctgcttgttttccttggaaatagtgaaaattatttgacattatttacttaagtattttcaaaccagattgctcagaatcagactgctacacctaggaaaggccaggtgaagtctcaggaaaggattctttaaggattttcaaggaagatttttttttccttctagctggtgccaaggtctgaacatgaaagttttctttctgtgccttgagcaagcctccttctttttgttcactctaacactgagggtatctcatgttaggccaaatctttatataggggtttgctttaaggtacccatcttgggaagatacttttccccaactctgtccccctataccctgtgcaaccatcagggtggaagctcaggggctctacattgcatcaaaaatcttcaggatgttgttgtctttggtgctcacttatttcctgggatccctgcagtcactttgttttggcctctgtgactttgtttcttccttttgtattagctctgtgacaattttcaaaagtttttatttatatattgaatacagcagtttagttggttcagttggtgaagtccttcagggtatgtagtctgccgtcttggtggaggcgaaaatgtaactcacttttttggcaggtggaaggagatggagtctggaaatgtcaggcaaacttgaagttgaatatggttcgcagatgcaaaaagaattctatggcactaaatttatctgggcccagtctttatttttaattaaataggccgattgtggcagaattcagttaatagggctggaggtaatttttggagttttgatttgagttgtccagcagttccgattaagatgggtagacagtcatataggtcatagtggagatagagaatgggctttaaagtcaggctgatatgattctgagtcactattttataatttccttggatatttatagctttgagtaagttattcgacttgtttcagcatctgtttccccatatgtaaaatggtgacaattattcctgctcttgtaaagattccgtgagcccaggcaaatgaggtttgttgcacggcacacaaatgtcattcaataggtggtggctgctgctgtttatactcttaaacctagaaaatatagacaaccatggtgggatgatggttccttagagaaaatggtccttaagaaaatgcacatcttccccagtgacttgaaatcacaaagtctggtagagcctgtgcattgctgtcaagaccctagtctaggagtcctggaaaacagcaggaagtccttcctcttgggtcgaggtggaaaccctggagcccttccagagaagaagctccgtgtataagctagagaggaattggtagtcaaagtcagaaccaaacagatgtagataccagatcagcccaggggtctgtgtaggagagctcattgatccttttctccttttagggttaggcatgctggcaagtgactgtgcccttgcttgatcatgggagcagcctgcactcacattcaggtgacagaggtcagggtagataagagctctcttgaggaattctggcattttggcaaaactatactttttttaaggcagagaagagatggggctgctacctcaagtaataaaccttttttgtcctcctacatttcccttagtgatctacaagcatcagccactcccctggcttactctcaaggttctctcaggtggttttgacattgtgggaactacctacctgctgggaacattgtgatagggtcagactctgtcctgctatcagatcccaactgcactgtaatcccattctgacttcaatctcagaaagaagagatactgaagactgggactttcttgattacttctgtttaaatatttgacaaatctatgtatgcaaatcaagcgacacttggagtggcatttaagcttgtgacatctttaattttgagactttcattgttttgaggaattcaataatgattttttgattaagcttaaatgtttaacaatagaagcttcttttttcctttcatatagcaaatgccaagtaaatggtatttcaaagaaaagaagcaatccaccacacaactaatgtacttagatctgttcattgacctctgatgataaaaaaggcctctgctgtctatctttcattatgtagagttcagaataaatgatttggtccatggttgcttagataaatgcataaacaagaggtagacagaatagagatgtagatgtgataccgtatctatttcgaatctgcagacaatcttagagaaagtgtcaggtagtatagaaatagcttttgaaaatgaatgtgtataaattcagcatgctaataccagtgacagaaaatgcaattcattttttgattcacagttgtttgtctcctttattgccgttttaggatttagcaggagtaaaagggaaggcaagaggttacatgaagttctttgaaaaattagctttttgccttaacatccctttgcctttgtgtctatttggtgtgctcttattattacagacaataggacttctcaatgttgtcagaaaaggctacaaatattaaaaataaaaaccacattcagaagggaaacaaaatcagccttgagaatagcattcattatattaaaactgacattttctttggaattgagttttgtaggtgagcacagctcagctttgtgggacagtgctagaaattgccactatttcccttaggcaagctcctggattttaagaaagctcagatagatatagagttgccttttgggccatttagtccttaagaagttcccttcttggagtgatatagacaccagaattgttccagattttcagagtaaggcacgtatgggtcctctcacaaaggtacacaattctgagacccttttaggaggaatgcagatctggttcaactctgttgttcaatccaaggtcatatatctgttactgccttgtgtaggaactactggggctatggaaatgaagtaaagataagtgataagttgttactttctttctattgaggttccacatctgtggattcaaccaaccatggaccaacaatactcagaaaaaaattccaaaaagttacagagagtaaaacttgaattttccatgtaccgagtactgcattgaatccatgtgaatgaattgatgtttagacattgtattacttattataagttatctagagatgacttaaagtgtataggaggatgtgcatacgttatatgcaaactatactattttatataaaggacttgaagattttcagattttggtatctgcaagtggccaaaccatatgccatcatccctcagtgtccaagagtatcaccaaactcagcagtgtattttatccgtttcctaaagcattgccaaataacttaattatcatagattctataaactctatgattaggctggagttttgttgtattaatttatttatttattgagatggagtatcgctctgttgcccaggctggagtgcactggcatgatcttggcctgctgcaacctctgcctcccaggttcaagagattctcatgtctcagcctccagagtagctggtggtacccgctaccacacccggctttttttttttttttttttgtatttgtagtggagacagggtttcgccatgttggctgggttggtctcaaactcctgaccttgggtcatctgctcgtcttggcctcccaaagtgctgggattataggtgtgagtcactgcacttgacctaggctggagttttaaatgaaacatggatttttagaagatcatgcatattagaaggagtgataggaagctaatatttcaggcagcgtcaactcttagttctttaggggctgctcatggtgcatggtggttggtctaagatcctattttttgttttttctaccctttgctaccacccacaaaaggcagacaaggggtaaattttcttgagaaattccaaaagcttggaggaagaggatgaaataaatgacaaaaacaaaggttagaattacatgtggattccatttccagagagtagttctggtatgagtaagtcagaggaaggtgtatgaaatggaaccatagttaatgtagaaagatggtggaagtcattccctaggtttatctattatgtctaaaatagtggctcaaaataatcttagttagatcaaaggttgaattgatctcctgtatggggaaagtacttaagacatgaaaggataaacatgattgagaaggaaaagagaaactcagataattttctaggaaacgatacttgtttttcaatcatggtggtctctatgtaagggaaaggaaaggaagagtaatatcactactaggttgagttactctttcgtgtggatgtgacagtagacagatcatatcaaagtgctgtatttagggtttttttgcaccatatttttgaaggtaaactggagtaggctgtatgaaaagtgatcagaagagaggcttggaatcatatcatgaggagctgttaagggaacctggtggtgccaagtgtggtcaagacgacaggataacctcaaatgcttgaagattaggtttgctcaggatggattacaatgaaaacctaggtatggcaggaaaaaaagaaagatttcacagccaaaaccatgaaaaatgtttcaaacaagagagctaactgagaaaagtggctttccttggaagataatacatgttcctccactggagatgtacaaaggctagataatcacttgaggtttcttgtgaggatattcaagctttataatccctttccagcaggagagtctaagactctgtgattattggcaatgactgggtggcctagaaaaataaaaaaggttattttacaaaattctgatcttacctggggttttggttacttttcctgtccttcttctaagcacaaaagtgaattcctggggcattctgtttgggggatccgcttacgacttttctttttttctgaccccagctctccagaatttttcatcagacagaaggcagtgacttcctagtttgtaaaccacgacattctagttagtgtgtgaagaacatagagaggatagtgggagataaatgtaagtgcctcggagttcctgattagatcgcctgtaaacatcataatgagtccttgagaacacattcattatgagtgtttttgtgtgggcttgaatggaaagcacacacatttatgaacacccatgaggttcctgagttacagtttaatgtctcatttggtattcattagaccatgacagccaatatttcttcaatttagagtgattccaccttgtgtaaaaaaaataaaaaaaacaaaaaacagataatgctaagaatcagtgaactgctctgagcatttttttctcttctcagaaggattttttttcttgttgctattagctttgttaggatgatgcaattgaattacagaaattacattcagtaactcttgtttgcagctaaattatgcagagacaagacttagtcaattggaaaactgtcattgtgagaagacttgtcaagtgagtggactgctctatcgagatcaagactcttgggtagatggtgaccattgcaggaactgcacttgcaaagtaagcctctttgtaaataaatacagtaaaaacagttttaaggggagaggtttgataattagagtgtaacctggttctttaataaataatattaactctgagaattgttaggtttttacctagcacccactagccatacgagcaattgtgaagcaatgctggaagagtgtcatgtcttatatgaatacttggaaattaaaatctgctttcccttgccaacacaccctaatttgatttaataggcaatgtttggagtttgaaggttgggatatagtggaaagaagggactcctttgattttcaaacaacctaatggttatccttattcacaaccagaataactttaaaaggggagtttaattattttctacatgtttttattgtcttttgcaaagtgtatccatcacctgtttcaaataattgcaaggcatttcctccctgactcactgtcagtgtgaggatatccattatttgtatatcccttcatctgtttcagtgaattacaacatccccctccaaaaattagtatggaaaccctgtccagttgaaattacttgataaatatctgaagaatgccattgtttgtctaggaaaatacaaaacagattgttagagcctcagaaatgattgacagagtctgcaaatgtgttatttatgttcttataaaaatagactttttgttttctgcataatctagttagcacacatgggcaggtaggatgaaaccagtgatgtatttcagaaaagtaattgaggtggtacaggtcattcgggccggagaaaacacttcatctgtggtcctggagtggactgggaattcgaatactgcttctgtttccctgatgaggtttctgggatgagatttcaatgatctccacaacaggagctatcaaaggatacttctgagattatgttccatgtccttccttcctcagagtggtgccgtggaatgccgaaggatgtcctgtccccctctcaattgctccccagactccctcccagtgcacattgctggccagtgctgtaaggtctgccgacgtaagtactgactgagggtcagactggctgtctgtgttttgagatttatttatttattttccctgtttttctggactcaactgattgacattgatgaaatgaaacattggcagttgatgtaacattaaatatatggtaagaagagccacaatattttaatcacttgcaatgtggcagacacttaacatgggctatttttttttttaaatcctcacatcacctgtaattactattcttctttcattctatgtggaaggaacgtgtgttcacagggattaagtcacttgtccaacaagtgggtgaggctgatctgtgaatttacaactccaaagctccataggctttagtcccctcattctaaatgatcaagttaaaggccaaattctgtattttggctttctgaggttttggctagattctcctcttattaagaggcctttgttaggaacttccggatgaaattcagttaaaatactgaagctgtcgtttagaacatgtggtatgttccatatactgtgctggatgctttaaatctactagcttagtgaattctcacagcaactctttagggaggtattattattatccctattttacaggaagctgaggcttagggatattagcttacgaaaatcatgaggctggtgagtggcagaggtgagacagaaaactagttctgttgactacaaagcccatagcctttttatcagtccatatggtcctctacagaaaaggagagttctggtcagaaatgtgtgctatggataattttcaaggtcatttatttaccaaaagaaacacaccaatgtcagtagccttcaaagcacagtggtctatcattctgccaggaacagcatgtcacctattatgacactgaaagtgggaatagcagtgaaagtgggttgcagcagcccaaataattgttgaacttttcaaaaaggaactttgtaatcttccttttttttttttttatggttggcacactgcacccattgctctgggggatgtacttggagttgctctaaagagaagaactttcttatttctgtttcaagaacttttggaagtcatgtctggcaatataggcagctcaagtgtctggatattgaattatagtttgatcccatgatggagagagttgttagtaggtacagattatttgtttttattcttgacattcttcagcagaagaagttgaaaaactattaggggccaagcacagtggctcacgcttctaatcccagcactttgggaggccgaggccgtcggatcacctgaggtcaggagtttgagaccagcctggccaacatggcgaaatcccgtctctactaaaaatacaaaaattagctgggtgtggtggtgggcacctgtaattccagctattctggaggctgaggcaggagaattgcttgaacccgggaggcagaggttgcagtgagctgagatcgcgccactgcactccagcctgggcaacagagtgagtctgtctcaaaaaaaaaaaagaaaaaaaaaaaaaggctattagggatgtattaaaaaatgtgagatgttttagtctattatttagagttcctgcatagatctctgaatgccatctcttgaaagttgttgtttggacatggaagtaatgagtccttcggcaggtttgtgtcttaactttttgacgtttttttaaaattataaaagcactgtgcttttggcttaacattttgaaaacacagagaatcataaagatcaagatggaaagttcacccataatagctccacttagaaacactcttgaaattttagtggatgtgtcctttttttaagaaaaattacattttgtgtgcagttgaggttgtattgtgtgggcaattttttattctagtctgttaacttgccattgtcacttaaatatattattatgttttaaaaacttctgcataaatgtcattttcatgagcttcattgtttcccattgtttggctgttgcataacttttttttaaccagtcccaagtcattgatatctagattgtttcccacttttcactattataaagcacgcttaaataacatgttttgtatagaaaacacatttttgtatatttttgtattttatatttcctgaaaatagaattcttcaggccagaattactgggccaaagatgaacattttcaaggccctggatacatacagttaaattgccctctcactagacgtgtgtgggacggtcatttttctttgtgctaatttgtttgatagttttaggtttttaaaattatttcagaaaataactcaattttattaaaatgttgatacacacactaactaaaacatcagttttttttttttttttccctttgcatggaattcatagcaatttagttaggtagcactaattttctcacagctctgattggtagtttgatgtgttcagagtttaataaagtgggaatacaaataaattattaaaacactattctagacaaacttaaaaagaaatgatacaaggcacctctggtaattaaaaggttgagaacttctgggctggagggctttcatttctcactagtttttaatagaaatatgcattaggtgattactgagtactgatgcctggaataatgatgagggatccttccctgctttagaggagctcactttcaaggtagagacgtggtttacagtgtctggaactgtaagtgcactaacattaggcatgtgttggagtacagaagaatggcctgggagggagggggagaataccgggggaaggcctgggatgcttcccggaggacatggagccaagttaaatattttgaaccttctagaagttgacttttgtgggttaagcagtggggtggagaagaagagaatgaggattgctagagcagagttctaacactaatcagtggaatttctagatgtttccaatgtcttcacatcagaaacatggtagagtatatttactttggttgtcccttttaaatataagtatgtgaggtaatgcatatgttagttagttcttagccataccacagtgcctacgtatttcaaaatatcatgctgtagaccgtaaatatgcataccttttgtcagttaaaaaataataataaaatataaaaaaagacaaagaaaaaattgtatcttgtatgaataacttatagtcaaatcttgttttttaatccagtctgacagtctggattgtattgtttggattggatcatttaatccattcacatttaatgttgtgagggatataagtgaaactactgtttcctgaataccatgtttttccttggtttggttccttattttgattttttttcattttttttgtggagctgcctgaagtaaatttcttatatgtgaatttaaagaaaaattcccaagcttctctctgactttaggtggggtagtattctagggacaccaggtaaaggtagggctatgacaaaggcaaaatgagccaatatgtaaaagcagattgtgttgtctgctcactcactgagtgttcacggacttctcttggccttgggaactgcagcacttacagatgagggcgtctgtttggaaatagggaagaaatttatctaagcatccatggcggtaccgaaaatagtgagggagtttcattcctcaaacacttgttgggtgtctgcactattcaaggcatatttaatatacctatttgcacattaaaatcctttggtgaacttcttaaacttggaggtttccagggctccacctagacctacataatcacaatctccaggcatcaacatcctgaaatctgtattattttggtagacagatttgagatctaccagagataggaaggagggaggaagatggagaaaaaaatatttcttctatgcaaaacagtatgtgtgaaggaataagagtgaaagagggaaaggggaatagtgtgtttgatgataacacaggatttatgtaggtgagaggttgaaatagagctgcaaacgtgagttgcggatggatgatgaagattgtatcccaatgaagccattcagtaatccctaccgaggtccttctgccaaacactttgtcagttctgggggcaacagtggacacgtatggatcatttactctgacaggcactgtgtttaaccattttatatgtattcatttaattcttccaacaactttaagtggtagggtccgctattatccccattttacacatgaggaggtgaaacagagaggagaagtaacttgtccaaggtctcccagttttgggggagccaaaataaagccctggcagtctggcttcagaacccagtgggatgctcttgacctgttggctctaaccattgttctccagagagatctctgttacaataaagaatattatttcacatgaacactatggaagacacagaagtcacacagagaagggagtgattaactccatctgaaatgtacatatgtatgtgtgtgttaggaaaacgtcataggtaacagctgagcggggtattgacaaatgaagaggagttttccaagtgtacaaagtaggtaagaacataactgccagagggaattgcatacacaaaatcatggaaataaaccagtgttggttttggtactgcaatcaaggttttaatgcagagttgtggcataatcaaagatgtgcttttagaaaggctactgcatcaagagagctggaggtggtgggggatatgggacttgggcatattccaggtggaggtgttgaggctggcaggcaggcacagcctgggaagatgcaaaggaagggaaggatgtgggtgacagccaaaggagctggcacattagagatactccacaggtattgttttgcatgagacaaatggatcagggacagagcgtctgtaagggagaaattgccaggttttgaacaagagcctgtgggagactcacggtgtgattaacagaaataagacaggtggagaaagcagtatggggagcaatacattccgtttgacatgtttgagttagagatgcctgaggtacaactagtttgatgtgggtgtcttgctcatagaggtggtatctgaagccaaggctgtgaattagctcactgagggaggaaggatctttgggtgttcagtctctctgatctgccactctcctttaaagtgtaaaacagtgtgctgattttgacattctaggccgctgagtaccaagggatggctggagtgtgtgcagggtacaaatacctaaataaagatagggaaaccttgtatccacatctgacagggatgtcaagctgtacttgtcaattgtttattcagtgtgcacccaaatggcaaaattgtccaatcattgcaccagaaaaatcaaggtcaaaattgaagggccaggtgtctgtcggtgcaaaaagatacagctgcataactctttatatcctcagtacattttgtttctgacataatggagaagtgtgtgttggtgctaggtttcaattttgtgtttgggcactgtgaaatattctagtttgcatgtcaccagtgtgatatgaagagctttaggtatccatttacatttctaatcaccctgaaagatgttcgaatggagtcccaaatgccccagccaaacgcaccagagcctgactcaccttatgcttgaatttcctcagacataaaaaataagccttttggctatagatcaagaggttggataataagggctgatattaggcataggaatgcagtggcagggaaggagggctgttgtcagagaagtgaggatgagtatgagaaagcaggagaaattcttgtgacctccagtggtgatcctgaaagtcatcctaagataatttcatagatacatacattctgcactagtgccaaattgcagatggttgaggcgtgcagtaatatgttgatctcattcaccagcaccaaagcaccctgctatgtgagtacataaagttcagtggacatttaatttttataagagactggtggattcgaggggtggatgtgtctccatgtgtggtgtgaatgtaaacaatgaggcatttttatctccagattaggagttttgggatgagcctgtcaaaggggaagagaggatttggacaagtgccttaaggcaggtgatcaaatgtgttaataccattgtgggagtggcaaggggcaaaggaagaaaaaatgtctatttcttcgcttcacagcttgggccaagaagcagatggcagatttgacaacagtgcacttagcagaactgtcactttggaacaagctgccttgccaagttggcagcaggcacatttgggagtgtgggaatttattagacaggaattccagaccttggaggtgtggtctctccatgcaagtacactgggaaatctagctctcattaggaccaacgagtcatggtcaactgatttatctacaaaattgaggcataaaagatgatcagggatagatttttgtttactgaagggaggaaaggacctatccagacaattatattaattctccatttttttggtctctacttctaatgtttgaagttgtattgaatgccagaaataactcttatctgtggatcaagaaatttgactgttttttgccacctactagaggctcattaattggaaaattattattactctcaataaatcctaaggcatggggctttgggctggagataaaattatagacattttccctaccctcatgggggttgcaattagcagcagggacatggtggggtgtacaattaaatgggaaattaggatgtcatgtgatatatattctgttgggattaggttcaaagtacaatagaataaaaaagtgaggacgattaaccagtgttaaagggtaagaacaagttctgagggaagtcagccctaagcggaagctcatgggtgtatagggtgggaggctgccagtggaaggtggatggggtgctctgcacgtgtttctgagaaagagaacggtatatgtaaggcccggaagtgagagataaagcatggctagaacatatgtggaggtgtggatgttttgtagggtgaatgaaatcacgggaaatggtgggctgtgaaccttgggagataagaagcctcatgaatggccttgtttgctgaactaaggattttggactttattctgagagctttagggaccctgatttcaagcagggcctcatgtttgcacttaaaaaatatgtgtctgactgttttatggggaaggactggtgaagattgagactagaacatgagagagctaggaagttgtggtggtactgaagaagagggatgacgacagcctgaacaaagacagtgtctgggggcagagggtgaggaatggagaggaggaggttgacttgagaaacttaagaaggggacattgataggatttggacactgattggacatggagttgtgtaagagggagaggttagaaggttgccaggcactagggtgtgggagctgggatggatacccatgccattgccattcactgagaggagaatacaggagtggaacatatttgggtggggagtgaggttgctgcaggtcaggttctgaggggaaacagactttgacatagagatttacatgtactttattaggaagtgctctcaggatcaattctgggataggaatgaggtggtgaaggaagaagaattgggcagaaggagaagttaagctgcagtggttacagcaaatgccgaactcattcctacagggagctttggagctggaatggcccttcggagttgtcctcagttggagaaagggggccaggactgtgtaccatgttcacccatcaagagaacttcaccttgggcaaggtggctctctacagccctatacaagtcttagatctccattcaggggagagccgttagttgccaactgtcacagcagttgtaagaatgtatcctttgctcatggaagtggatctccatgtaccacagcatccactacagggtatgacgttaacttaggcatgtccctggactttcttcttcctgtggctaaaatggactagatgactactgtttgttttattggaagggaggaatgaaagccccatttctcacctggtcatcctctttgcctttcagatcttgcccctcaacatcgaagggggtctaggttctttatctgcaaacacagcacttgcctcacttagtaattatacattcactgatgttattatgtaattactgtctatttccctgattgtaagctccatgagaagaaagctttggttcttgcaacactatattaccagttagcatgttgcctgccctttagtaacactagaatattatttgaatgaagaataactgagcatcccgtgagaatcagagggttttataactagtaaaccaccagatttaatcagcccatttttagcagatacagatatagaggctctgaaaggtgaggtggttctataagaccaacaccgaattagtgggtgagatctcttagagtgcgtattattgcttctgttcctcctagagctggggctagaagggtcctcatcagggcaggagagggagtgaccagatacttgcttctttttttcctgttgaagtggatggagaatttggtggtgttatattaggatcatatcaaattgacatatgctgtacttgcttaaaagtgagtcagccagttaagtcaagaaatgagtttcagtgcaatctaaattgagtggtaggagctccgtttatgtttctctttgaaattttctacaagttcacccccgctgcccttcctggcagccttttgaactcacctttccaaaggcattctctctagtgcattgatctagcactttacaggctttccttgtatttctcacttgtctcacatgtgtatttctcacgcccactcccatgatcacaaggaagaagaaatggtgtccttctccattgtggctgaggttctgaggaatggaatatatgtgagtcccctttcacccagttcattttagctggagtgtctgaatcaaagctactgctaactgtactccacagcgattgccaccagttctttcttgttttagcttcttactacatcagttcattctctagttcctttggcaactgtaacattgaaataattgtatatcctggctgtaaaggccaggcaaacacaatcatgatgaggtctgcctgggagatttaagggttatcctccacacaattcctttcactttagacaaagagatttgtattgctcagaagcagagaatctaggtttctgtggaatctattggagttagaaggtacctctgaggtcattttgtggcacagcaggactgtctgacccatttttatgttttattacagcaaaatgtatctatggaggaaaagttcttgcagaaggccagcggattttaaccaagagctgtcgggaatgccgagtaagtgttaattttatggtccctatcacttctggaaaatgaatagatagatgtgtgggctttagatgaggttcttgagtggggcatattggcctggatagggccccgaggggtggaactctctgcggtgggttggattacatgatggcgaggatccagccaggccatttatgtggttagcttgtggtcagctgtggatcaggtagccttggaagaagctattaaggcaaggatgtgagaggagaaagaactaacagctgttattagttagggaggctggtgggtggccctgcgaaagggttttgagttggtattaggggaatcagtctgtaatgctagttatgataatactaactctactcccagagggctgatatactgttaaaaatgcctcttcctcctgcctgcccctcccatgcattacttgaaataagatgtataagatcatagatctcattcaataatcattcgacaaaaatgcattaagcaaatgctgtatgacagcattatagtaggttctggatatacaacagtgaacaaaacaaagtcactgtctttatagaacttgcagtctagtgagggagagagacagtaagaattaaacaaacgtataatataatgccaaattctataaaagtatgaagtaggctgaaggaatagagaggtctgagttggggatgggtggactgagaagatctctctgagatgtaattttgttccaaaattacattttgggtaaggtgtgggagccagccatgcaggtatttgggtgagtgattacttaaccaataattgcttcctaggtagatgagggagaaggcacgttccaaacagaaggaattgcacttataaatgcctaaagcaataaagggagcaggttttacttagggacctgcaaataatttgacttgggtgaagttctagagctcatgtgggagagtgatgagagatgaacctggacagttagacagaacaggtgacaatggacctagtttggacttgatcttaatggagatgagaattcattgaagctctctcttctctctctgtctctctctctctctctctctctctctctctctgtgtgtgtgtgtgtgtgtgtgtgcatgcacgtgtgtatgtcacgagcagctgtgcatttccaaaggtcactgtgattgcaatgggaggagtgattggaggagcaccagattaatttgaataattgtaagaaatgacctaaggttatgattgaaggcagtgatagtgaagatgtacaggaaaagagattcaagagctatttaaaaaatggaattgaaaggactcgagtgattgggtttggggaaggctaatatgatggagaggagaaacccagatgatgtccaggttcctggtagagttgcagggaataccagtttctgttttcccaagtagccaaaacctcccctggctaacgtaggtaaaaatgacaatgttattgaaatgatattgggggactcacagaatcctcagaaggccagaccaggcttgatactagatagagaccaaagagtcccagaagttaggaagcagaaaccatagcaatgacctagtagcggggatcccggcaagcacattgctgctgtgatgagtgactttcaatcatttctactgtcctggagtcacttatacaagatttaaagtttggagaaaggacatatgattagcaaagtttggatcatatgtccaagctctgattgttcaggatggggaagaattcgacccctttatcctctgtgtaaggagccagttacctggaattatcaccccattaagacagcatgcaatggagaaaaaattccccaagagaacactgtggtactcatgggaagggagactggatcagaagaagccaaaatgtgataaatgctctcttcattaggtgatgacgagatactggtgcaggaagaggaacattcaggaggaggaacatgttttgtgggtgaggagggagtgaagagcaaatggggccaggtttaggcatgttgagtttgattgtactttggctatctacacaaactctctaaaacttagtattttaggattatttctgtattttatgattatttctcatggttgcatgggttgaatgggctcagcttaatgattctcacttgggttcgcacatgcaattgcaatctggtggctgctgcagctagaatcctatgaaggcttgacatggctggctatcaaagatggcttctttacttttctgtctagcacctcaacaaagatgaatagaaagagacttctctctgtgtctctgtctggtgtgctcgctctctctctccctcccttcctccctccctccgtccctctctctctctctctgtatgtgtgtgagtgtgccttgttctctgcaacccctagacatggctaccttgggcttctttttttttttagaccgggtctcgctctgtctcccaggctggagtgcagtagcacaatctcggctcactgcaacctctgcctcccaggttcaagcaattcttctgccttagcctcctgagtagctggaattaagagctgcgccaccacacccagctaatttttgtatttttagtagagacgggttgttggccaggctggtcttgaactcctaatctcatgatccacctgcctcggcctcccaaagtggtgggattacaggtgtgagccactgcacctggccccttgggcttctttgtaccatggtggtctcagggatttctcacatgctggccagcttctcccagaataagctttccaaagaccaaggtgaaagcgccagtatttcttataaactggtctccgaaacgggaacatcattctgcattctaaaggctatagaggcccaggccagatttattgtagaggcagacaatacaagggcatgaataccaggaggcatgattcattaggtagacaggcatctttggagaccagctgtcataataagactttgtgatataattttctacttaaaaatacccacctccagccaggcgtggtggcttatgcctgtaatcccagcacttttgagaggctgaggtgggcagatcatctgaggtcaggagttcaagaccagtctggacaacatggtgaaactctgtctctcccaaaaatacaaaaattagctgggcatgatggtgcatgcctgtaatcccagctactcgggaggcagaggcaggagaattgcttgaacccgggaggcggaggttgcagtgagctgagattgtgccactgcactacagcctgggcgacagagtgagacgccatctcaaaaaaaagtaaaacaaaacaaaacaaaacccacctccaacatatcataatgggaagttactaaactaataggttagtggatttccatggctggaaaacattaggaatcagagaattcctttaattgggtgaaaatctacccccctgtaacttctgtccagtggctttacttcttccctctggaggataagagggtgagtctaattactcttacaatatagcattgtggttgaaaggtcaaaatctgcagtcaggtggatctgggtttaaatcctgaaattttacctagctgttagtgaagttcagagttccttgcgttcttttcccccattgggttccagtaagagctgggttggagaacataacttgagattattacttcctcctacatgatatttttttttctcctcaccattcccactgcaacataacggaagacaattataggcataatcaccagccctggaggaatgtggaacattttgcctagtgccttgtgccgaactgtcaaacctattccttttctgcctaacattagctgggacacactagtcagaatagcaacacttcttacctatctgatcctgatttctagaaaatagaacgcgaggcctaggtatttgtgttgatgctttatttatttattctttggtggtcatgggcgtggatagaggaaggggaagggtatagtcctaggaatgcaagagtgaggcacagacagaaggaagtatggaaggaaaggcaggagagcaagtacaagatggtgcatcacagaaaagtcagaaccccacaacaaagcacagctggctttgtgaggcatctcctgagaaggtgacagaaatcactgtgtctcagaaaagaccatcctcgcaagtgctcttacttacattgtttcattttcttttcaacacacctcttggaaaaaagacaggaatgtgttttaaagattgaaaagaatgaggcatttagagactttgcagaagcactcaaggagatactaatacaagaagagcttgaattttgttctttatggagagctgggaaggaaagacattccctatattctgtctctcattggccagactgtaccctaaaggttagcttccttgaacctccctattttgattcccattcttgccctcttggctgctgctgggaatgccagagattccatgagtccaggtggtctggtgggcatgcaggtgtggtggtctctctgcatcagtgggtactgggtgtaggggctctccactctgtggcaggggcaaggatggtgtgacaacaagggctttaatgatctcttgactgacaaggaggctcccagggttgggagtaggggagtaggggagtaggggagcaggtggggtggtcaataacctatagctggcacattatcacacaaggatgttgtgtagattaaatgagataaaacacatggagaacttagtagagtgcttaccacaaagaccatcctcaataaatgtgagctatttttgttattccatatgaccatacatgtccttcttgaatttaagacagataccattctctctgaacattgttttacttctaggaagggaaaacagttggattctaaaattgttgcttttgtctttgacttcagggaaagctgggatgattaaaggcaattttgctcactgtggtgatggtcccagaatcagccataacacttaaaattagcaaatccttttccattttgaatggaagctgtgggtgactctagcaagggtcactattatgattcaatgtctattatcaaagaggagccaggcagacaccatttgagacctttagaagatatgggcatggatttgaatgccagcttatttaaatatcacttactactattactggcacattgcagttgctctacacacttgggttcatcttttactgttttttttttttttaataatttagaaagaagttggggcagacagattattctcttgcacaggtagtgtgtgtgtgcatgtgtgagtgcatgtgaataattttattctgtgcaaaaaagttatttttccatttattgtctttctatagttatttactaattactttgtatacaagaaagagttattgacaataatttttaatatttcttgagcacttattatcttccaggcacaatttaaagcatctaaaacatatttatctcggccgggcatgcgggtcagcactttgggaggctgaggtgggtggatcacgaggtcaggagattgagaccatcttggccaacatggtaaaaccctgtctctactaaaatacaaaaaattagccgggcatggtggcacatgcctgtaatcccagctacttgggaggctgaggcaggggaatcgcttgaacccaggaggcggaggtggcagtgagctgagattgcgccactgcactccagcctagtgacagtacaagaccccatttcaaaaaaaaaacccaacaaaacaaaaaaccatatttatctcactgaaacctcataataattctgtgcagaaggtaatacccagatgtgaaaatcgaggcacagaagaacaaggccacataggtagtgagtgagccagctgggatcagaacctgtgtggtttggccccacagtctcctctcttagcctgtctactgccactcctgttattgttagactgacttggaaataattctcaattctgaattttagaggggtagattgagaaggattgtttgatcatttttcagtctatctgagaatatcagattggtcaggctatggcccattgattcccttgataaaggtagcatttataaaaggccatggaagagctttgggacatagttaatggatattgtcagcagagagtgagggtaatgggtataggatcaaagggcctcttatttctcccaggcagcttttctcaagatgtaagcactaatgccctatggaatctgttgtatgcaataaattaaacttcctcttaggcatctaaaatggtattatgaagtattatccttgggaggactaaggaaataattgctaaaataatttttgatattctgtcattcagttgacaaaaggatgcctggagatccacccattttcattttcctgggatcattttaaagcttcagcaacaccaattagtcaaaaaacaaactcttgtttcaaatattttcaccaagtgtttccaggaattaacataatttttaaaaaaaaatcaacatgaataaactctcctagcagtcttattaattttgcccaattattgcttttctgcagaatttctttatcctagcaacaattttttacttgaagttgtaagttttatatgttgttagaaattcaggttagtgcacaatggttagtacagaacttgaaagtgtatgtatttgaccaatgacatggagaaagccactctaaatgagaaagaaaaaaggaattgtatttttccaccagcgcagaactccaggggtcataaaataacatactataatcagaaagacttaaaatgttaattatcaggtacttcttactagagataggtttgaaaataaagctataaaaggtttgtgcctaattatgtagctggattaaatggatttggtggcacttatgcaatggtaatcacagttcatattatttttcaaattcatgcaaaaaggtttgtctccatttaaatatttgggattatgatcttactcattaaatatgttaaaggttgattagaactggtgactgatttaatcagcgaagcaaaccctttttataaaaatagaagatttgtgaatgattatttttaaaaaatcttctgtagcatttttaatattttgtttttacaaaaatatatacttatacaatttggaatatagaggggaaaatgtaaggaagaaaatgggaatcactcccgaatctcaccacctagagataatcttttaacagtttgatttttgacagcaagagtgaaatttattttaattgtcttagtttgggttctcccagaagcgaaccctgagctaaggatttcagtacaagtgatttattaaggtagtgcccccaggagaaaccagtgagggtgtgggggatgccagatggagaaggggaagaaactgagaagaggtacaattttagatgaaaggtcaaacataccgtaatcccaccatgggctctggagcatacattttaccctagagattgtctctcttcgaggtaaagaatatcccataccattcattcactggctttgggtcatacgcatgggagttgtagaacttgcatgtaacttccggctctctgcatgggcaaaatggctccattgcccaagggcagtgctctgagagtgacagaggtgagccagttgcagcaaagcattgataaacctagaggtgcgcacatagagctgacaaaaggattcaacagtgtcagccactcttatttatgccaggaggcagcagatcatgaataaatatattaatattgaaggatagacttagaggcaataatggtaagtaattcagcattgtgatttcctctacatttagctgctgatagtaaggttactaacttccattgattggtaataactggtttgattccctgttgtagaaagtaaggcacatcaggtagggacacttgccttaggactggagctaatttttgaggttagataccacccatcatggtctggattgaggattaaaaatgaagtgcagttgcaaagtggggcagagtgagtagcaggatcgattctcaggtcttagggacaattgtaagatagtcaggagaaagttaagagttaccttgggaaagattgggaataaagataaaaggagaagaaaagacaagactaagaatgccagaggctggcctgtctggactggaaattctgagaaaggagaggaagccatggtgcaaataatccaaaagatgagcagttggaaatttatatttgacatatacaattatgttactgttccaatttaagaatgggtattcctgatatagtgggagttcttgccaaaccagagaaatgtggaaccactgggatgacggtctcatgaagacggaaaactcagtctctcctgcacccttcttgactatacaccttcatcctattcttccacctgtgttgggaactaccttttggccttaaatgagatgcctcttcttgagcttgcttcctggttgacttaagcatccccttaaaaatgggagagaaaaagtaaatgttttagataaaataaggaactctcagcatttttaaaaaaatagtaattaatggaataatttttacaaattggcatcatactaaatacagatgctagtaatgtcaaccaaaaagaccttggatgaagtaaggtcataaagattcaccttctgaatattacacacgttattgtaagtgattttatatctagggaaaatctaatgctcagctaactgatcctctttcagttcattcctgcctacatgccttggctcttttcagctctttgccaggaaagtcccttcttcctttattccactaatcaagttccctcaaagctggtgtcttcataatttctccccacctgagcagagttaattattattctatgacacattataatacttttattagagcccatttttaggcttatgctgtgctgtatgttttgtggtttctagtttatgaggctttattcctccctccatccaaactgagaattcattaagagcaaggaagatttgctgtctatcactgggttcacaaagcctgttatccaggggcatgccagagctcacataagctcaattatacataacttctgaacattgctttcagtgataccatgttagtagctcaaaatcagccatcactggagtatttacatcatagaaattaggaaatgttataaattaggccccaccggaccaagagtcgattgttagacttttatcagtgcattgctgttagaatccttctgctccatagaagatacttcaaaactgttgaatttgaggcttttaggatatagaaagggaaatttaccttatattccaggggtctcattaatttaatttgtggcattatcgtttttagtggaatccctgggagtattaattattgtatgttgttatcactgcaggctattaacaaagaacattataagtttgttccattgactaaaaatgtgaacatctttttctttccctaatatttggcttccagggtggagttttagtaaaaattacagaaatgtgtcctcctttgaactgctcagaaaaggatcacattcttcctgagaatcagtgctgccgtgtctgtagaggtaagtgggcttggtggtgggccatgcgtggggtgaggctggggctggtcttctggggcatgagattttaatgaatagtatgataataacatgggtccaaaactctgtgcgctgctccttaaaaagttgcatatcctatttacctctctcagtcatagtctcctcaattataaaatgaggataataatagtatctactttgtaagactgctgtgaagattaaatgggataatgcataagcacctaccatcatgcctagcatgtgacaaatgttcaataaatgatagttcctataataatgctaatgttagttcttataataataaccattatcatcattattacatttttctcatgagtgagattgggaagcattcttttcagctccgtcttgttgggccagttcccatactctggtagagaatgatgtatggtgaatccttactcataggttagattgttatgcaacatttttactccctgcaaggaaaaatgcatcagataaataacacttggttgctaattaattattgggcagaaatggttttgcttcatcttcctggaattgccttcatcccaaaatttattctttatttaaatttttatttattattattattagtttagagttagagtctcgctctgtcactcaggctggagagcagtggtacgatcatagctcactgtaaccttgaactcctgggcccaagcaatcctcctgcctaagcctcccaagtagctgggacttcacaggcatacaccatcacacccaactaatttttatttatttattttttttttagagactgggtcttgctatgttgcccaggttgtccttgaactcttggcctcaagcaattctcctgtcttggcctcccaaggtgttgggagtacaggcatgagccaccatgcccagcctatttttatttttcaattgttatataatagttgtgcatattttgggtgtacatgtgatcttttgatacatgtatacaatgtgtaatcaaatcagggtaattgagatatccatcacctcaaaattgatctttgtgttgggaacattacaattcttctatctattttgaaaaagacaatagtttattgttaagtataattaccttactgtactatccaataaattccttttatctaactgtatttttgtacccattaaccaaattctcttcatattccctccccctttcccttcacggcctcttaaattgattcctatgtcttaaaacccagctcaagtatcacttcctctctgcagcttctcacccaagcagaattagatgaattaggagatcctaggatttgttcaaaatcttaaaaaaaaaaaaaaaaaaaaaacagttaaactcataggtattattttaaaactatatctaccataaatacttcagattctcaaatacccagtaagtgatatccttttaatctgagctttgaagcttccagagttaaggaggtccctgcagcatagcaatttagctcaggtaacctcatattttgctttttttttcctatcttttctgtagcagaggggtggcaaaaattctttataaagggttacaaaataaatatttttgactttgccgacaagaggtttctgttacaactaacagaagaaagttagcaagaaagcaacatagatcataggtatataaatgggtgtgaccatgttccaatgaaactttatttacaaaaacaggtggcagcctgtaactgttgacccctcccttagcaccttctggtgtatgaaaatgttgtatgtttcaccattgcatgttttcagcttaggctttctgtgtttggtcatgagagctctgggctttggtaaaattcttaggaaaatttagtgtgttgatagccagaaatggcccctagaattagtgataggctaactatgacatcagaatatcttccttgatttatctgctttcatggctatattatctgcagctggtatgttttggaaatacctaaagattgagtggaattttcagagtgatgcatttattggttagatagaatggttaggtaggtcttataatttaatgcaaaattcatcacttgctatttgttggggtgccaagtgagactcagtttatgtaaatcctttctgatttatggtttcattagagcagaatcattaattaggccacagaaattcaggagggatttcattgccctgacccaatttacaatagaacaggtgccactgcttctgttagcacttgtctggaatgtgtccattaccaatgaagatgctgagagatgtgacatctcattgacaagaagcagacatacaaggttcccgttgctagcaagcagtggcatttaccaaacctgactcaactttgagggaagagtgggaggcaggaggaagacttcatagatttgatcttaggcagggcccgtctatgaaatcaagggctttctttttcataccagttccttctcagccaggaaacagccagctcttttacttggaagctaatagttttctttggaggtatgtgtgtgtgagaaagttattttatgctctttgactgctctacatttggacaggaactagagcatgtcttcagaaaagaggtggtgggagggtgttttcccgggaggtaggtgaattaaccatttggatttcttctatattactcccatctcagagtcagactctgaagtaaaggaggcagcattgttcactgaggcccttttcagaaacatctactatcataaccttcttccttcttgctgacccacagcagagagaatcccagaacatccagcccacttgtccacatgctagggcctgctcttcccatcaggcaatcaggaaatgaaaggcatatttagtgagatgtctctttttcatgaaaccctgcaatttaaatgacaattaacaaagagcaatacagatgagttcaaaagtctgtcatcttgaactaagccccccatgaattttgctccacatctcttaattccgtctttaaaagtaacataatcatctctcacaattttgtgagaaatacttttcttcttatttttgccttttcctctgcatttctgagtggactcacaggagaagggggttggacaattactattctgacaagacctgaaaagcccagtggacttctaaagcaaattatttggttcttcttgcctcctccccttctccccttctctgaaacagaaagtaatgaaaagtcgagaaacactcaatttctatgtaaagtaatttgtatcctgcatatggaaaggcagcagcatcgtttgctttgtggactgattgtccacagactggttggcagcaaggaagcagagaggtgggactgagatgagctgaagtgtgtattttaggaaatgagcactgtggtatgctatagctgtactgcttctgccaccctgatgttgttgattacaaaaaccaaagtggctgtggcctttcaacacctgcaccgaaggcctttcaattagcatatttatcatctctctcttactgtgaccatccggtcattagtctgagagaaattaccctatgacggtatcattcctcagaagtctaagtcaaaacctttctcatgcctgcctggagaatttgaagttttccaaggtttattttctttaggactctgatgagtcaccttacctggggaggcctagactgggaatttgagaaaacttccagagagtggattttgctcactgtcattgtcatgttaatgaatgaatgacattattttcagcactagctgataggctttatatattttacatatgaaataaggttaaaacccatttttctgagttataacttatttcctcaagttatagcttgctagcttgattatgaagttaatttttttttaacttagtcttaccaaattttctcatatggttactgtcccccaccccacaattattgactaatcaagatggaagatacaggctacatctttacatttgattttttttctttgtttgaattaaacctaagactttaaagttagtaagaacaggttctgactgacttatggtgttcactgtatcaacaaactggtctccaagctaggggctcagataccttgcctcttcaaattttgtgtcatgtcaaatgctgtaactaattcccttgtcttttagggaaaaatgaatataaccaagtaaacagggggtttaatccacagggctgttggagcagctgggacacccataggagaagaactatagaattggtagggaagaaacacgcaaagggaatcaaggtgatggatactggcggggagaggccactttgtagtttgtgggactcatggtctcagtcacacaacagcaccacccagaacatccttaatcaccactgcagcttttctctgatacctcaggacagtttgtgctggcaacatgaaattcatttaccctcctctttaccttgaggtaatggatgtagcaggagcctgaccacttgaagtgtgaggccattaggtggagaaggggagtgtgcactggaataacatctgggctcctgcctgggaagaagtaataaaagcatcaatatagacccagcagaaaaagactgctcgtgaatttctggtgctctcagttaaaggatgaaaaaaaaaaaatgtcaacaatattgaccatgtattctcaggaccactccaggaaaacagacccatcatttgacccatcccggaattcttgacatactcctcagggttttattcccctggtaatcagctctaattgtatctttaatgttgccaatgacgttggaggattttgctgcatgtttatgacttctagtgttgggaaaaagttctttccgacatctgttccaaatgcgtttatctgtaattttaattcaggctcacttgccttgtcatctggcctggacggaaattagttgagattatttgtactgttaaagattttatgtccttcaattaaaccctccctaagagtcttggcatcaaatgattttcctcccacccagtcttcctcattgttttgggtgaatttataattgaaatggttttagagaaaggatttcagggaatttgagaagaaaagagacctgagaaaaaggcacttaatgagagtgtaaactagtgcctaaatagaggaactggcagttcacagatggaccagttcctctgcatattgatagatgagatctgatcaaaatgccatcaactgtgggctaaagtggactggaaagacagggctatatgctcaactgttggggctgggaacagaggatagtcttagtgagtaaatgaattcatggtcctaaacgtgctacagtggatcaaggtctatgaagcttccaaaaggaggcacattttcccagagagaaaacctgacactaaggctaggctgcctcagaccttaagggaagacccttaaatgttgactactgtggaagaaaccaattgctttctaagctagaacctgtgagagtcgggagttcagtctctattaggcctgtcctgatggccctaccttctgtccacaaaagcttaaggattattctcactttcaagagcccaggcttctcctgtgttatgtgtattgattgtggagtacataaaggcatccagttctcataaaagaccctttggccatatccttcttaaccagtccatgggtggacctgactgtacatctgaggcacatggaatatgctgccctcactataccattgctccttacgtgaatttcaaggttgggtaagcagtagtgaatatgagaggtattgacgttctaagattttagaatagaggactctggagtgcactttgagattgtccaggtatataatttcaaaggtaacctgcctgacctgctggggtatactttaggggcaggagattgaggaactattagtgacccatgtattccttgctgtggaagaagttacgggagtgaatcataacgatgtatgtctatcattggctgcaaaagcaagagattaagcagaatcagtgatgattccttgataactataaacaacataaagtgggatttggagagtggcagtgtgggggggcctcagtgtaataggcagagcttattatatgcagattaggctaatgaatttaatgaaagtaaatcattttactagtgttactggtcattcatggcaacagagctcgatacaggaccaccactgcatccaaattttaggctgcttccaaccagaggagaaagtgtgaccccaacatttacattttctttcattaatttctttgtacatatcacgggcccatgctgctgtaagcatttggaactcttattctttgtccagccaacctcattcatccttcaaatctcttctttaaaacattgtgttaggtttcttctctgcatacattcctagagcaccttgcccctctccatcatgatatccccttgtaacccaatgctcaaagacagtcacccctgctagaatgtaggatgaatgcggacatgtttatggtattttttgctgtattcctattgtctggtataatgcctgcacatgtgctaggtgcttaaaatttgctgttcttaggaggacagtggaagaggacagtgattaagaattccagcctcagtcggactatggctctgtgtaccttccacaagttcactgccttcctctaacttcagttgccacatctgtaaaatggggataataattcagcttcatataattgttataaactcttataacaattttatgggataatgtatgtaattttatgggataatgtatgtaaaacacttagccaagtgcctagcacatagtatgtgttcaataaatgttaattattgctgttattacatctgtagcagattatttggggttctccaaacttactccttgttctttcttcttcctctttggttgtcattccatttctcccactaggatctgtgtcctgctcctatcaagtttctacctattacagttttttgttatcttgaaatgatttatccttctctgaaacactatgacattttttcctgctcacatctgacttaacaaagattgccttgattgaggccataggtggtttattgccccttagggattataatttccctgcgggcagagaatatcttaaacatttttgaagtgtctccagataattatgtggtgctgcagcccacagagtagaggccccataaatattgagtgaatgactattcactcacttgtgcagaaaggtaagtgggcatggaatgaatattgcttgaataaaggcctccattaatttaaaaaacacatttttgagaagaatggttaggcataatcaaagtggatttgacctgaaggtgagtttgtctcaccggcccttcactgtccttgaaatacaatttactcaactccgggcatcatgatttgacatggtacatgcttaatagaaacatatgcattggaaaatcaacactgtttgaagggctttgttccaggctgtcagatgcatgtggaaagaaaaggacagttaaagtctactggaaagaaagagaaaagaaacacagacaaggaatacgtgtgataaaggatgcacatgtgccgttgagtcaagcttcctaatgaaggaaaatgtgaccatttaatctaattattgatcaattcagacatgggaagtgaagtccaggctcctcctctggaagagagacacgtgatgcctaaaagtacccctttggtaggaaaaaacatcaagcactgctagttttaatgattattgtaagcctctcaagcccttatagaagtgttgtcaactgtcagaggtttcagatttccagccagttagactcttgctctgatttttgactgaggcaatcaccagttaacaggtcataagtagtgaggctggatgtaactcatctaggcctatgcatctactctctaatgtcccaaggagtggctacctctttcacttttcataaccaggttttgctatctgagaggatatatgacatagtgagaagcacatgggctttggagttagccagacattatttagaaccctggcatttccactaactacctagagatttgtgaatttgtactttttatcttgaagttgaggataacagcattaagttattttgaactttagtcatgattgttgaaaatatcatcatcattattagtggccaccattgactgacctctttaacaggtataaggaactgtttcaagtgccttacatggattagcccatttaagtttctcaacaacatattaaaaggtatatattattattcccatttaaaacacctagcatgccaggcatattataagtgcatgaaacttatcattattatttaataacaatattattatctttcagaataaattctccaaatattgttggtttaaaattttatttcaaaaataattctagaatgttatcactgaaaggaattaacttgactttatctagtggagtgatttccatatttttaagccaggaactgtaattaacatgatcagtatgggccaggcacgatggctcatgcttataatcccagcactttgggaggctgaggtggctggatcatgaggtcaggagttagagaccagcctggccaacatagtgaaaccccatctctactaaaaatacaaaaattagcccggcatggtggtacacgcctgtagtcccagctactctggaggctgaggcaggagaatcgcttgaacccgggaggtggggtttgcagtgagctgagatcacgccactgcactccagcttgggtgacagagtgagacttcgtctcaaaacaaaacaaaacaaccatggtcaatatgtcaaaaatataaaagattattctatttgaatcagaggcagaggacttgaaccctgtataacaactcatctgtgcctagggccctgaggaacacagtttaaaaattactaatttcaggctgggtgcggtggctcacgcctctaatcccagcactttgggaggccgaggcgggtagatcacgaggtcaggagattgagactgtcctggctatcacggtgaaaccccgtctctactaaaaatacaaaaaattagccgggcatggtggcgggcgcccgtagtcccggctacttgggaagctgaggcaggagaatggcatgaacccgggaggcagagcttgcagtgagctgagatcacgccactgcactccagcctgggcaacagagcgagactccatctcaaaaaaaaaaaaaaaaaattactaatctcatccgttcgccatatgcatacctagaaaagcaaagtgatttatactgtttgttagctgcagatcctaaattataaattcgatctcctgacttctagatccattgttttctgtgagaacacagtatgtgatatagcataattattgtttactaaaagtactgatttaaagatgataaagcatctttatatactttatcatatttgaacttctcaaattttatggtagatgttacctattccttctagttcatctaaaatgctgcctaatatagaaacaactttctggaacatttggtggagatggcagtaagggggagaaaaaaaacaactggagaccagaatatagaaagagggtgattccattgaaataagcaagtacagtggagttgacgtttgccctgagtgcaatttcgagtctctggtggtttaaaatatggcttctagtggacactgtgtaagcagacaggagacatcctggggctagtatgagaaacataaatcaagaaccttaaagggtgaatccctccatgggtgaactaggaaaaatccactctgcccaaagagacttgcctgtcagtcttgactctagatggaggtctagaggagaaaatcttgcattcctaaaagcttagggctagactttattccacctgtgtggctcaaccttcaagcactaagacaaaaatgtagttgaaagtcatcttgggttgatagttccctcagacccctgacagaaggaaacacaaatcctctctgaagaaatgcagtttaaaaaccaaaacctcaaatctcacacattaaattccaaaaaatacgagcttacagataaaagaataactcaaaacacaagagaataagctatcatgcatgctattcagcataaacaacaaatggcaaaattagatgtgcaaagcctgaagatattagaattatcaatataaaatatttatatgtaacatgtttaaagacattttttaaaaaggaaatttaaaaaaatgaaagaataagagactatcaaatttgactaagcagactgaaaaagaatcaaataggattctaaaaataaaaatacagtaagtgaaattaaaaatgatgtgggtgactgaaagagaatataacacacctcaagacagaattaataaactgaaagatacatctcaaaatgatgcagaattcaccataaaggaaaagaaacagaagatatgaaagcaagtctaaataacacagatgagagcttgagaagaaagaacatttatctaattggaattccacaaagacaaaatagagaaaaacgtggaaagggaatgtttgaagagagaatatctaagaattttccaaaatgatgaaagatttcatcatctttcagattcaagaatctccccaaatcctaaataaaaatacatttatacctacatatcttagattaaaactgaaaaatacaaaacaaacaaaccccaacaaggctgggtgtggtggctcatgcctgtaatctcaggactttgggaggccgaggtggggaaatcgcttgagcctaggagtttgagacaagcctgggcaacatagtgagacttcatctctccaaaaaaaaaattagctgggcctggtggcacgcacctctagtcccagctactcagttgccgaggtgggaggatcactttagcccatgaggccgaggctgcaaagagcaacgattgtgccaccgcactccaacctgggcaacagagtgagactctgtctcaaaataacaacaaaacccaagctaacacacaaataaaaaagatcttaaaagcatccacagagaaaggggttgccacatgtaaaggaatgactattagattaataagtgactcagcagcaataatagaagccagaaaacatggaatgacatttttaaaatgttgagataaaataaccgtatacccagtaaaactattttttaagtatgaagatagtctaaagacacatttagacaaattgaaattgagcacagtcactatcaaaagatactgaaggaacttctaaaggctatattaggaagaaaaatttcttggaagaagtagcagggaacaagaaagactgttaagctaagaaaatgttgaacatgtggctagagaatatgccccaggaagcatgtttaagaaggttttttagcagctttgtttctcagtgaaaacccgcaaatagctcaaatgtccatccatggtataggcataccctggagatattgtgggttcggttccagactatggccattaagcgaatattgcaataaatgagtcacacaaattatttttgtttcccaatgtgtttaaaagtacagtccgatggcattttactcactggaatgtctttcaaaattggtgctgatcctcctgctttgtcagctaagtttatataatattctaaatcctttgttgaatgaatgaacccatagctaaaggcattcacatggatgaatagagaaaagcacaccatagtatactaaaaataaaatggatgttggcgtggatgtggtgaacagggagcacttcttcactgctggtgggaatgtaaactagcacgaccaccatggaaaacagtgtggagattcctgaaagaactaaaagtagaactaaaagtagaatttgatccagcattcccactactgggtatctacctagaggaaaagaactcattatacgaaaaagacacttgcacgtgcatgttgatagcagcacaattcacaattgcaaagacatggaaccaacccaaatgcccatcaatcagagtggataaagaaactgtgatatagatgatggaatactactcagcaataaaaaggaatgaattagtggcattcacagcaagctgggtgagattggagactattactctcagtgaagtaacccaggaatagaaaaccaaccctcatatgttcacattcataagtgggagttaggctatgaggatgcaaaggcataagaatgacatcatagactttaggaatttagggggaaaggtgcctggggttgaaagataaaagactacaaattggatgcagagtatactacttgggtgatatgtgcaccaaaatctcacaaatcaccgctaaagaacttatgtaacaagacaccacctgttccccaaaacctatggatatgaaatattttttaaaaaagcataccatagaagatatatacagtaagatttccctcatatggagtttaaaatgggcaaagctaaatggtatattgtttaggcataaacacaaatatgaagtaaagctataaaaagctgcaagggagtgattagctcaaaattgaggatagttatctctagtggctgggagggagattcattggggaggtacaattaaggagttttgataatctggttgtattcattttattttatatattcatatatattaattttattactctttgtattataaattttacaagaaaacaaaattataaaaagagtagtcatgtaagaatgtagtgagaagaggatgcaggatcagcatggataaaagcattcaggtaggaacagcctcagcaaatttgagtatgggtgggggaaagcctcttacgccttggacagcccaaagtttcctatatctattctgccactttcctatccagtttatccgtgcatactgccaaagtgtattttcctgcatagtgacatataataaaaaatgttacatactttattttggggagttactttatttcctccttttctgatgtacgtttttatttgttttttctaggtcataacttttgtgcagaaggacctaaatgtggtgaaaactcagagtgcaaaaactggaatacaaaagctacttgtgagtgcaagagtggttacatctctgtccagggagactctgcctactgtgaaggtaagtaagctatttaatgaagtcacttgtgagaggttgactgagaagtgtatgcctggtagatgtggttaaagagtgaaaactatcacttggctgtggtcctatgcaatcctataagaaatcatatcaattgctgagggttctctgttctcctggtttatccatgctgctcagtagcatgagaaagcaagacctttgaaggtcgttatgaagcacggcaaagaagcaaaggcaacagggacatatcaaatcccatgttctgctgctgtgcacataacaatcactagatcaaccatagacacatcatattctgttttcttatttgatgagattgccatcttcatatttaattaaatgtacagggtggtttctgttttcaaatgatactttgacattaactcatactaggctgctgtctccttgacctgacaagatcaggtttttattctttttagtgggtttcttcgtgactggttcatgcattgccaattcccaatctctactaaaagtcacagtaatggagggactcataactttggcacatgggctgatgccattacagtgggatggtggcctcaagcatcaatgacccacatttctgctctagagaaagcaactcctccgtcttaagagagcaccgttttttcaggcttagtactgcaacctgctagtggtgagcattgcatatatctattaccttaacatgccagaggagtgggagttagttcgacctggtctgtatgtatagtaccataatatctgagcccatccatttccaacgtgctcatggctcccttccatcagtttgcaaaagctttaataagcaaagtgatggctgggctatttttctgtttgttctgattccaattattcctgctgtcttcattaataataccttgcaccatgatgatttgggtagttgtcttcaatgaatgctgcaaattcctggtcactttcctctaagtggtctggctctcagataggtcaggtattctaaaggtaaagacagtattaactgatgatagtaatggtaaattctttctattctctatctcatagttgaccctcgaacaacacgggtttaaactttgcatgctgacttatacatggattttttttcaacaagacacaagtcaaaaatacagaattcatgggatgcaaaacctgcctatatgggagagccatcttttcctatagagtggattctgcagagcctactttgggatttgagtgtgtgtagatttgggtatacacaggggcctagaaccaattccctgcatatacccaggaatgactatatattgttaatccctgcttaactttttggctttgactaaagacctctagttatcaagaggatatatcttattactactagagaccagtaccttgtaggaaccctctgtttttttcatttcttctggaagactttctttgttactaccataatttttattaacaatatattctaataatatataataattttgtcttcttatttttcactgtttttttggcttgttttatggatttgaagttttaaggagacatgtcacttgggagaatgaaactgtccctttgcttatgaaccttttcatctgccctttaatacatcttagttatttgttaatttggggtgatgggagtatcaatttcaatacttcatattaatatttatgtttagatcttcccttatgctattttctatcagaaaatttaagtaattttaagaattaaaaatgtgagtattcccactatttaccatggaaaaatcctgtaagccacataatggtctaaaatatttaccttcttaccttttcctatatgcagggatagacgtcgaacaattataaaaatgatagaagaaacctcaaaaacaatgtgaatcctgattacgccactggcagaccttttagttgtttgttgaaatcagcatagccaccattcctgaccccacttctctattgagacccagcagaatatgagacaaaactgctggtgctaatgctgtttgggattctttgattcatttctcattgatgtcattttttattacaaaagactggctccatgaggagccatctgcagtatcaacctgatctttctctatgaggccttattttataatgctgagtggattttaggtctgaatcactgttttcttgggcatgctcctgtttagctcagtgtatgagcctggccttaggccagtatgcattgtggtgctattgcggttgggtaatggcaatgtgactgggcttcagtcatttccttgttgtatggagactttccataagctccaggggatgtgttcttggagagaaggatagcacctaaggagaaatggctaaacattggacccctcctagcatgtaggaacatagctcatgggttaaagcaggggtcaaatactgggcatccggctgggaggcacagagaacccagtagagtgaatgccaacatttagagcagatgcctttctcgcattccttctgccatcttcagcatttgaactttgatctttgggcctatgtttccgtgattgcatgatgacttccatagctctaagaatggtaccctcacagcagcatcctaagcaaggaagagaggaaggggcagggcttaaaaaccttgtctgtgtgaggttctgtcattttatgctcaaagaaagtccttcgtagaaagtcattccccaactctacccctattaccaccataaccacatgcagaagacttcccctgtgttatttttcagacccaggttacaccacttctatcctcaccacacacacacttctagaccgatgtttgagaaaggagaatgagatggccatcactgctttgggctaattgtgtttattccctggagctggaggagaggtttgtcttcctgaaaccaaaagagctttgctggttacaacaaaatagggttttaaccctattcaataaaatagggttttagcaaccattcttttatgattacatttagatgaattaaatgagataaatggtcatgcaggccatttccccagctctctcctaagaattgccctttgaagtgatcgggtagacaagcttacagatggccaaatgccctcctaggaacagagactctctgaggcttcattcgttgtctctccacagcctagaaagaagtaaatacttatgagctgcttgaagcaagttatttttactctgagtaaatgggatgaaaatgactcatacgataaaaaccacagtgaacaagactggcttgcaaattaaaacaaaatattacacacattgtccaggccatcttgaaaagcctgttcaggctctcagtggaaaaggaagcaccaaaggctttcaattttcttaacttcctaaggtagaagcagagaggtggcatattggctcctgctctgtagagattgtcgtagaaactgccgtagagaagatagctgaactcctggccaatcaatagaagataataagaccttttgtcagctatgatacaattcacaggaggctgtttcattttgccttttctgactccaggaggagcattctccattttgaaaactgctctagttggattttaatgttttaggaatcttgtcggctgaggctttttccttttttaatgacattttcaacaggttggtcttaagtagtttctgatgcattaggagtagtgtctgaggaaagtatagcaataggggccctactcatgatcttagttcttgaatttggagtctacctagatagagtctcataaactttttctttctgtgataaaaagttacttagaagcataaagaacaatgtaatatcatacacatcatgccatctgtcaggtgtggaaagcactacaattaacattaaatgataataccttttacttgcagagtgttttaaatttttcaaactccttttatatatgttacactttttgaacgttacaatgaatctttgagaaagttgcggcattggccacattaactccattttatgagtacagacaagaggattcagagaaatgaagtaaaaagatgatcctcaactcatttctactctagagctttctgcctgacttaaatgctccctcttcttccactacccacactgttccaatactgtgctagtgttcaaaatgttggttgccctcccgattttgccgacatcagttttggctaatgaaatgtgagtggacgtgacatgtagtttcagagtagaacctcaaggagcttttgcagaattccacatcgttctcttttctctctgaaacaaaaactggcaatgttccaggtcagggcttctcctttagctgacatcccagaatgaagatgacatggaaccgtgtgacaactgacaggtgatgggtatgtggcatgagtgagaaataatcttgtatgccactgacattggtaggatttgggggtggggagttatgctaccttgtgcgtaatagcgtaagcctacgatatgtctccctgaattaatggatccaactcttgtgggttcagaaggataccaaaattcagagctaacaactgaaagcagtttttaatagagcaagcattgagagttaccaaggtacaaattgttgagtcatcaggagtttgctctggcactgctgccaagcaacagattttttacagaccacaagttataaagcaatgttttgtcatgccaaattcaacatggtaaatggatttcccaattaagatgataatgaaacagtgcatgtcagaaatttagcaaattgtctggtattcactaaatattgaatagatcacagttattattaccattattatttacttaaatcattaatgtttatgaggatctttcttggaatttgcaggagtgtgtgctcattgagaccaatactttgagaaagagaaagagaccaaattggcaggtagcaggggagaatacatttagatggaaggactagggttcatcaattcttccaggtgcatattgttagcagtggggcactaagcctaataatgtataggtgaactcattccttccttggaaaaacacaagtggaattgtattcaaggaaatattttggaaaaaaatgacctgaattggtatgaatttagtaatttcatgtaacaaaactgacatgtctgaaacagagcagctgattagcaaggtgatttataacttctttcatatgactagaggtggtggtgaagggtctgacccttagaatggtaagaggctgggaaagtggtagagagatcagagttcaaacagaacgcagcccacagaatacctaagtgggtagatacttactagacatggagactaatgtaaatgcacttctatagaaacaagatcctgcaaattcttaattaagagattgtgtagaggaaatgggctagtttacttaattacacttctaattatccaatatttaggtaacttcttttacatttaaatattttgcattttataaaatgtgtgaacatcatgatctacatagcccagtttcttctcaagtgtgggcttcagtctcctaaagctctactttagacagcaaagcattgctttagttcgttcatgccgctgtaacagaacacctgaggctgggtaatttacaaagaatggaaatttattttctcatggtgctggaggctaagaagtccaaaatgaaggtgccagcatctggtgagggcccttttgattcatcatcacaggtgaaaggcagaagagcaagaagtgggcaagagggggcagaactggcctttttatatgagggcagagccatcatgtcctaatcacctcttaaaagttccacttcttaatattgttacaatggtgactaaatttcaacatgaattttggaggggacaaacattcaaaccatagtagagatcaaaagcctcttctgattggtcattgtcagcaaaaccttaattcttagttcctgctcccatttatttccagatattcagaatgcttgagataagaataccttggggtatctttcttttctgttttctcattagcctgcctcactaatggagagatcttccagtacccaggtatctgtcaatccccacctcccctttccaaggcacagagattcctagcctttgctttgttctggataactaacatgtcatcttcctcccagcaggagatgcagctgagccttgttcctgggcctggcttttctctgcctctgctttgttatttcctaggctacttagccaaagtgcatctattcctgctctcctacccacttgaaatcttcttaaccatcacctccccaccccctgccgccccctgccccgacacacacacgattttcttcttgaaagtataacacaaagaaaaataaagttcaaattcaaatcctggttatttcacctagggttaaaagaaggggtaaattcctaagctctgcccttaggaatgaaccccagtcaaactaaccggggcaatggtcaggatggaacttcaaatagcactgttttgtttttgttttgttttattttatttattttttaccacgcttcatgcttcaaaaatttatttgcaagatatatgcagaaattttagttatttctttgtgacagaagtggtgtaggcattgattaggttttcaggccagttcatagaagcccagggcataggtatttactagacacagagactcgtgtgaatgaacttctgtggaaacaagaccctgcaaattcttagttaagagattgtataggagaaatgggctagtttgcttaattatgcttctaattattccaatacttaggtaactttttttttttacattttttacatttaaatattttgcattttataaaatgtgtgaacatcatgatctatgtagcaccacgatcttcatgtagctgaagtattgtactacaaagatatcctgagttccagggtgttgaaaacagagaatcaggtacttttctcccaatttcgggtaagggtacatccacttagttgctcaggtcataagacatagacatcatccttgattccactcttttctttatccccaacatctgctacatcagaaagtcctgttagctttacctccaaaattaatcacaaattcactcatgtcttgctgtcttcaccactaccaccctagaccaagcttcctttatcttttggctagtgatcccagtagcatccactcttgcccaccatagtccatcttcaaacatatttaaagtgagctttttaagtgtaagcagattatgctactctcctgttgaaatttgtctcatagctcccatgcctcttagaataatacccaaatttggtcctgtgtcaggccctatgtgaactggaacctgcctacttctccaaattcatcttgtttcactctctccagtgtttactcttttcccatcacactggaattctttgcatccctccaataggcctgtgcagtagttctttcctcaacctgggaggcccttcactcagatctttccaaatctgctttccaggccttgttcaatatgtagttcaaatgccacttctttagaaagatctctcctaaccacgctggctaaattagctctgctgctatcatcagttaccccctataccatttgaatttgatttaatgtattttctttgtagcacttattctttgaaattgtgttgttttcttatgtgtgtttttctgtttaaagttttattatctgaccctttggaatataaactgcatgagggcagcaattttattttattcactatctctagcacctaaaatagtgcatggtacattatagacacacaaacatttgcttaaagaaagaaaggaaggaaggaaggaaggaagacagtgcttttctgtatctgacactgttttcttatgtcaagttcattttactagcattgctcaagggctgctttttaaagtgcagagtctgtaggtcaggggctgcttctgcccacttttgctaatactcagttcatgtaatggtgaaacgctgtgtgttaactttatttcatatgaacgtcactgcctttatttgctacggaatgcctttccttcactacatgacaagagggtagctgtcccttcattttgataaaaagataatggtttttcaaaaaatcattttatcagctgtttatagaaaattggttttctatagattttcaaatggatgttccagcttaacacgtggctcccctcaaaaccatgattcagggaccctggctcctttcctcttgtggtcctagcatgggcagtatgtgcctctcaaggtcaccagggaaggggaaaagaatggaaggttaccagtgggaggtttttatgggccagggctgttcacatttcactggccagaactcagatggtggctctatctaactgcaagaggggttggtaaatttcgtctagctgtgttcccaggaggaaagaaaaatctgttttggtgagtggctttttgatcttgccagcttttccagttatttaatgaaaaaaatctcctcattaattataagcgttttactttttatttatttcctttttcccataaatgagttctagcttcagttgattgtgctgaagcttgctcacttggagaccagataggatttgactacttaaccatgcccttttcactttcctgttgtatcatctccaggcttccctgtgccccccactgtatcatctcatttggatttattctatcctcaatattccttatgtctcaaggtgacccatctcctttctctccaagcaaaattcacagtttcccctgtgctgcagttctgagttttgtgctagaaagaaagcaattcatggaacaagcttacacacatttgtaaatgattgatatccagctaacactaccagaggtaaatgtattctttaaagaggatgctttataattaagagagtcttcaaaccattaaattccaagcaacatagcaaaagaaagtaaaaattaaagtaatgtgaacatggaagatagaactgcttagaggactaagcagattgtctctgcctgggagttggtcttggtggtcagctatcctcaaatatttctgttttctaacatttttcttccctccatttttttcccctgacaactctcaggggagtgatgtagtaaagaacaaagcaaaaaacattgaaatagggacaagaagattttgatggatcctgactctatcatttagcagccgggtaacattggagagtcacccaattcttgtgtgttttggtttctttcatgatctaaacaggacttttcaacaaggccaaaataaaggccttactttaccaattggttgtggaagctaaataagatattgaatgtgaaagcattttgcaaaggctaaagcagcatagctatgtattgtaacattatttataattatattatcatgcattattataccaacaatattattttagtcattggcagtatttgttctagaacactagaacacaggtctttagatcttcatggcgtatataaatatctaatctatctctctgtccatccatccatccatccatccatccatccatccatccatccgtactctgaacatagagatatatctaccaacatgtatattgagccatagtttgtgtagagtcattgtgggctttataaaagtggggcttctgtgttgtacaactccatggggcatcatttatgtagttgtctaggtgagtggcagctgctggaattatgcagtataaagtctgcaaggttgtacactgcagccctacgaaaggcataaaggaaagggtcaggcccagagtcttgtctcattctttaagtgaaaattaattgaccatctattgtggctgggtcttgtgttggctaaagatgattaagccatagatcgtatcctcaaggagcttaacagtttaaaagggggaaaagagccttgtatcagataagaaaattacaataggatttgttctatcctaggatttaaatagtgttgtaggaatacaatggtgagagcaatacattctgccaataggagtcagcacaggctgcccagaggaagtgacatttgaacggagttcttaagaataagatgttctgcaagaagaggtatgcaggaaggccattctcagtagggggatcagcagatacaaaagctcaaagtgagaagtttgacatggctggaccaaaggattttggtaggagatgagagtaaagatatggttgatagttggatggggaaaagcattttgaatgtgctaagaagtctaaatttttttttttgtgggccagtatatacacatataggatgctggtatcacagtgggtgcaaaactggatccattgggttatggaaaaaaaaattagaacttttatttatgcttattttcatctcatcctcaatgaaatagttgttgtctcgatgaattttcaaacatggctatgatgggtaagaaggagataaagcatcgttgaggtcataagaatgaacttgcatggccttgctttgtgtctgtccccaaactctcgcagtcaggctgcatctgattcttgatcatgtcttccctctgataactcagatacctggcatttttccaggtgaatctatcttgctctgcttgtggctggatggtgcccagaagccaagcctatgtgtatggccttacattattttttagtgatgtaccttcaccttaaaaaatcatgctgagacatttttttggctcacttaataatattttaggactttagcatatctccttgaaagacattatgcataaattatgttatttatagtgcttagcatttttatgtagcaaaaagaaggaagagaagaagaaaaaaacagaagggaaaaacgtccctgcttttcagggacaagtccaagttttagagctttaaatggaaatagaaatgtagtcgctttaaacttttttggttatttaaaaataatacctttcaactatctctaagaaacctaatatccagacagaaatgagaattgaactcactcagtttttattgtactcttgttattgcagctggtatgttactgcctgccgtgactcagcttcctggcgaagcttgcctgggtaaacaattagagaagaataacacaggtttagtggaaagtttagatttagatttggggtacctggcttagaaatcctggctttatcattgttttgtgaacttaagcagggaacttcatctctcatcattttccctttgtaaaattagtgtgctaatacttatctaagtagtctttttaaagaattgctataaagaaaatgtagcacatatagcccatggaatactatgcagccacataaaagaatgagagcatgtcctttgcagggacatggatgaagctggaagccatcatcctcaacaaactaacacaggaacagaaaaccaaacaccgcatgttctcactcataagtgggagttgaacaatgagaacacatgagcacagggaggggaacaacagacactggggcctgctggggagcggggtggggggcaaggggagggagagcattaggacaaatacctaatgcatgcagggcttaaaacctagacgatgggttgataaatgcagcaaaccaccatggcatatgtatacctatgtaaccaacctgcacgacctgtacatatatcccagaacttaaagtaaaataaaaaattaaaataaaaataaattgctataagaactaaggggaatgaaaagatttaaggcagaatccagcacacaataggtgttagttaaatttgaatataataaagttcaataagatataagtaagtcctaaaacatattgttcagggtgtgtgtcaatgagtagttaggaaggggagggctaattcttggagttagcaggaaagataccagtcaagagggggtgggttgaaagatcaggactacagtgactatgatgaatgctggatgtctgatggagaagtgtggggtggtataggaaattcacactgagaccgtagcatgagatagaattagaaactagagggaggctgagaagggaggaggttgatgtacgagtttggagcagtgtgactgaaaacctggagttaccaaaaagcaaaagagcatttagtgtgtttggagctcagtgtgggagattgagagtgttgagcgcagagagaaaaagaattgggaggcattgtaggccttgtgaaatttggattcagtaggaaatgaaatgttgatgagatttttaaaagaggtgataagatccagtttgtatttctgaaaaatctttctggtttcagtgggggacagaaggtagcagcaaatcagggacatcagttgttagtctgctgctgcagtccagacaagatgcaatggtggacatggaaaatgtgggcaggaggtgaaacccataggatccattgattgggtgtgaggagtagattggatattgtatgaaaaatgaatttagaatcactggctatttcatctttatcaaatcaaactctaatggctgactttgaggcttcctcctctgggttctagtagcactttgtcaaaccttattagagtgcctatcaaacaggatcttcattacttttttttttttttttttttttttgagacagagttttgttcttgttgcccaggctggagtgcaatggcacaatctcggctcactgcaacctccacctcctgggttcaaatgattctccggcctcagcctcctgagtagctgggattataggcatgcaccaccacccctggctaattttgtatttttagaagagatggggtttctccatgttggccaggctggtctcaaactcctgacctcaggtgatccacctgcctcggcctcccaaagtgttgggattacaggcatgagccactgcgtccagcctcttcgttactttttcttaacatattttttaggttaagagctattcaaaggccagagctgtttctgattcatctttatatccgcagcctagcacctgtaatatactagttactttctgaatgaactgatgaataaatgaaggtagaagaatgtgattccatggataaactttagtgctctatggattcttcccactgacatttggcatctcatagatatatcttgttaatttctttccaattttaagttggaaaaagccaccttgaaatgtgttccagttacagcttgcacatctttataagaaacctcgtgtcctccttttaggattgaaaggatttacagaaagcccagtgctagctaacagtttctaaggagctgctatagagattcagggacttttcccattcatttctggatctttatcacttttcctgctactgccgaatgctgaattttgtcttttgatgctgacacctggctcctcaaaactctaatgggaactttctgagcccagctaaagaaacttggtttgtcagatagattatagttcacgtgttgatgcttccagcattgtgtgaagtcatgtgttgcatttgactgaaaaaggaataagtttacttgtttaggctcgggaggaaggaatggaaatgagcattctctttacaagtgccagaatgtaagccttatgaagactgggattgttgcctgttttgcagattgttttttccctagcacctcggacagttcctggaacagagtgggtgctcagtaagtattcgttgaataaatgaacagctggtggtatgaggtgggacactccgaggtgtttgataagtttttcttgctaaaaaaggaaaactaacatttgtgtcaggcattgtgctaatcaggtcttaatacctgtcatcttgctcagtcctgtctgtaattggtcaataaataaaccaaggcttgtcacacactatatgacagagtcaggatttaatctcaggcccgtctgacatcagaaataattcatggccctataagacgatccagaggaaaaataactccaattgattcctgttatctttttttttttccccaggatacatttggttagttgtccattttctccagttctagacttttgcagatttctttcacagaaataatattttctctgaatttgtttttctgatacaccaactcagcattttttggtgcggagggtaaacagagcatcctttcacaacttctcataagctatgatgaatagcatttctcaggattgtcaaaaatctttagttagctctcccttctgggctgctcttctggaaatctatagcagactgggtgatttctcttacactgaaggcttcagtatctctattggtctggggtatagacagtcaaagggaatctgcttaatgtaaacttagaaatgcttaaatttaaaaaagataaatggttttaatactttctacaacctgatgcctcaatctacttccaggaagtggatttttttcctaaatcaacttcgacaaattgcaactcatttttagtgaaaggttattcactgttattcattaacattatttccataggtgataaaaatccgggccttttttcttctcttttcagatggagtcttgctctgtcactcatgctggagtgcagtgcatgctctcagctcactgcaaactccacctcccaggttcaagcgattctcctgcctcagcttccgaagtagctgggactataggtgcccgccaccatgcctggctaatttttgtttattttttttttagtagagatggggtttcaccatgttggtcaggctggtctcgaactcctgacctcacatgatccaccctccttggtctcccaaagtgctgggattgcaggcatgaaccaccgcacccggctggggcttcctttttgtgttctttaacacatctaaatgtatatcatccattcttctccagtccagtggtaacagcttgcccctcactgagaaggccattgaaatccactgtttattgtatgattagttctggtatagcttcaaaatagatatttcttattcttcatggatatagctacatattcaatatattatatattatttaatatatattcaatatattatgtattatatatacatatatgtacagatataatgtattatatacacatatgtagatataatgtattatatatacacatatgtagatataatacatatatgtattatataatgtatgtattatataatatacatattatatatgtattatataatgtatgtattatataatatacatattatatatgtattatataatgtatgtattatataatatacatattatatatgtattatatgatatacatattatatatgtattatatgatatacatattatatatgtattatatatgtacatatgtgtattatatatacatatatgtgtattatatatacacatacatgtgtattatatatacatatatgtgtattatataaacacacatatatgtacatatatgtgtacatatatgtacattatatatacattatatatattatatctgtacatatatgtgtattatatatacattatatctgtacatatatgtattatatacattacatttatatatacatatatctgtacatatatgtattatatacattacatttatatatacacatatctgtacatatatgtattatgtatacacatgtacacacatgtatatatatacacacattatatctgtacatatatatgtttatatctgtacatatatatgtacagatatgtgtgtgtatatatatacatgtaatgttcaggttgattttttactttgacttttgaacataatttgtaataaatttcagtatagacaatgaatgcccatgacgtgtagtaattggccaaaacacaatcagaatgtaactggctactgagtgacaagcagaccatttgatatctagatcccaacccaactttgggctttgtgattctccactgtcactgagtattgaatgcctcttgttgaaaattcaaaggggtaacttaaatgtttcagctgtgtttacttacatttcttaaagtttattccatttttcctaagaagagagggaaaatgtttccttgttcaaatatgtttagaacattttacataccagatatcaaatttgcatataatggctttgaaaagctcactgcaaactgtgtttaacatagcatctgtttaacttacttgtacatggaattattgtaattcacacatgaaacttaatatcattccataaaaccagaattctgtggatcatattttcaaaaatgctccttaatggcttttactacataattataagctttagtaatatttacaaatctgggaattcctaaaaatctctgtatatttatattataagtggcaggattttttttatggtaactgtagtgagttatgaaagtttgttttctttaacgcaaactcctacaaaacctgttgtttctcttccataatttactgaacctgtgtgcaaattttttttttttgaatcataattaagaagagaatggttcgtcattttgctttcctctttgggtaaagtttgggtatgatgtttctgaatatgtggccattaagcccgtgtatagctagaataaatatgacaataacaaatatttgtataaggcattttaatttatgaagtgctttaatatatattgtttccttagtatcctataaactctcataatttagggattttttttccttagggtattttatagttgaggaaactagggcccagagaggtaaagtgacatgtccaagattcaggcaaattaaatctattttttttttttttttttgagacagagtctcgctctgtcacccaggctggagtgcagtggtgccatatcgcctcactgcaagctccgcctctcgggttcacaccattctcctgcctcagcctcctgagtagctgggactacaggcatctgccaccacgccctgctaatttttttgtattttactagagacagggtttcaccatgttagccaggatggtctcgatctcctgacctcatgatccactctcctgggcctcccaaaatgctgggattacaggcgtgagccactgcacccggctggcaaattaaatcttagtccagattaggacttttttcatgctgtcctctcttaaaacatactcaaattattaaataaatacttaagtgcataagacactcttattagcatggagagcaggctccaagatgtcagagatttttgtctgcttcattcactgttgactctctaataaccagccttgcctggcacatagcagctacttggtaaataattgttgagtgcataagtgaataaataaatcctagttgttgttgctgctaatatttatcagtacaacttctatgtttatattctaagtaccttacatggtttttgctattatactccagtaaaatattgttattctcattctacatgtgaggaaactgagactaaggaaagttgagagacttgcctgaggtcatctagctagttaagtagtggagttagagctctgattctgcaatgctatttctcatctttgtaagagagaattgagactcaccctaagcttacctaggaagttaagtagtagagttagagctttgattctacaatcctagttttcatctttgtaagagggaattgaggctcacacatacttaaacttgtatctttttatactgaatccagttgtttctgtaacaaaccatctcatttgtcttgttctgattcagtcgtggttgacaaaagatgacaatgttgctgctgttgtcgacagccagtatttcctcagcatgtactctatgatagtcaccgcgaagctaggtattactattattcccataaaaccaaagatccaagagaattaacgatttacccaagtttatactgttaataaataaatgacatgccttcaatcctaatccaatattatatttgtcttcatgaaaaaaaaagcacacacacacaacaaagaccaaatatcagagtctaaatgagggattttgcctgtttatatttactctctttatgggtcctgagggaacataatttgtgtatcttagatagaagacatttgggcaactcttattttacaattttaggtcagcatagataaggaattagtctcccatagattcaggcatgcttccacaatccccttccaaatttctcccctatggagaacttcaggatagaatttagcagaatacttaacctggccctgtctgtaataaacctgtccttagcaaccttcggattctcatccccttccttctcccttcaagatgcaggagtcctctccctcagcttcttttctttctttttaggttaccctgcaaaatcagattctcccacgttactgctctaggtctcctctctttctaatctcccaattccctccttttctaattattatcaacattattgatgcttactgcttagtgtgatgggacatgctgtttgcagtggccacaggtagttacacttgaaaatgagtggataggattttgcaggccccccagcatatttactggagaaagacaaagggtttaaattaaaggattaattggaaagctcttaagtgcccttagtttttggtcgactgaaccaagttcttctcttgaaaggtcaatgagcttttccataatttttagctgctgtgaggaagaaactgtaaatctttccatttatttgctttataaatctcccttcagctcatttagtaaggagctgaacataataaatctgtgacttttttttagaaatgaaaaaacaaagcatatttggtaaccatgctatcataaaaggaaacctgaactgctaaaaccttaaaaaactataaattaaacttttcttgaatggaagatatgtcagtgtgtgtgtgtttgtgtgtgcacacgtgtgtgttttatgttagaataaatcatgctactgggcctacccccatgttatcttccatgtaaatagcatgttttatgatgttcccaaaacaatgaaataatctttgctctgaaataatacctgctttaaaccagcactgtaaagttggaaataatggaaaacacgttcaaactgattaatgatgtactcagagaatggcgtattctgcctaattggaatttttgagtatctgaggagaaaatcttggaactcttaaattccccctttgttgttgaaatctttaaattcttgaatcctctttctgctcttagagtgataggccgtgttcattgttgaatttcttcttggtgactaggaatactcatggggccaccaggctaacagtaggtattgcttctgagcctcttcatttacaatgttagatttacatgaccaggttgaggcttcttgcctgtagttgtgtgtgctccagggcacggttttggaggttatttctgtaccccatttatcattttggcttttttccttgaagtgacatgcaacaaaggaagaacaggaccttcttaaggtcagggatgagatcttattcactgttgctagtaaaatactagcacttagtattgtacatggtacattggtcaggatgcatttttctaaatactcaatgacttaaagtagacatatttgaatcactaaagttttttaaaagtttgaaaagttgactttccttcctcttttccttttattgtctgaatttatcgagcatctcttgttctcagatactgtgctaggtactaagactacaaaggaggaaggaggttaacgtttcctgaatccctcttacacagcagacattgtgttgggtgcgtttacgtatattattttatttaatggtcataggggactatgcagtagatttcacaatcttcatttttaaagatgaacatatagattccagaagaattaggactaagattggaatttagattggcccattatacctattcttttgtccctgtggttcttgaatgtggtgagctgcagtttcctgatgaattctgcaaaaattcactcttctctaagacctcttctggacctagagtcagagttgaatctttagagacctgaaccactgaaaggtttgtggtgtatctcaaacttttgggagagcccataagtaattcagtatttttgaaaataaaatgtagaaataagcctaaataagttctatacagttctgaattttttaagatagtaacttgacaatattgcatatcaatttatctctaaaattctgtctatctcctctctctgtctctctttgctttgctaatgccctaccccatagtctgaccactgggtaacccagggagtccaaggccctgggattctgatgtgcagctgttaagcagtgcaccaaatatttttgattctatccccttctgggcactaatgtgtttgccatgggacttgtagttctggccaaggagttatgaacagaagcaatgtgtgttgcttccaagccagagcagtgagtcagtgagcaatacctccaaaattccttccagccagcaatctgagaaaaggactgttttgtcagcctaggttcctgaggctttcagtaatctgagcccacttgctgacatgtaatagtcatataacatgagttaaatggactttgttgttttaaactactgaaatgttgggattgtttgttatcacagctaaactgtgacagctgtatgtggaatccaccatgcaaggcacttaaaactgaattttgaagtattttgccagacaaatagggagaaaaaaggatgccagacagaaggaaaggcatatgtattttgacaactttatttatcaaattcttaatttttttcattttaaaagtgcttttagaagagtttgtagaagttggctaaataattttagtaggaatcataagtctgttggtatctcaggccccatcaaaggtatgtgggtatgacagaaaagagtttctagactgagcaggagatgatatgatggcaaaatacatttgaaaagttgactatatctagaacataaattacatataggacagtggtaggatatgaagtgatgtaaagttcctactttaactatgattattaacagtgcccactatgcactcctaatcttctgagcagagcagagccatactgggggctgtttctcaattttgtgaatagtttgcaaaaatcattagatctttgacaagtgcagttaagcctaaaacatttgccttggccctatttctatttgtcaccttctgatttctcttatatcaataagctaagaaagtgtagatgtgtggtagattcattaaaataaggaactcgtgttggtatataaaagggccaattgtgctgatcaggattctttgatatgcaaatggtagaaaatcaaattcaacatggcttaagcagagaaaatatatggcttcaagtaactgaaatttcaggagtagccttcaggcaaagctggattcagggctcaaacaatgtcaccaaggctcaaacaatgtcaccagggctctctctctttctctctctctctctctctctctctttctctctctttctccttctgacttttgttgattttattcacaggcagattggttcaactgctaccatcatcttgaagcttgtcttcttaactaagtaatcccagtggatctagcaagtgtcagagaattgatgagtctgtgggggtccaagtcttggccccaaacaactcaggtatccaagaatctgtaacatagtgagtagccagtcctgaaacacagtcccatgcctggaaagtgaggatgagaattcacgttcactcaaaccatgtgactgagagtagggtagagatgcctgctcaaatgaaactgagggtgttgtattagaagtgaggggatagtttatgggtaggaaaaaccaatagctatcttttactctgacgtctttcagttttgcagatgagggacctgtaaaatgatgatatgattgagaatgattatgtggagcaaacactgaactgagatttaggagacccaatttaggtccctatttgctgctatctggctatgtgatcaaaaccccaggttccttagttgcctcacctgttcaatggtagtaatgatgttcatccgctatgagatgccacagtgcttgtagtgagatataggatgttattcatatgatgtcttcagtattatttagccccttcattttgtagaagaggaggatcaagtgacttggccaaggccatattgtcagtaaatgtagaaccgtaagcaaagtctctctctcctcatattaaagacagaattttaatagcagttgtaaaagtgccctgggagagtttaagaattatgccaatgtgatttacagtttctaaaaagttgtttgtatagggaatttttgttaaagaatcttaaaagcgtagagcttactacttgaatgatttctatggttaatgatttgggatctttgtggaaaacctccaacaaatttacctttgttttggtaaatatttttcagatatctcttttattagagtgtggtcagatctatttattacgttattttaagatctgattttcattgttttcagcataatacagtggaaagagaccttcagatcagtaagacttgggttccaatcttggtttggctcctgttaagttttgtgactgtggcaagttattgagcctctggggacctgcaagtattcgctgtttatagttctgtatcagtatcctcaatagcattctaaacttaattcacactccatttgcaccttcttaaaacacactttattgtgatatgtcactctggaatttgtgccacctcttggctcgctttcctttcctcagacaacagatgatggagtgccttaaggcttgatcccagacattggcctctgctaactccccatcccccatccccaacccatctataccagtgccataactctgataagtggtttactaacacagttatatactacaccccccagctcagaccacttgtctaaacttcatgttttaaagatgtatgatctctgccctgaacacctgctcttctttcagtgtttcctctatctgtgagtgatagcaccaaccctcccattacatagtcacatatttaggagacattcttaatgctttcctctttttcaccctaaagtccagtcgattaccagactcacttgtttttatctactgagtatcttttcaaatcatcaactcccctccacatgttttgacatcctttagacccagcgtttcatgtttctcatctcaacgttggtggtggcctcttcacttccttcattctagctctctttaattggttttggatgttgtacacagagtaatctttcacaatgcaaaactgaacattttgccctcgtggccttggtgcacagtttctcattgctgtaaggaacaagatggatccttatcacagaccacaggaaccttcaggatctctctgccttctgatctcattttgcaccatgctgcctctttgtctccattcacattagccatccctcagtaacatatcttctagtccctcttcctgcagcattcttcccctactccttactagcttcacttagttatcgtctatcttttttttcagatctcaggttagttaccaccttctcagttaacttccctgcccagttccagtgtaatttccaatatgcattctcctaggatcatgtatctctccttttttgtaccctcacaatgctaattttatatttgtttgtaggatttctcaatgattctggacattttccccatgaacattgtatctctagcacctaataaactgtttgatacatatattatgtaagtaataaatatttgaatctcagctgttattttactgaaaatggaagatctctgaagccaaacagatctgagtccgtatcttggctttacttcttaattgctacctgactttgagtcagttacttgaattgtctggattctcagttctctgatctgcaaaaagggttagtaattctactgcataggttggaatcaaatgagataatgtagttcactacctagtatgggcttgtctgatgtaattcattccctttcttctttcctcccatccttccaatccccacttagaatagaataggttatgtttcacaaatgttgggaagctctttctttacatttttcctagcctttacggccatctcctcctttaacctggccgggcatctgcatgactcctactggatgctgttcagttcattagtgatgagtcatcaccatcctgtgtcctcttggtggtctctgcagaatcatatggcaccttaatgaccaacatttatgatgatgggtcatttgcagagagaagggagtaattggcttattttgaaggtacattaactcgctttggtcgctaagactagatgattaaatttcttcttagagtccccaaatagcatttctacttggaccctctttgatttaaaccaagtttcaatgaattttaaaaatccacattggtctgaccaagttagtggtttcctctcagttacattgattcccaaaatgtttcaggttgattgggtcaactttgtttgctgaaaaatatgtaaaataatttttttggatgtgattcacctggtcaacttacagaatgattaaactgggtcaagttaatttacctgttgttagatatatctcgcctcatttcctagaatttgaagtggttactattctttgaatagtagaaaattcatttctactattttactctatttacaagaatatgcaagtacagtaaagcagtagaaatgaattttaaggtaaaattccagtagtcagtgaaatcatggctagctagaaagataaaactttatatatgttttcttagtttatctgcacaaaccctaacccacagttagtactcaataaaatatagctatcatttttatttttgaatatctgtctatattcaactttgctgagtggtaagtagaactagggagattttagaaatgatatacagttatggaaaatctatgactgctgctctcagcttgggcgtatggacagctaattaaataaatcataaagctgtgtgatgagggcaatgtgcagagttgggtatggtgccataagaacccacagatgagggactgagggcatctctcagagaatgttgggcccttttgaatctctaatttttcagtttcctgtattttgggaagtggggggaagaagattagaagaagattagagtcttttcctttatctgaagaataaacccatgctagtttagataaactggccaaaagtcaaagcaggggagaatttttatctgaatttcttggccacaagtcttatataattagtgaaattgtgctgtactttttttatggagcagaagaagaaccttggttagttgcaagattcacattatccatgcacaaaaattatgacatttcctgggaagaaggagtcttttggattcagagctaggctactgctgtcactgtcttgtgaggctttactaatggacttcacctcattgaccagtttctgtcttcgcaatgaagaagttagaattagaagcccaaagttggcatgctatgagctacacttgatatgaagtttgtttttttttggctcacaggcactttggagactttaatttgatgcctgttggcagagtctgcagcctccagtttgccatgctaccctccgctcccttttgtgatacacccagccctctttacaagccagggagccttcagcagagcagactaggcaatacttcaagttagtctcaaaagagaatatgttagatcaggacttttcagagcctcaggaccctcctttcacatttgcagttgtattccaggtcccgttctctcccatgacagatctgcccatgttccagatgtggagtgaaaggcgttgttaagaaagattgcatttttcagctggccattgtcaccttcacctccaatttggagatgcttgtcttattgaccttttccttgtgcacccttggcaactgaaatctttagcacctgcacaaggccccagaggatcagttttaccagatgctggtggttcacaaatttccatgtgcatcaaaatcacttggacccaggtgcctgggccccacccttagagtttctgattcattaggtctcaggtagggcttgataatttggcatttctaacaagttcccagaagacacagcatccttcccgtatttctgaggtcaggaacatgcttttagaatcactgttctagacatttgggcaccttttttttttcttacccttcttaagcccacatgaataaaacaagtgactgtcaatatttgtatcattgtacatgctttcaactacaatgatgggaaaatatagcactctttaagaaaattagggaatgcagttatcaccaggtcgctcccctacgtcaattttataatcttcacttacataatatgtaagaaagcattttctatgtaaataaatttcaacagtcataatatttgttattatttaactgggttgaagaattatatattttaaagaattatttcagaagaaaactaaaaacttcagaatatctaatgcaattttgcctggtacacccctggcatatgggagccaataatcaaaatggctttttttaatagataagaaggaaaccccataaggctgaaacattgcctaattctattgaaaaaggccaaagccattttaacttgggtagattttactctacactgatcctattttatttcttattccccctttgaaaccatccttaactaacttaaccttggatgtacttattcttatctaatcaaaacctacacatcatgggctctggagagatattgctcaggttaaaatcccttctctacaagttactagctatggatgttggggaactttattagtctgttttcatgctgctctgaagaaatacctgagactgagtaatttataaaggaaagaggttttaattgactcatagttctgcacggctggggaggcctcaggaaacttacaatcatgatggaaggggaagcaaacatgtccttcttcacatggtggcagcaaggagaagtgcagagcgaaatggaggcaaaaaccccttataaaaccatcatattttgtgagaactcactatcacgagaacagcatggaggtaaccactccgatgattcaattacctcccaccgggtccctcccagaatacctggaaattatgggaactacagttcaagatgagatttgggtggggacatagccaaaccatatcagaaacttaaatttcgttgtacctcattttttttctatcagtataatgaggataacaatagtacttacatcataccattgctctgagaacaaattaatatacataaaggattgaaacaatgtttaacacattttaatattataatgaaattcttaccttcttcagctcgcagagtattttgtggaataatttgttggttcttaaaaccgtgatatattgattcctagttaatagaaaagaaaactaacacaaaaaacattgggattttcctgtgtttacaacaactaaaccatccctgtgctcagcgttctgagtcatgctacacttacaacttctacttcagaacttaaatatgttgtggtatcttcaatctgctatttggtagttgaaatttcatatcatttaaggaaatagtgtttccttaatgcaataaattcccctttgccttttctgctattttatcacatagggatggactgtacttcatatactaagagcccttcttctgggtagaagttcatcatctgaatcagaattgaatgacctatcatggtgaataataagtgtaaatttaattccacaagacctattaccatctgcttgtagataatggcacaaatatacatatctctatatatacacacgtacatatatatgtgtatatatatacatatctatatatacacatgtacatatgtgtgtatatatatctatatatacacatgtacatatatgtgtgtatatatatctatatatacacatgtacatatatgtgtgtatatatacatatctatctatatacatatatgtatgtatatatttgaaagtattttcttcttactgggttgtcaggacactttagagaggtttgttcttttctttttttttttgagacgctgtcacccaggctggagtgcagtggcatgatcttgactcactgcaagctccgcctcccgggttcacgccattctcctgcctcagcctcctgagtagctgagacgacaggcgcccgccaccacacctattttttttttatttttagtagagatggggtttcaccatgttagccaggatggtctcgatctcctgacctcgtgatccgccttgcctcagcctcccaaagtgctgagattataggtatgagccaccgtgcccggccgaggtttgctattttctcaccttggtaccaaagacagctttagagttggacatatctgagttctcctcttgactcctccactagctaactatttgatgctaattcttgcaaggtgcttaacctctcttgacctcagttttcccatctgtaacaatagtgtcccttggtggtattggtgaaagacagcaaggttaagccacttgcctatactcatatagccaataagtggcagagttgggtacaaatccaagtcttcgtgatgcagaatgctctttcttcactgttttcctcagtttctgaagaggaagagtttgtgatctctggtcctaatcccctgtggaacacgtgaggcttggggttctctgaataggggcttctatcccagcagtttgtttgcagtgggtaaggcagatgggctccattcttgggtattagcatgttcccaattctgggctggaaaatcaggcctgtctattcacgcagaaaggttatgaatacaaaaaagggtgatcattacataaaaggccagggtattgagactgctttgacttctccaggtccttctcccattctcttgttaccctttctgttccattaccttatcttcttgactttgattttcttttcaggtcttgacctcatttcatacttgacagcagaatttggcataactgattaattgaacagtctgaaattagctggggtataaagcatgaagcagttttatttttcttcaataactgccctcaactattcccttgacaacatcataggcagattccatagctttttagtgacttctgtttatagaaattccagtctaggccgggtgtggtggctcacacctgtaatcacagcactttgggaggccgaggtgggtggaacacgaggtcaggagatggagaccatcctggctaacacggtgaaaccctgtctctactaaaaatatttaaaagaaaattagctgggcatggtggcgggcgcctgtagtcccagctactcaggaggctgaggcagaagaatggcatgaacccgggaggcagagcttgcagtgagccgagatcgcgccactgcactccagcctgggagacagagtgagactccgtctcaaaaaaaaaaaaaaagaaattccagtctagtttgcgacttcagtttcatacccaatttaaagctctttctttttcctccttttagcactgtccaagctttggcctgagggcttgcaatatggggggagtacagtttggtttttcagttttgccttgccttgggcctgcaaatatttgccctttcatgggtcagtaaggtctgtggcaggtcctgtatgaccatccctttgcacgtgtccctaacagggagattcattctggcctggcctcatatctaatcactcctcctttttagatccttttcttaatagcgtgcctctgtagcctcttactgctgaagtctcctcacccaaccggtaactattttggatgtggccttggcaaagtggctcaaggctagttacctttcacagtgcccacttgaccatagaaaacatacattcttgacatggcagtaccaggacatgccagtaccaagagattattctgctgttgaactctttttgtcatttttctgccatttttctccagcatttttctctccatgctcagacacagacattggtagtttcattgcataatagatacccagctgaggaatggcatctcagcctgttcttgctggcacctccaatctcttagaaggtcaaagcattccttctgagctagtgactcataccacattatcctttctccctgagctgtcatttttgcttctatgcataggcgaggggatggagttgtaatgatttagatagcaacacttggagatggtgtctggcacctaattgtttttttaactttctttaggatttgagtacttggcttcatttcatcctcagctttgatactaattctggctctggggagaagtcctgctcaacatccaattgcactggcttctctggctcttgaccccaggtgcttccttagccatgctctgtgggtatcttctggtggtttccactcctggattccacagctcactattctcctgacccagtcctgatcttgaaaaccaactctggtgtttgcccaacaggtccagcattttcagatggcctctgattcctaggatggggattatcctaaggaagtattcagacaccatgatctgatgagagcctagagccatgtgccatcacaaggggagcaaagtcttgcctactaagggaacacatgccctggactgcatttccctgtctcattattcctgcctctgacaccaacatttctggagactgagatttttgttgtaatgcattgtctttgttccagcagatcagggactgggcagagttgtagaagtccactgttttactgccactgagatttctaaggtggattttcaaaaagggagagacaacatatgtcaacccttattgagtgccttctaaaattaataatatgctcttatttaatttttgtaccaattatgtgcaataggtgaccttattcccattttaaggaggagtaaatggaggccctgccataggcaagtcacatgctcagttcagctagatcttgggctagaattaaaatccagattggtctgattccaaaattcattgctctttcccctacataacaataaaacaacaatggagaaggcatgtctggccaggccagcacattgggacgtgcctcggattggtcgtttgtttgcatcaaatggcacatgcctcagtcaatgcctcctggcgctgatcctgcctgcctttaggtgtggctgcttttgaactggaacctgctctgggaacgatactcgctagtccacactgactttccattctccaggcttatcattatgcatgttacttgcagcagcagaggaagttaatttggcagaaggaaattaaactcatctcttattctgcattctcccagaagtgttgtacttgaggagaatcacattcccaaggtgacaggtattgtacagaaagggcataacaacccctctccttctttggttctttcaaagccagtgtagcatgcaaaaaaaaaaaaaaaaaaaagttgaaaatatttgtatttaactcaataatgtttttaggaagacaaagatatttacatgcaaggttattaattcagagatacaggctgcttaatacataagtaagaacaatttctggggcaactctgtaaacagggcttctaagatggggaggccaggccaggagactgtttcaatttaaatgtgatctcaattactgaatgcatacctaacaaagaggactgggtttctaagtttcttgcttaatccatgcttttaatttctgtgcagtccttcaaaatgaattcgttacatatttcactgctgtccaggatgctggatgctaggatttgcagtctgccagaggattgaacgtttttgggtattttgttgttgttgttggttctgttttcaattttagcttgtggaaatttagcctgtagggacctttggaaattatttcaaacctgctcgttttgtagattaggaaaggagatccagagaagttaagaaggtgggttctagttctgttcatagttttttgtcatttataagtctgtagccttgggagagtcttttcccttctctggccttgaatgggtcaaggtcaggtgaagagtaattggtactgcctggagcataaactttgtcttctaaccaatgtccagggctgttgccattggattggaatgactgctacttccctaggcaaaagtggcattttttttttttttttttttttgaaacagagtttctctcctgttaccgaggctggagtgcaatggtgcgatcttggctcactgcaacctccacctcctgggttcaaaccattctcctgcctcagcctcctgagtagctgggattacaggcatgcgccaccacacctggctaattttgtatttttaagtagagacggggtttcaccatgttggccaggatggtctcaatctcttgacctcgtgatccgcccgccttggcctcccaaagtgcaaaagtggcatttttgaccaccttctagaagctttgtgttaggcggtttgtggcaatcattgccttgtcatactttcctcttttaatgaagtgagtttccacctgtctagaatgccatccttactttgtatgcctggcaaactcttacatgatattcatggctcgatttagaagctatctccttgaaattttccttgactccccaggcagacttagattttctctactaagtttcattttatatcatctactcattataattccacctaacataatcatgatgtcatgattgctgagtgacacatcattcaccacaatgggttccttgtgggcaggggatactataactagtttatcactggtgctcaatacttgtttgttgactacatgaacacacagaaatgggctgtggtaaatttgatggtaaggcttttgttggaagcatcccatcacttcttaattagacatgatggccatggagtgatttgggctagtgtccattagcttggtcagtgaacagagtcttaatgaatatagtaaaatgtacattcatccctcagtgtctgtgggggattggtttcaggaccccctcaaggacaccaaagtccacggatgttcaagtcttggacataaaatggatagtatttgcatataacctatgcatatcctcctgtgtactttaaatcatctctagattactgataatacttaataaaatgtaaatactttgtaaatagttattatactgcattgtttcaggaataatgacaagaaaaatgtctgtacatattcaatacagacacaaacatcaatttttttccccaatatttttgacctgcagttggttgaatccatggatcgggggatgggggacccatggatacagagagctgactgcattgtctttgttgccaaaaaaaaaaaaaaaaaaatcagtacgaatcaggcattaccattttatgcatcctcaataatatttgatgacaaatatgattctaatattcctttatattttcaaagatagaaatgcaaagataaactgtggtaatcatgtaatccctatctagcttacaaaataatgttctagctaattaggacaacttttaagaaatctattttacttttgtgcatttctatagcataaacaggttcagggccttatattagcttttaagccattattagttaggatttgaatgccaggtttgaaaacacatacacctatttcctccccatacagcacactatcaaaaacaatcatggtacaaactcagcaggccagttttgaaaataagcactgagtattgtcatgaaaaaacatgaagattctctgagcagtcaaagctgcggtaaaagaaatttgatgaatcttatgttagacataacagttagaaatatctgtagtgatcagtgcttctactggctcacaatagcatgccaatttttataatctgatgtattgtttactatgattcaaagagcagaaagtcaatcagctaaaagctatactttgacatccacaattaaaaacaagaaagaacaacaaataaattgctaatgaataaaaagtttttttaagttggaaaatgtaaaaccaaggagtggaaatttgtagggaaaatgtaaattacatatgtccccaaagtggtgaatatataatatttatcctcatgcttgcagtagatagattgcttacattttccaaatatgccattgtacttacattttatattacaagtgccaggccttagaagagctaaactagaattatttgttgtcccctggagttactctagttattttagtgtaatatcctgctgagatttatatgaaaatgaattttaatttctaataaggtaaccatatgctttggaggctgttgcaataaaatgtcataaataattattgtttctaacaaattccaccttgagacaatcaggtcttgttttaacagcccatgttagacatggattttagccattttcatatttccaccaccctcaccttgcagtcttcaagtggcaacaggagagataccctggtggaaactttttttctctttctactcctcacctgcatgatgttattttgttttagaattgcaagcttcaaaaggaggcagatatctaacagacttaattttctggttttttttttactcctaattgctgcagagaaaattgatcacattaggtatagtgtgtgtgacttgtccagaggaattaactttgctcatccttttcttgtgattaatagttaactaattttagtagctgtaaataactaagagttagaagaagcaataaaaaaatcagcttctggctgggcgcggtggctcacacctgtaatcccagcactttgggaggctgaggcgggcagatcacgaggtcaggagtttgagcatggtgccagcatggtgaaaccccgtctctactaaaaatataaaaaattagccgcacgtggtggcgcatgcctgtaatcccagccactccggaggctgaggcaggagaattgcttgaccccaggaagcggaggttacagtgagcagagatcgcaccactgcactccagcctgagcagcagagcgagactccattaaaaaaaaaaatcagcgtctataaattgcttcacatttctacatcccagaagagaagagtggctccagttctcaactcagttcttcccctttgttatttcccttcaaccagctttctttgccttattgtgtatcaatcaataagtcaatcaacacatatttatgtgctgctctgtttcatgctgggcagtgtgggatatcaaaaaagagtaagacatgatctctatcttctgtaaatcacctccttagagctaatctggctcactggaatgctacggaatttaagttagggaggaattcagagaaaagttaggtcactgggcactgaactagatggaagtttcatgaagaaggcaagggctgaagaatgaacgagatttggattaaaggacaaaagaagagaaacattttgtgctcattctacaggggtttatttttacttaatgtattagtcttcaggtatcagggttgaaattattaccctgccatttaatgtataagaatttattttcttcagtatgatctcattctcattccctgttcttaataaaaggaggacctgtgtgattataggtccttggatctcacttaacttaaaactgttgtttggatggactcagctcatttaggtaagctaagtattcagcttattcaaagtttaaagcttcctcacagcttttggagacctcctctttcccttatgctcaagatagtacttgcatgttctgtcagaggactggagtgactgatgtaattcctcttacccagtctttgggtgatagtctttgttcttgctgtagcctagcatgggtttccatgcatgatgagtgctgccaggaagcctttctatcttaaccactatgctcccacctctgctgtcactggggctactgattctccaggacctaatttcagcttccatttgctcacctgcctgggcggtccaccttgaaatcatctgtatctcaccctgtgactcttccctggtgacctcagcagctggatactcagtaagcttctcatggtggggatgggaaactctggatccctttcttcccatatcaggagttcagggaccctggatatgccacatccccatttctgttaaattacaacttttttctgtgggcatgggagtccatctttagaggctctccttctagacttccagacagcaaattgagtagcaaattctttgttctttaatcctcctctgccctctctagggtttttatcttcccgatttacccatctccgtaaaactgaacagttggaggtattaggtccttaacacctttgttctccttacatcctctctgaatctcccccacctccatatcctccactggaatggcttcaacttccttttcctatattttaggaacttctcctacatcatatttcttctttttccctaccccatgagcatatcgtccattttgcttttgcaaaaaaactttatcctaaagatgagagaagctataagggaagaaaaaaacaacactgtaacaactagatgattaagaggaaaaacacatcaaagtgtatttcacaaaatttgtctactaataaatacaatgtatgactataaccaaatggtacaataatatttgttggtttccaattcaatgactattgaaaggtggtgagtgctttggatttaagagtttaagtttcctatcaccatgtcagtagtatgggtgagacatggtaagactaaacattaggcatcataaaaaagctaaaggacaagatacagtaactcagtggttcgtctgtatgttacagccattccagagcactgggatcagattctatcaccccaagtcaggctgaaaaagagaatgatgctaaatgtagcatgttatcattggtggggattgtggaacagaataagggcattagtgaaaaaaatctgtggaatatgaatataatttggagtttaggtaatagtgatgtgccaatcaatgttggtttcttagttttgacaaactcaccatggtatataagatgttaatataaggggaaactgtggtagaggtattcaggagctgtctgtactatctttacaacttttttgtgtgtgtaaaattattcccacgtagaaagtttatttaaaataaattatttgggatcaggcacggtggcttacgcctgtaatctcagcattttgagcattgcttgagcccaggagttcaggaccagcctgggtaacatagcaagaccctgtctctacaagaaattaacaaattagctgggtgtgatggtgtgcctgtagtcttagctgctcagcaggctgaagcaggagaatcacttgagcccaggagttctaaatttcagtgagccatgatcacaccattgcattccagcctgggtgatagaccaagaccctatctctaaacaaacaaacaaacaaaaaatgaataaaaataaaaaattaaattctttgtacctatggacaagcccacaagcaacaagcaaaatgcaaactattatatttcttgttacaatcttcttaaaattgttaacattttccatctcctgagatttttagaatattttaaaaattataagaatattaagaagtgaaaaactctcatatttctttgtgtatgtatatatgtgtattttcattgttttacttatagccctgttttcaataaatagctatttagtaaatagccatgcagatattacaaaagagagagaaaaatgttgattttctaacactcctgatagattaattttccctcagagtgcaggatattctgcatttagtttagataacataagctttttttcattttgttttagccatagctgaattttgtttgttaccccttctgaagtttcttttgctaagatatatttttgtactcttagtttacaatttttttttccacagtgaggatggtgacaattttcattaaacaccttataaatagtcctacaccatctctatatacctccagttctgttattatccaaatttatcatctctcctaggtgtgtaagcaccttgacacaaaatgcatcttgagaactgttaagccaaagcagcagctaatttaacagctttggcttggtcaataatgttgaccagtaggaaaacatcggctgtcttccatcttcctgctggtcagcattattaactccacagtttaatgagtgagcttgagaactgctgcctgtgtatgcttctgtagaagatgagattggattaaattcaatctatataatgccagggatgatgaaaattgcatgtcctcttacattcatgtaaaaattgcttttatggagctcttccttctttctgtaaactcagcctttcttaaaatgaaatatacattttcaataggaatcagacgaagggtgacttctaccattacttgaaaagcagcaaatgcaacttggacaaaattaaatgagagttctatcacacatttggctaagttcaggtttgcaaaaaagactcatagagtccaagtttggtgtatatggtggtttgtgatgttttacattatttgccacatccccatgctaagtcaatgatggatatcaaatgctggggttaaggttccaagcctgtaagactctcagaaaccctgtcatggcagaattctgtacgtaaaagagataccacaaccttctgtttagttcctttgcttctttgtttgccacattgcccatcattcttggctcctatctaagatttgggactccattaagctttaatgtgatgctactgtctcatcctcacctcagtctgtccatagctttgcttttgttctacatgctagttcttaggaccctggctgcactctatgtggtgtatgacattttaaatggtgacaaccacctgttgttctgttccgtgaatgtgggcttccactcattgggcagaaagagtcctacctaagagactcaacttattccttagactttcctactaaaaatgtgtgaccagtttgaatttcctttgatcacatgctgttttttatttccaaagcatgagtatgagtctttaggggaagttgaggagcatccattgaattcaccctcaaaattagtagcctatcccctcatatgtatcttccagaccttgttttctaaaaagttcattatataaaacctttggtacccttgcaaaaaaaaaaaagccccaacttcgcttgagtcttccaactttaaaaggtatggacttctcttgatttgaattttcagctgttttaactggaaatgtctctcagcttcagtcaattaaggtagcttctgttgttgttttcttcattatggtgttaaagttttagctctaatctgccacctgccctgtaaaggacatcgatactccagagcatgtttgctaattatatttgattagttgaaaggtcatatgaaggttgtgtgtgtgtgtgtgtctttggatggggatgtctcagagcactaatagatgatgttcctcagatccaccaagggtaaataaatggagttgaacaaaaggtgttggcaatgattgactaaatcacagtgaaagatgtggatctggccttggaaaacttttctacttagctgacattcttagctattgtttgaccttgaataagaatcttaatcgcaccagcacggcacatgtatacatatgtaactaacctacacaatgtgcacatgtaccctaaaacttaaagtataataaaaaaaaaaagaatcttaatccagtttactgtgtcagagggtggtgagattcaagatcattataaagtgtttgtgtattacctacttaagggaacctttatgaactttgtcattcaaataatcttttcggaacccagagttaaaatttcccagagctattgttgtctgttgatctttacccagaatcctctgacgaaatcagattcccaatctagcagttaggacatgacataatgcacttttaaaaaagcaaaaggaaaacctaggaaagacaaagccagctttaagtcactttcaaagtctcatgattttcctgaagtgaggagactccatggaaaagagtgatataatgcctccaatttatctcaatggagtacatttgaccgggatttatatagatcaaattaattgcttttctgcaagatacagcagaagatgaggcttttgatagacatttctgaagttaaatattctttatgcagcaggatgttaaaatagtactctttctgtcccatgggtggaagcccacatgcgtagaacagaatagcaggtggacactctactcccccattccagacaagatcaggcacattcagggtgttatggtcgtagacagcctacagcacccggtattcccaggaggtctcccatccaagtactaaccaggcctgaccctgcttagcttccaagatcagatgatactcccccattccaaactggaaatgctgggccatgtaagcagggctcacaaagaactctcttttcttaaactaaagtgtgattgaaatgtaaaactgtccatattttggggatgagtatacactcatgaaaagagtagcatcttcaaggccatagctgtatcaatcaccttccaaagttttctcctatcccatcattattattattgtatttattattatcctgtggtaagaactcctgacttctcactttattctattaagtggttggaaaggtatgaggggagctgaggattaaataaaacatttatttggacaaagttgttaagttgttcccactttttcccacattggaaaggggagaggtggattctgtcttccgcttaagcctagtgagaacagcctcaaggatgctctggagaagttgtgcatttcccagagctaggggaagaccgttcactgatgtctgactcaccacttgccaacctgaagagtgacagctgatggaagcagccctgggcagcaggctaaggggcatgaatggaaaggatctgcacccccactggagttacattccagatatccctggtgtgttatttgggttctctgggaagcggatgctgagaccgagctagaggggcagatggtttattaagaaagaggggaatgcctatgaaaaatgaagaggaaagaaagaagcaaaatagagaaaataagagagcctcagaccaaatgtgaatcttacaaagtcttgggcaatcaacggggagctcccacattggaagggggagaggtggattctgtcttcctcttaagcctagcgagaacagcctcaaggatgctctggagaaattgcacatttcctggagctaggggaagactgttcactatctgactcaccacttgccaatctgaagagtgagagctgatggaaacagccgtaggcagcaggctaaggggccatttgaatgaagagtgtctgttagagtcccatgttgggcaaaatggcccagccttagtacccctgtaatactcagtcattggttgaagaacctcagctctgatgccactgtagtggattccagggctaatgcacatgaagtctgttggctaactatacttttcacaactgagtagcaaggtctttcttgaagagagattcaagcagtgtacctctatgggtactgggaatggcaaactgcctctccatatatttcacagccatttcagcatctctacagctagcatttcagaggagaatctacatatcgaagccataaaaggctttagactagaagaatatcaaagctgagcaagaatatattataacagttacctacattccttttgtaaaaggaaagtctgtgcagatatttggacattctgactattccgtctttggtaaatattatgcctatagcagggaaatgctgttagtggggttgggcttgggtaggtgaatggtagattggaaagtctttctgtttgtctggacagattactactttctgttttattagaaagctttaatcagaaaaataaagatagataggatactgcagagcaagggttagctacacttagggacttcctcagccagaaaagtctccatgggcctgcattaaacctgcctctacattccatccaacaacagtctaccctgctccatccaaaaaatatggcagaaagaggttctcttgtctagggttctgctttactgagagaattgcctcatgtattgtggatctaagccagtggaaaaatttcctcttcttataagtcaccttggtgaggcacagtgtccttaaacttgttcttctgccaatcctatttccacctgcagttgtcacactctgtctcctgacaatttcacttgcagtgaattattttcagcaaactttggctattctaggagcatccatgaatgctaagaatttatcttaattcccccaattcctcttcttcttgggttttgcactgaatccttaacatgattatattttttaactactaatagaattaatattaaattaatatttcatccattagtggaattgatttcttttttgtatttttaaatgtgcgatctcttctcatctaattgataattaattgaataagcattttctattgaataaacatttgctgagcatttcctatgttccaggatctgtgcggaataaatttgggaataaactaatttagatatagtctccaacttcaggatgctcagtctttagcttttcctgcaaatcatgcctataaacatataacttcttttctgaaaaaatgtgttgtttttcccatttagcttaatgattagatctctggtttcttgacagagtggggaaataattggtgaacaactacctctgaatcaagatatacaatgcaaagaacaaactcaaagtgcatcaacaatgcaatggttactaaaatgccagtttttttgctaggtcacataaatcttgtgctttggacatcctgaaaagtttaggcttgcagaagtattagaggtcatctagtgcaaactctttattttgtggtacagagacaaaagcttgaagagaaaaaaatgtcttgcccatagtcatggggcctgtaaatgaaagagctgggaccctgtctccttctctatactctgttttgccctgctgtttttggtacagagacctatggacctgtgtcagggaagctggaagagattttgtcacttggtaagctgcaggatgagttggatccaaggtcctcctctctgagggtctctgactccaagaaacaaactgtgagcactaatgctagattacctttttttaatttttttattttattattattatactttaagtttagattaccttttgcattatccataaattattgaagttcagtacctctaaactttgtagattcaaattctcaaagttgagaagtactaaatataatatacagatgaatattcttctagataattgtggagtgatgaatgtgagaaaaatagaggactcatacagattttcttgcactttccattgcccttgaatctcttcctcaacttctctgcctgggaaacttttattcatccatgcatcactaatgccctttgatccatcttgcagaatagattgttgtcccatctgtgttcctatgcactttatagtacttgtggtactaaggtttagttattttagttatttctgtgactctccctggctgtgctgtgagtttgagtggcggggaatagctgtattcatctttatgtccctaatgcttattatgtgtactggcatgtagtagatgttcaaaatgcagtaattgaagtggttaataaaaactaattaattagagtcagtctagtttagctaatattatacattataataaacatttttataatattttaaattataaagtatttttgtttattgtcttgctcgattatgattctaatatcatccccatgagggagttgtgattatcactgtttctataggaaggcacagaatcagagaagccatatttaatgttatctaatgagaaattgagttttccacccatccgggcatcagtccacatgccttggtctccacagggaggttttcagataccaggtatggattgctagtagttggataattttatatgtccatgattaagtgagataagagtaataaaagtgaagttttttaaataatgctaagatacattaatgtatagtgctaagattatgttaagatgaagggccatccttgtgtgtgtgtgtgctaaaatgtccccttttaaaataaaattagagtggcagcatatagtatattaaaaaatcgtgtgtccaaaggaacattggctgcaatttgtaagacatatattattaaaaataattttttgaagtgttactagtctgctaaacctcaaagcctaggaaccatagctacctttgtggaacacctcaactagttaattttttctatacctgtcttttggaagcaaataatgagaaaacaggcttatatcaggaatttaattaggataacatccatccaaaaaccatttagggtgtgtcctggaataagaatgtactaaatttaatttcttatatttgttttagctatagccctgaaaagggagagctcatattcagaataataactctgtaggcatgtcattcttatcaacttgtgtttcattattatatttaccaacatgagtggttaaaaacatcgatatgatgattttccacaatatggtttaaagtgaggtttacttctacttctcatttaagccacttaaaattaatattgtattatgtccagagcattgtagacaattacatgttttgtttctgtgtttacaaattaggtaacatcacagatttcactctttttgacttagaggctaatgcaacagagtgaatgtggttttatctcaggctacatttccaccctgtggctgttcagactggacagtggcagggtttttgccagggaaggaacattgttggttcaccagactggtggcatttagagcccagctcacagcacaggggtgctgctgcttgattgctggcattttgctaccttctggctcttgtctttataaatgggtagcatgtatttccaatctcttctcttgttgataaagactgtgttcatgagcattggcattaacaacacagttttgcagcctgaggttaaaagctttctgatgtctcattaactcacaatggcatttcatttttaatattgtctgtgcacacttgcttgaatcatcacagttcaaatgactttaatttgcagtggcaaacgtaaccgtgatggattctttagaaatacaaaccagagtggtgggtgccaccacggtatacttattcttggttaatgccttttcaaaatattaggaacatctcttctgtcactggtatagcaaagtagcaatcacataggctttggacttagaccaactgaggtttgaatcccacctgtgtcagttattagtggccttgagcaactcacttcatctcctttaatcacagtttcttatccattaaatagatataattgataatttcatagatttgggggggggagtgggaaattaaatgagaaaaaaatatatacttagcatctagtgaagttccaggatgagatctgctatggtttgaatgtgtgggtctgctatgatttgaatgtgtcccccaaattttatgtgttgaaagcttaatccccaaatttagatgttgatgatatttagaggtggaggctttggaaggtattagaattaggatgggggatcccatgatgggactggtggctctataagaaggggaagagggacccgatctgatatgctcttgccctctcaccatgcgatgccttctgccacgttataatgcagtaatgctgtcttccccagatatagtcccttaaccttggacttttcagactctagaactgtaaaaagtaaatttctttttcttattaattacccagtctgtggtattctgttatagcaacagaaaacatattaagacaggatttcttctgtatgttattttcctggtggtattcaaaaaacatttttatcaaatgctttgcctggaatctctaagactcagaatggcagcatgcatagtcagtctctcgaatccctttttgttttttctttccccttggcgcttataagtttcagtgacacggtctctttttgcagctggctgaagagggataagacccccaacgcctctcagggttgaaagcttcaactacatcatgtttatctgagagcttggcgttggagttttgaccactgtgatacaatactttccacttggtattaccctttacaagactgttgtctctgacaaccccacagggaagcgggcaggctgggccaaaggaaattctttggtcttagagtgaaataaacatcatctctagcaacctttaacatggtgaataccttagaatgcaaagcacaaaataaagatcgaagttaactttgtatggatatctacctgttggaggggtagctggtgatatattgatatatttatatataacaatctagaagcaaatgttggctgaccctgctttattcctatgattagaacagtcacaagaataggcctgttctcttgagcaaggaaggattctattccagacttaatcctccatcctgtctcataagtagggagacaagagaaagcagtcaactgcacctcacatctttcccttatcctcttattgtctggttatacattttgttttcagtgttgagggtaggcatttctgaaatcactagaacctttaaacttgctacaaatgtcagtttttagtgatctctcctctgcagaagacataataacatgtgacattgataggattggggcattcacaaccaatgtgtatgtgtatgtacacacacacagacacacacacacacacacacacacagacagacacgcacatcaggcatgcagtgagaaactgcagaaatgattgggatgaaagttagtcttagcctggggccgctctctgcaggaactgctgaaacccttgcctggagctttttgcatgcatatcttacactctctgttagccttcctcactggcattctcttctcactctaagatttctttttttgttagaaacaaggcagccagattccatccttttggtgtctcggtgatgggtttgtgtaggagggacacctgtacattcacacttacttgcaattgtaggtgctatgcaattatgacttaacagtgagtaattttaacacatccttccattctcaaagaacaatgataatcggatttagatgcccacttacaaaaaagacattttgaagttaaggtatggcccacttacataagatgatttttgtaacacctcagatacatagctaaagatgtcaatatgaatagaaatatccacatttgttaatttgcaaaggctcagatgaagttaatgcctcaacctgaagctttctgtgatttgtcctagagacatatcaaggaattcagagctcagagtgattttataaatcatttaattcagactcctcaatttatggtagggtaaatggttgcttacagaagtgaagtaacttgcctttaactacttggtaaaagaggttggactcgctagctctcatctcctacaataattatatctctgaatccccaaataattacagactgatcacacattttggaacttcttacattactctttattgtttcatatgtgcagacttgtctaacctacttcattgaaaatatttaacgtattttcagctataccttaagtgtagctgaatacaaactacatcttaaatcctttctattatgaaggctaaattgatgctaattatttagtagaaagattcaatgaatatttatttattgactaaaatatctaagtattttgtctgcatgattctaagtaaagggatactaggacattttttcttaatgtctgaatgtttcagatttctttctaatatatgggatctagtcagactgggacaggcgctgtattatagtaatttttagaatcatagtaggtgctgaaaaacatgtttattgagtcaatgaatgaatgggtaagtaatgaaaaatgtgtataaagaactaataaggagaaaagctatggacagaagtgtggtgtgggagagataattatagggaaaggttagctttttgggagacctatacccatcctcacatgtatcccaggcaagaatgaggggcaggtgaagtccagaggtttctctgtggggtctggggcagagataactttcttttgtatcatagtaccagctcttctagtaactcattaacatgcaattatgatttaacagtgagtaatttaacaaaagtaatttaacaggtaagggaaagtagaatttaacatggaggagaagaagaagcttctaaaatactgttggtttcgaggttccatcaactgcagcattcagtgtgtcaagtaaggtagagtctccaacgggatccaatcaggttcatcagggagagggcaactgtggcaatttgattggtgggacatgaatgtttataaacaccttgatgtccatggacctgtgtttatttggtatgtgtgaaactgttgtgctgcaatttactgttggaatcatgacagccacttttcatgggacccaaggatgctcatctctgattcacggctgcctccagcataattcctggaacattaattcacctgattgagcattctcctcggcattgatccatccctatgttgtttcacatcaacttctatgtagcctcatggcaattagtatcacttgttcatttattcattcatccattcagctaacagtaattgaaggtcttctgtttgttagatggcatgcaaagtgctgaggatataaagaggaaaagatgcattgcttgtgttcgtggtgctcactgctgatgaggagagtaataaaacccaaatccaaatttgaccctgtaagttctcataggacacatctgtggctcacagtgaggcagagggtatcacaggcacaagggtgcataattggttacccagagctcacatgcaacgtggcatttcttctgcttgaaatcacgactacccagggtctgtgtcttgctgcctcagaaatctgattttgccagtttgctgagaagagttccgtctcttagggacaggattatatttgacatgcccgtagaacttgattatatatgatatctcagaatgtcaattcagtaatttacagtaactgtcaggcaggtcagacatttatctcagactaggatattctcaccttgaagggaaggaaaaaatggtcagaagcttccttaacgagcgtgtgctcagaggaaggtttaatagcagtgggttctggtaggctggttagtacatcacaacaacatgcaaacagagtcaaggggtggcagtttttgagcaaccatcagcaccccctccccctccccccacccactgttacgggccctgccaacttgctaatcttctccctgtgctgtgggatgtggctgtttgctattctggcttaacccaggaatggtggtgtgaaggatttataggaatggattgactgcatctctctcagactgtaccacacaaacatttttctcttagtagagcattgtttaattcatataattcatgtattaatatgatatgtgttacatggcttgtgatgaaaaacagcagtctactgctcactcctccctattcctcccctaagaagtttcttcttaagttgcttctactgtttacttccattcttttcttctaataatgtgcttgtattgctatattttatacaattttatttattatctattgcctttctcttatagtgaggattcagcttgctaactaccccttgctccaccctccctgcctgtctccttctctttccaagttctaatacaatagagctaggatcaactggaagcttcaggtgaggtttgaaaggaatgagcttgcagttataaaccccaatgcctggggcataatagaccagtgtgcaaaatctccattctttgacctaacagctgactgaagacacgttaatttacaatttaggaccctggtttccttcttcctcaaaatcaaagtggtaatactcgctgtctagaaagtgagggtgaacaataaaatacatttaaagtgcctagaactatacaccttaaaaataggctaaatagggagtaaagctgaggggctcttttgaaaagtgaggtgccgtaaagcttgactaggaacattttttactagggaatttttaaggcaggcaaaaatactccctttccctgccccagataattagaaaacagcaaactgcccttagcttccccagtcttgagctgtgtcaccttgtaaagtactgttctaccttgggctgcccagccccctttctgttcagtctgtctctaaacagggtacaatgccattgattagacttccttctgcttagtaaattacaatcatactgcacttctccttccttgaaattactcccaaatcaccttgattgggggtttcaatgttcctggtttcctcagtcaaacatttacagacattttctagctttatttccccagatggttaatctcacacattgtatgtggattttatgtatttaattcccagctggcaattttatttcccctatctttgcttccttaaaatctaatcaaatgcagaaatcaacccaagaatatcctctatgatgaagtctttctggatctcctggtctagcccagagttatttgttattcattttcattgacaagtccctttcttcctgttacaagttggattctctggaagcagatatggctgagatggcattaggggtgcaaaatatttattagtgatcaacacctatgaaaggaaaggggaggaagcaggattaagcagagagagaagaggaagaaattataattctggcatgacaaagatcagtaacaaatactgtacctgagtttcctatgttggaccaaaataaccagacccttacacctttatacctccacccggctccccttgccagatgcagactgccctggggagattgtgtcctcagaccaggcatctctctggagctgaagtggaccctgaaagaactgacagctggggaatgtcggctgattacactctctgcagttgggcagcaagtccttccatgaacggagatcttaggtttccatctttgtgcctactgcacatgcagagtatttcttttaggttcttagtgaacacactcatgtgtatagttaattgattgttgtctaccttttccacaggcctgtgagctccctctcactgatcttttgttcctcgcctccaccacttagtgcataatgaacatccaataaactattaaataagcattccacaaataggcataaaaccagtgtttattttcatgttcaacttctggagttatttctatcactgtattcatcaccgtaatgtgaagtgtagaaaactattttctgtgcccctctagggtgccaaccactgcgctaagagcttctgggcaccatgctgagagcactttttgggttaagacctgtgttttctctggcttccatattaagagtccaacccaatgtcgaataacataggccacccccaagttgagccccactgcagccgctctacttttcagttgctgccgcactacagtaaggagagtgctctgctccatccagaatgctctgttttttacagcatcctggccttgcacatcttcatatggtttgctttgtttattccaaccttgagagcatatgttagatattgtctgtgttcaacattcagagttgttctccctgccagccttccattcaagaccacacagttttcttctttcatgacctccctttctccccagttagggccattgtcttgaaattagggtcatcagaaacctgctcacccccatcctgcatgggagtggctggcatctattaggacaagctatgatccttggtctctcccattgtaactgcctgatgagaacctcttgcccactgtccagatatgccaatttatcaagacaggggaattgcaatagagaaagagtctaatatacatacagttcgctaaaaatgaggctggagttttattattactcaaattaacctccctgaaaatttggaggctagagtttttaaagatagtctggtgggcagagaggttgggaatggcaaatgctaattggttgggtcagggatgaaatcatagggagatgaagctgtcctcttgtacagagtcagttcctgggtaggggccacaagatcagatgagtccatttacgagtctgaatgatgccatctgatccatcagaatgcagggtctgaaaaatacctcaaacaccaatcttaggctttatagtagtgatgttatctctaggagcaattggggggattagtaatcctgtgccctctggcttcatgaatcctgagccgtaatttctaatcttgtggctgttttgtttgtttttacaaaggtggtctggtctccaagaaaagaaaggatttgttttggagaagggctgttatcatctttgtttcaaagttaacttataaattaaatttctgcccaagttactttggcctaagcccaagaatgaacaaagggcagcttggaggttaaaggcaagattgagtcagttaggtcagatctcttttactgtcacaattttatcactgttctaattttttgcaaaggcaatttcatcgtggccctctttttgacctcataagcagaactttggccacccgctgggacctgctggcttatgccctgtgttggaatggacacttgagtcaggccctcattctggccacagggtataggaaatagtgctccaggaagattagagctgcttggagatggttgagaggggccaatttggctccaaatattgaggcaagtggtgaaaatggagagctgcagcactgggctatggacaaggcatccaaggaagtaaccagccagaagatatcacctgcctatggcagctgcctaaatggactgctgaggaataaatgggtcctacgttatctgctaaggatgtatttcccctctttctctcttttttaatgagcttcttattttagaacagtttcagagtcacagaaaaattgtgaagatgtgtacagagcttgcagtcttccttactattaacattttacataagcttagtacagtacttagttacaattaatgaaccaatgttaatacactgtgtttaactaaagtctatacctttattcagatttccttagtttttgcctattgtcctttatctgttcggtatcccattcgggctaccacttatatttagtcattatgtttccttaggctttccttgcctgtgacagtgtctttgcttttcatgattttgacaatattgaagagtactggtcaggtatttttttagaatatccctcagtttggatttgtctgatttttttcttataattaggctggggttatgtgtattgaggaggaagactcattgatatttattttacacttagggttataatacaatactgctttattttgtttctctaattgttccagctttggcaaatggaggctgtttcagttgactcttctgacagggattttaagtttgactcaactaagtcaactcaatgattcagttggatttgatgtaataggcaactgggattctgagtaggggtggcctgcactcttactgcctttgactatgactcgatgcttccacttggcagattgcatcaagccatgtgccctgcaggtcttcctatgttctaaaatagaaattcttggggtagagccaagcttgctttcttttccttttcttttctccctgttcacactgtaaattctgtttgaaaactaactgggaaagatcctttctaagacagcttaatgaagaaatgtagttgaatgtaccactttctcagcccagtaatgctggcattcctcagagagtctgaacttttcctaaccaaaactaggttacaaaacgaatataggtttcatattcacagggttgataaacccataactcaatgcctgcttacctcctggtttcagcacttatatttctgtaattatttgcctgcaaattgctgtaatctgagggtactgtgaactcttggagggctgacactatgttttatacatatttgtaaacccagtgtctaacatggtgctatgttagctgcccaataatgttgattgaataaacgaagaatattggatggggaatgtaattagtttgtttatccaatttaattaacttgaaatcttataatcaacatatatgatgaaattaatattcaagcaaagttatagtctccctgcccttgttgtggttatttcattatgatgaacctcttaaagtacttctgagaaaaatagtcttgattttggctcttgttttcgtcagctgaacttccccattgtatttatcagatattttctttttcttgattttcacttatcactgaacacacttgttcactgacttgaactttgttcatttttttagatctctggatcttttcttgtcatgtcaattctctttttcttaaggtaactgtcttttgacacgtcttctttctgttttctttcttcttccttttccccttattctgtgagtgtagtgctcaattttcttgcagctttaacatcaggagtttgatgaatatattagtttcatacatgactgggatgcctgtacaaagaatgaacaagccgctagagaaccaagtgtgaatgaagcaaggttgtcaatgaaaagcccagaagagggaggaaaagcagagattcgtcctcgccgttgaaattattgctgtgattacttgatacgtgggctcatgacttgctctgtaaatcagtacccttttccctgtgctcatagtggttcctaccttagagtgaccttggttaaaaatgcctgtccaggtggtgttggcctgacaatgtatttgcctttcaaggtcaacttctttcttcttttcacaatttgctttaagctgttatactgaggtgactttattttatttgcagctttgtttccccctgtggctggatcaatgccattgtggaaaggtcagcagcttctgaaacacctttgtttggtaatggagtgtagggcccattttcaagacttttttttccctcctctagttctttctcctttccctcccactaagaatcaattccagagtcccatctgtgctttccctctaaatgactctcctttacaggtgttaacattgcatttaagttaaaacatgccattgcccctcataagccaggcacgtcctgttgtcaacacagtatatgctccattcccacaagcctcctgctaatcatccttgcattgtgaccgtttctgggtgactgttttgctttataaatgaccatttagtcctggtttgtgtgaatgcaatgtgtagagcttttgtgtccgagggctaagctgtagggtcttgtagcgtttgccttttgtgcgtctggtattggcagaaagtgagcttgtgggtcctgcaatgagaagcgactgccattgtggtgcttatcggcattattggacactaatggatggatagcagataacgaatatatccgaagccttacctttcttcctctcttgtgtgttaggaccgacaggatcattcagggcaaggtgagtgtaataacatgctttgttttaaatgacaaatcagctttggcttaattcattcactttctccctttcaataggtgaagataaattaactagagaagctttgggataaatcaaataagtgaacatactacttactttttcttaggcctctgatgcatttggctgagtgatttttataaatatgaacttttcatgcttcatacagtcagtagctccccaaactcccaagcagggcacctcaggtttgccatgatttagttccaccacctttctagtctctttctccattcttacccacacgtaccctttgttctagccatagtgaagatatcacagttcctgtaacaaatcatgcccagtcacctcttggtgcctttatacacaatgtgttcttacctcaaattacctttccctgctatagtctcccactctgcacccaccagccgataaactcctatgctacatgcaggttactgccacatgtcctatccttgttaaacctccggtgacccctttcccacctgtatattgatcatttccaccttcaggccacatctctacttggtacatgattgtacctattctaaacttaatagcacctaaggtcattttccaacttgaaacctttcaggagtttactctcttttttccccctaacttcccatatcaacatagtggtaaaattggtaagcattgtaatatgactgcaaagtccaaaatcctggctccactttttatgagctatgttaccctgggcaaattatttaatttctctggtctcaattcctaggtgttcttgggaaagtcatctaaatttcctttgcctcaatttttatgctggattccatgttatccacctggcatcatcaccaccattcccttctaaaggtcccttctgcatcatattgcagagaaacaggaacactttcccagcatttctttccctatatgatttcgtgttagagatagccaatgacgggcactggcacaaatgttgggaggcaggaaaggaggagccaccattctccagaagctgttgcagccagacacctgggcaaatgtgacagccacagtcatttcccaagaaactcttgagaatgacttgtttgctgctgtagctctaaacagtggtagaagcttcctggagattcttaaaacttttagaggcttgctagtgagttcttaaaataagtgactttgttgctgcctacagcctaggattgctggtggctgcttcccagcttttgtgttcctagttcttcccaatgttatgattatctctaattacctattttttatacctgtaatacatggagtggcttctgtttttctagccataccctgagtggtgcaatgttctcatcagtttaatgcagagaattatggtaccggcttcagagaattaactgaaaaacaaacatacctgaagctctttgaacatattatatacttcttaatattttgtgtccgctactggaatatgagctccattctattctatacacccttattgggagccttctctactctcagtcttgcttgcataatatatccattccttattttattagaggaatactatttctaaatgcaaacttgatcatgtctgtcttcttatcacgaggagctccccatctttctatcatccttatctatgaggggaagtggaaatcagcttgttggaatgaaagaatgaagtctaccatgattgatgacttatctactcacagcctctgctgtagccctactgaacttcaaaaggaacccaaaacttgctctagtatttcacacttctgtgtctttgctgttgctattccatctgctggggagaactttctatctttcatccacgcctctgagatcctaggcacaatttgtcgcatttggagagtcctctttgatcctgctgtatttcagccttatttatcaggcttgattgacatattcaattacatatttgtgtatttgtattttctttaattatgcaggatgtttgggaagagaatcctttcttatttctcttggcatttctagcccggaaactaggatagaataggtttcaataatacatgttcaatgaatgaatgatcaaacactttaatactaacataggccttataactttcaaaggagtacacttagccgtgggaattagaggccatgctgttacagattctgtcatcctgtaagagctgtgctgcagtttatggaacttcaagcaacattttggccagtgggcacgaagagtgatctgttagactgatagtgactgggaacaaacttactgctgttgtggctacagcagtgtcagatgtttggttttgatcatcctgattaggagaatatctaattcttcagagagagagacagagctattttcctctctgtcagtctggccgttgtcactgctgtttctttcaatgtggtaggcacattagattatgacctcctgctggcaaaagaggtcctgggtgcccatgtcaacgtgaggccagtgggtaatgtcctgttgtttccccacaagctggtgcaagagaagatgtatattttcagtgattgttcagctgcacttggaaatttttagcgagtgggtttactgcaggaatgcttagatctattatttaccaaatggtatgagttagagatggatgctatgtggcaggatccttattcatttctcatctgcagaggctgcttcctattcagctctgtgttctacttcattttaagtattcctaatgtttggacatctcccactccactcaagatgatttagtcatcagattgcagttgggaagttttcgcctatctttctgctttaattggtcttttgaaagctctactcccctgcggatggcagggagatataatagagtttgagataaaagggtctgggcttgagctctagctctaacatgaactagctttgtgattttggacaaatacttaacctttctgagcttcatgttcatgctcttttaaatggaaatgattataattgctcttcttacctcctagggtgtgttagtctgattaaatttcctaattctagggcaaacctagaggtagtatttctttttctctaaatgagtgagcttttacataggaacattggatcccaagcagtgaataaaacacagctgaactttaatactgcatcttatcctgctgacatccagtcgggaaagaatgcacaagtatatgtggcccaagaagggtcattccaggcacagtatggtatactctgatggtagaaaagagtagagtcattctgcactctgcgaggcattcttgtcgaattaggggctatgtgtatcttattggttctcaactgggggcaattttacctttcaggggacatatgaaaatgtctgaagacattttttcctgtttcaaccacaggggaaggagggagtgctcctggcatctgatgggtagaggccaccaatgctgctgaacattctacaagcacaagagaagctcccaacaacaacaaatgatctgatctcaaatcccaatactgctgtggttgagacacaatgatgtatcttatttaaccctgtcccagagttccagggccaagcaggatgagctgcattaggatgcagagaactctgaggaggtgatgagcaccctgaatggcttagcttagcccctgggcccacctgaattctgcttcaggtttctagcctaataagccctgcacttacatcaaccactgttagattcttctctgttcagtttccttggaaatctcttgttatcaatatttgctaatagttaagaatttagactttgcagctagaatgtctactttgaatccttacctgtcatttactagctatgtgacccataggaaattctctatgccttagctaactaaactatacaatggagatatgagtattcatcttatatggttatatgtcaattaatatgcacaaataaaaatactatatgccaattaataagcaccttgaatggtacttggcacttagtaagtgcttagcagctgttaaccattacgtaattgactatacttcagaacaatagcataccaacacaacattattgtgtggttctcataccattttactttaattggtcaaagctttatttcatgccttgcttcatgccagacacagcgttgagcagtgggaaatcacaagtgctctaagtgaactcacaggcaataagtaaatttgttactatatagtccaacgagtgtaatagaaccgtatatgctctactatggtggcaccagattggaatgattaattctatctgaagccatctgagaagaaagttagttttgtttttttttctttttttggaaggttagtttttaaaagatgacaaagcagatcaggaaaagttgaaagtagaaacttctccttattagcctaacccaagatgtgctatttcttgaagcttctgcacatctaagctgctctgtctccccaactggtatcactttgtattcctctccctcatctgcagtagctggaagacatcactccttcttgcccctctccactttttctgcctggatacatagatttatgtcagaaaatacatctttgtgtgggagggtctctgaacaggtgcctttcattccctttcctgctcagaagagacaccactgtaggaagcccataaacaaccactaatcttaagagctcatgcagctggccagctggacattgtattgtaccaaatagcagtgatctgtggagttgtttgaactggttcactctcacgataatcaggaaaaaatccttcctggtaaggaggggccagctgatagagcagaaagaaacttagaacacacacacacacacacacacacacacacacacacagagttaaaatctctttactgtagtttttagactttcacaactaccaaatgttctttccacagagaaacagagatgatgttttgcttgcaactgtatttttatgaactatatttgccttaagagttgagataaatatgagtttacatattcagtcttacagccagtctcctgagccaagctgcatactctgaatgcaacaatgaatactgaagcttggcttgatggggctgggggtgggggtggggtgtgaatatgaagagagctttaaaacttcaatatctctttcatgtttatctgcgagtgtgaaaatgccatgaatgatcaattaactatggcccatagagttgtggataattgctcattctctttcaaggaactttggttcccccaaatagttgctttattttaggcatggggcttaaaacattaaacttattttcattatcagagcacgtcttagggaaggcaagtcagatgaaagctttattattgctaattatagtttcatatctttagagaagcacctgtgtaaattgcacatgaactgctgttctttgaatgcatgcaaattgcattatgtacatggtacttggcctcttgttttcttgcatagcaagttgtctctgagatgtgagatgatttcacggtggtgataggcccatttgcaaatctgtttatagtaattaaactatcaaaataatgttccatttctcttgaattccaaatgggctgatttcattagcttcatgtttgggctgaccctcaattaaactgtgagaagcaaattgaacttgcgtccttggcagcagactttctctaccatgtcttctactctggcgttgaagaatacagtttcaccaaatctctaccttggcattgttgccattgggcattaataattcttgttgtaggggcttgtcctgtacattgtaggatgtttagcatcatctttgacctcttcccactagatgccagtcacatcccctgccccagttgtgacaaccaaaaatatctccacgtattgccaaatattccctgggaagcaaaatttcccctggttggcaaaattattcctagttgaaaaccactatgctatttgatgcttcatgtatatggaaaagaaaggattctaaaatgttgaaaccctaaaattgtatgctggaccatgtggcaggttctttggcgttacctttaaaggaccataggtactgatttgctcaggcaactcctgtttcacacctgttgtaccaccaaaattattaacagaaccctgtttcactttcaaactctactgattctaatggtaaattgtataggtactctagttttgggggagatgctcaaaactttgtaattgcataaaaggaaattaggctcagaagttcaagtaatttaccaaaggtcaggttacacagctactaaattgggttgctaaaccttgaaaatgggactaagtccaaagttgcatcagttgctttaattttctctttccaatttccccagagtgatctacagtaaaactcttgacgctaaaaggatttcaagaacagccttgatggcaagaacttggaagagttcatctttctcagtatccagacaggaggagagagagttgagagttggacaatcctagtttcaagtctgagttcatcatttacttttttgtgaccttggcaacatgcctcctatatttctatctctagaaaatagagataataaactgaacacaaagttatcataagggttaaattagattatgtatgtatagtatggcacctgccatatattaagcagtcaatcaattgttgatatgatgattactaactccaaaagaaaggggatgatggtagagttcaagatattaaagggaaacaggcaggaccctaggggctgtgataggaaagaagggccacatgaggagtggggctgaactgaggactagggtgatatcttactcattagtgctctatggttccctcgaagggcctgcatctgggaagaatactcactgaaattttctaacccaaagcttaatagggtatttcaaatttatagggaaatttgaaaagcaaaacactataaagacccaaagccatagagatagaacagtgggatattgccttggaaggttagcacaggagttaaaatgtcagcggttaagttctttccagagccaagcagtgtgtgttcttcagccagccattcttctcctttgaaccttagttttctcattgtaaaatgaagaattgtgactaagccttagtaccttaaaaaagtcacaaaatgactttatagtaatgcgaaaagagtaccaacagaaacaatacagccagccacagctctattatctctccaaatgacttatattttgattcaaaattatgtgaatctaaggggttatcactgggtagcggcaatatgactttcattttaatttgtgtgtgtgtgtttacttatattttctaaatattctaatgtgcatatttattatttttcaaatcagaaactattcaatgctgctaaattttttttttagtgtatgaaactgcaaatttaatagactggtgggggaatactccctacctagaaaacaacttcctgcatgtcttactacttagaaagtaggcagtgtgcagccctgcttggcttgtggagtaatatagtgtggaacatgctaataaagacaatgtatgacatctactggctccagcccccacctgcatgtgcacaggtgcctggtgtggtgtcattgtcctggtctttcattttggggaaaacaaatgcatatgtcttttggctcatttgaatcaatgggtttcagtgtaccatattttactttttcattttttacatatattaataatcactaagcattgctctaagacattgcagtgttgcatagaaactattctaccaaaacagatgcaaatgtttcttagaaatccttccaaaatccttccttttgtaagaaagcttcttacaaaagccttgctacaaaaaagatagcgatttacttctcaaaagtaataacaattcctattctttatagagaagaaaagaaggcctagataagttttgatgttccagaatgtggaaacaccaggtcattcagaaattgaggaaattttaggaatgcactggtttcgttcatttatttacttcattcacaaatatctgaactaccaaaccaacttagaaaataccttctacattgatttacttaaaatcaagtaagccagaggagtgatcttgactattatttttatcattaatttgactacattgtctgttttatggctttgtttacccaaaagagtctttgaaaatctgtcagtattttggctcctggactcatatggtccccataggaagcgctgtaatagttatggtctcacatatgtatcagttccaattctaccactttgaagtgttagttaaaatttattgttcaaacttcttctatcaagcgggagtaatatctatcttaaaggattattttgaggagtaactggatataaattgcttacaagaatgcctggcatagtaagagctcagtgacatttagcttttatttgtgttatctctcatgaaaaggcttgcattctatcagtgaaaaacatgaaacaaaataaacttgtctaaaacaagacacagcagcaaaaatgatcttccttctatctatttagtttccagggtttattcaataatttccaaggctatagtttcttataattcagactattcttccacctttcctatttatgtacattatggttcattgcatgaaaaagaattacctaaaacttttcttcctgtcttgtgaatgaaatgtcctctgtccgtttcaactcccagtaatctctttctgctacaaactgaaagtgtttcttcatctcaatctgattcattcattcatgaaacacttgcaagccagctctgtgccatgtcccactccctaaagatattgtataaaccatacagaaaatgtcactgtcctcaaagagcttgtcttggggaccatggtctgtataatgttttttgaaatttttatgtatcttttattgttggttaggttgttatccttctgaggtagaatccgcttccctgtacctgacatggttatttgtgcatccattacaggtgctcaaaaagtacttgaataataattataaaaaccatagcattctctattgagcttttggtataccaagccttatgctttagatacgaaacttcacttaattctcacaattctgtaaggttggtgctattctccttatttcatagttcaagaaagcagggacagcaaggttaagtaacttcccagggtctcagagctggtaagtgagggaatctggatttgaattcaggttaatctcattctagagcccattttcttaacttgttttgctatactagatgaatagatgcatggctacctgcataattaggtgaacaaatttaatgtataggaagtttacattatgtatatatcctggatttcctctaattctctctttgctggtttctcctcacttgcctgagttctaaacattaaaatgtcccaggactctcttcatggacttttctttctgtttatactcactcccttcgtgatctgatcttgttctgtggttttagatagcatctatgtagaagtgatgcccatgtttacatctgatttcagcctagactgatattttactgattgctttatatctccacttgacgttgaaaatgaatgcaaaatttaacatgtcccaaaatgagctccagttattccccaacaacttgccctccccaaacctgcatcttctttagtctttcccatcaattaaaggcaattattccagttgcttaggctgaaacctctggagtcattcttaatttctgtttcttccattgcaatttcaattcattagtaaatcctgttgactccctgcaaaatacatttagactctatctggtcacatcttcgcatttttattgtcatcatcttgtttaagcccccataaactttcacctctgttattgcattagtctcttaactcttctctctgtttctgcccaatctcttttgcaaaccactcctaatatggtcctgttaaattgtaaatcagatcatgttattcttcttcctagaccttttcagctgcttcccagttcactcagtgtaaaagcaaagcttggaagccctacctagtgagcgatgcccttacctccctgatcctgtctcctcctgattctccccatgcttagcctccatgctggcctctgtgctgacctgccaacacagcagacaggcttctccatttgggcctttgaaattactctgcatggctcattccctcacctcttcagttttttactcacatttcactgaatcagtatggtctttgctggctactctgtttaaatagcatatgattcccattcgccatcccccttctctcttatatagtctccacagcaatcatcactgtctaaaatactatccagtttatgaacaatagatggcaagtagtataaaagcagggatttttgcctgttgcgttggttgtcccagtcactatagaacattgcctggaatattctatgcactcattcagtgtttgttgaatgaatgaataaattgtgtatttactttgtgtaaggcattgtgttgagcagtctacattcattattaaattgtaaaatattcaccgtgatcctttgagttaagtaatcttaccaaacatcctttatagatgagaaacatgagcttgagagattaagtattttgctcaaggtcacacagctaagtatgacataggtctgcataacctcacaaacaattacattctgctggcttttgtatgccagcccagattttccaccccagcccttcttagaaatacaggcaattttaggcttcttgggcttttccttcctgtgggctatgacatggcatttcccagcatcctgggaaagattaacaagcattccttgggagaaggggtagaatcaatgctagcatttattttcctctcactgagcattaaaggaagtagataaagcaaggtttaggacaaaaattcattttaaatgaaatttatatgaaaagtgctaaacactttgttctagttctggcaaggcaataactctgccatgagacagaatgccagtctgtctcacagggcacctctacttggatcatcaaaaagggagttcctgtggttaatctgggaaaagcctagtttagtttagtttagtttagtttagtttagtttagtttagtttagtttagtttagtggtttcatctctatttctggttttctatctagtttttatgatcctggatgtttttttattgccagctagtgatacactagtgattattaacaaaggtaaatgaaacaagattccaagctgccagaataaacaaatccataattacatgaagtccattcctagagatcctctttgtgaatcttcacattaggccatagttgacactgatcttcatgcttgtttttcttcactgcaggtatctctcaaggatgttgatgggattatatacaaataatgctttggctctctcagagttggcagatctcagcaataaccacctcttaggttctgggattcttcaaataagaccagtggggaagggccgttttaaaaataatttctgactgtttacagttcctgaaggactttttcttcttgttttgatttttagcaaaatgcagtttagtttccctgaaaccttaacaatctggaacagttcattgttgaacaaaaatgttcagttaaaaggcactacaaggagttgtattgctgggtgggcctggcagtggagaagatagtgaagctgagctgtgcttcatgcaatgctgaattgctgctgctgcagtgtgtgtttttttctggagtctaactcatgcacacattttataaaaagttaggtgtattcaagtctgcagcaagaatatgtccccatactcagttctcagaaactttgttcgctgaagaacgagctgaaaatagagtaaaaacaaaatgtaaccatgtaaaaatcttgtgtacccacaccctagaagccattctatatttctgaagggatgtaagagtgtcacctagcacataagatgtccttgtttggggctgttccttggatattttaatttaattagtccagagaaaatagcacatcagcattttattttaatgctctcccggtgattctaacatgcagccaggattgagaacctctgctttaagccacctctgggctgggtgggaagagaataattacctcttgcaggcttaatgcactttggccagagaaaatctgacccattcagagctaagaaaacatttacaaaacaggggctttaaatcagtgactccatgctgaagacctaaattggcatttcaaagtgcagtgataacaggtaatgcccactgacgaaatgaaaagctaggattgccaaagcagtttaattaatatatttccccaagaatctactacaactgtcccagtctgattttattctcttttgctgcacttctctcccattttcccctatcagttgtatccatgctctctctacctctttcttttttaacgttacctttcttctttgatttatatttgtctacttttttctttcccttttcttatttctccctttggccagagtaagagataaggtttattttgtgctgtttgcagtgtttattgaggaattgtatgtctctaatgatttattttaaaagcaaattagctgggcagtttttatttctcttaatttaaaaagctctcaagttattattattttatttgtatattgcccttaaaagtttataacccctaactctgctctttccctctggtggtttctggaatttagtagaaacagattccctgcctaagctgttacaacataagttaaattggaatcacctgagccagttactgctcctttccaattctctgtattgtagatttgtaagtgttgactttaatgtttctgaaaccaagcagagaagtacacagatttttgcttctttgtaaccgtcttgtttgggtggtaaggatgtgcttgctctgctatactttaatcgtattcattaaagggggaagagaaaggggttttgtcctcaacaaatgacacaaggactcaaatacagaagtatggagttcttcttaggccatatttagttcactttaacaagcttaaatttcctatcataaagttcaatttatgaagttaatttaaacgtcacattacaacgtctatactgtcttcctttgatttttatctttcgtcaatttggtgtctgtgtaacacacttgttttgttgtgtcataggtttatgtttgctgagtcttccaactcataatttcttcctcaacatctcctcctctccctcacaatcctgttatcatcaccaccaccaccaccgtcaccatcactgtgatcacacaaatgcactatgaaaacgtaattgaggtgtgaatccctgtgcaaatgcctgacctgctagggttgtctctgaaaactccattttaatgacttcaactagattaatctgattttccaaacattttttccttgaccaatttgctgccataagtcttggatttgggttcatagtcccaagtacaagcaggagaagaagaagagaacaggagaggggttgaataaagggcatggaagaacatttgatttaaataaaggcaagaaccacctactgtactagcgtccagctttcaatcctctccaatcctctttcaatcttctctccattcatctatttctgtaatggaaaagaaatgggaaaaccattaaccacttttattttgatggcaggcgcattatacctgaaaacaagattgaagatcttaaaatttctccatcatcagcaagacctctagagtgacctgctgaatgggtacttgagagattgccagtacagaagtaaatgaagtgattggaagctcatcacgatatattagatgatagatctgcacaagtttgggaaagtgacagcctgtagtattggatgttagcttgtgaattgaactttaaaattacgttagatatttctttaggggtcagcagaaaagacttggtgaaacaggcatcttgtatgagaaaattgttactggccttgcatgtcggatgtaggaactgtagatggccaggaagggtccctgattcttcctggttcaggttaaagccttgtcacattgagaagatatgatatatctctgtatgggtagtttgcactttttgagagccatttgaccttttagtcgtacagacagcagttatacatgaaatgtcttggctgaggtgccttccttgggcagcctttttgatattcagctaatgctgttaaaccagaaacttgggtaactggagtcttgtatttgattttcagttacatattggaggccagttaacttatttgattaggacccagtgacaatgagaactaaccaggccattgcctcatataattcaatttcagagatgttttattttcatctttgatttattttcttatgttattttcttgtattttttttttttttttttttacttatttaaccttgtaggggagggagatattcaaagttggcaatgcttttgcaaaaaagatgttctaaaacttatttgttaatttttttaaatttagattacagtagcaatgtgttcatttagagaataaagacaaaaatcaccaataatttgaacccctccatcgtagctataattactattgatatttggcatatttccttccagggttttactatgcatgtattctattatcattcttaattttaaaaaaggttttatttctggtttaggaacagggttctgctgtgttgcccaggctggattctaactcctgggctcaggcaattctctggccccagcctcccaagtagctgggactgtgccattgtgcacggcttttcttaatttttacattaccatctatatttgaataaaaagggtattatactttcaatataatattctttcttaatattctatcattagcatacttctcagctatttcatattcttttagaaaattaattataatgactaggtaacattgcactgtacagatagaccgttctgtgcacttccctgctgttacatatttagatcattttcaatttccattcttataaataatgcttcagtgaacatccttgtatataaatcttgtttaaatccctgactgttccctttgagtaattcttatgttaatgttcagaattcttttcaggtataatgccatttctatgagacttgctaattctgtaatttattctttggatttattgacagatgcaaggtagcagcattgtgcactgtaagaaattgtatcagagtttaggagacagattgagaacacattctgatacttcttagttgtgtgatattaaggaaggtggttcaccactctgcctgtttcccttcctcatttgcaaaaggaagaatatggaacttgtctttctttttccagttgtgaggcagtgaaaataatagcactttgtaaattttagaacactttactcttttaagatttttcttaacatttcttagtgtagcagatttttttttaagtggggcatattactttttgttttaatttattataaataaatgattttaaacagatggtaagatacaaaaaataaaattgggccgggcatggtggctcacgcctgtaatcccagcactttggaagggcgaggcaggcggatcacctgaggtcaggagtgcgagatcagccaacatgaagaaacccctgtctctactaaaaatacaaaaattagctgagcattgtggtgcatgcctgtagttccagctacttaagaggctgaggtgagagaatcgcttgaacctgggaggcggaggttgcagtgagccaagattgcgctcctgcacgccagcctgggcgacagagtgagactccatgtcaaaataataataataataataataataataataataataatgataaaataaacaaaattgaaaacaatccgtgtggctaccatctattttaagaaatacctctttatgtgttaattattaatctaggtcaggcattgtacttcggctccagtgcattgcccctactcccccaggagtctgtcattctcagcatgtctttataacttcactggctttgaagttgtatcctttatttctttattgtgggttgctacccttcaagttttaacattcagacttaccttaacaaaatctaaatatatttttgttttccttatagactttatgtagaatttttgttgttgtttttgttgttgttgtttttagacagaatctcactctgttgcccaggctggagtgcagtggcacgtctcagctcactgcaacttccacctcccgggttcaactgattctcttgcctcagcctcccaggtagctgggattacaggtgcctggcaccatgcctggctaattttttgtatttttagtagagacagggtttcaccatgttggccaggctggtctcaaactcctgaacttgtgattcacccgccccagcctctcaaagtgcttggatacaggcatgagccactgtacccagccgatgtaggatgttttaagtccaaacatctctttgtctttcttgttactttttccagacttttagttctaatttgttttgttactaccgaaatcaattgttatttatattattatactgcacagtcatgttgatgtgatttatccatgtaggctttgctcatcattctttcctaatctcaatctttcttcctggcttgctttcctttgatataactgttgcatctgtgagaagtttctttagtgagaactgttagtggtgaacacatttgttttttctttatttgaaaatgactatttcacttttatttttaaataatgatttatcttagtgtttaattctaagattacaggcataatcccatggtcttttggctctcttggtgtgaagtctgctaatgtggaccttgatattcctttgtagatgatgctttttaccctgattacctggatgatcatctcttttgctttggtgatctgctgctttattatgatttatccaggtgtgggttactttgtattaattctgcctggtaataatttcttgaatttgaagattggtgattgtcataaaatctggaaaattttcagctattctccaagtatttttttaaatttaacttctattttaagtttaggggtaaatgtgcaagtttgatatatagtactcaatagttattttttctgatcctttccctcctcccaccctccacctccaagtaggctctagtgtctgtagttaccctctatgtgtccatttgttctcatcatttagctttcacttataaatgaaaacatgtggtatttgattttctgtttctttattagttttctaaggatagtggcctccagctgcatccatgtctttgccaaggacatgatatcattctttttttatggctgcatagtattccatagtgtatatgtaccatatatttttttaatccagtctaccatcgatgggcattttggttgattccatgtcttttgctattgaaaatagtgctgcaatgagtatacacgtgcatgtgtctttaatatagaacaatttatattcctttgggtatatacccagtaatagaattgctgggtcgaatggtatttctgttttttgtctttgaggaatcaccatactgtcttccacaatggtgaaactgatttaacttctactaaccctgtataagcattcctttttctccacaacctcgccagcatctgttgttttttggactttttaatgatagccattttgactgacatgagatggtatctcattgtggttttgatttgcatttctttaatgatcagtgatgttgagcactttagttttattagattcagtttgtcaatttttgtttttattgcagttgcttttggtgtcttcattatgaaacctttgcccattcctatgtccagaatggtgttgcctacgttgccttgcgggtttttatagatttgggttttacatttaagtctttaattaatcttgagttaatttttatatatggtgtaaggaggggatctagcttcattcttctgcccatggcttcccagttatccagcaccatttattgaagtgggaatccttcctccattgcttgtttttgtcacgtttgtgaaagatcagatagttataggtacgtggccttatttctgggttctgtattctgttccattggtctgtgtgtctgttcaggacctgaactgagcactggatcaaatcaaccacagaactctctacccaaaaataacagaatatacattcttctcattgccacatggcacatactctaaaattgatcacatcattggaagtaaaacactcctgagcaaatgcgaaagacctgaaatcataacaaacaatctcttggactacagtgcaatcaaattagaaatcaatactatgaaatttactcaaaaccatacagttacatggaaatttaataatatgctcctgaatagcttttgggtaaataatgaaattaaggcaaaagttaaaaagttctttgaaactaatgagaataaggatacaacatactagaatctctgggacacagaccagagctaagagggaaatttataccactaaatgcccacatcaaaaagctagaaagatctcaagttaacctaacatcacaacaaacagaaccagagaaccaaggtcaaacaaatcccaaagctagcagacgacaagaaataaccaagatcagagctgaactgaaggagattgagacacaaaaaaatttaaaagatcaatgaatccagaaactcattctttgaaaaaactcaggaaaatagactgctagctagactaataaagaagaaaagagagaagattcaaataaacacaatcagaagtaataagggggataataccactgaccccacagaactacaaacaaccattagaggagtctatatatataaactggaaaatgtagaagaactggatacattcctggacacatacaccctcccaagactgacccaggaagaaattgaatccctgaatagactaatcatgaactctgaaattgagtcagtaataagtagcctaccaaccagaaacaagcccaggatcagacagattcacagctaaattctaccagatgtacaaagaagagctgatactattcccactgaaactattccaaaaatcgaggaggaaggactcttctctaacatgctatgaggccagcatcatcctaataccaaaacctggtagagacacaacaaaaaaaataaaacttcaggccaatatccttgatgaacattgacgcaaaaatcctaaaaaaaaaaaaaaaataaaactggcaaatgaatccagcagcacatcagaaagcttattcaccacgatcaagtaggctttttccctcgaacgcaagcttggttcaacatatgtgaatcaataaatgtgattcatcacataaatagaaccaaagacaaaaggcacatgattatctcaatagatgcagaaaaagctttcaataaaattcaacacccctcatgttaaaaagtctctataaactgggtatcgaaggaacatacttcaaaatgataggagccatctatgacaaacccacagccaacatcatactgaatgggcaaaagctggaagcatttcccttgaaaactggcacaagacaagggatgccctctctcacaactcctattcaacatagtattggaagtcttggccagagtaatcaggcaagagaaagatataaaagggcattcaaataggaagggaggaagtcaaactatccttgtttgcagactacatgatcttgtaagtagaaaaccccgtagtctcagcccaaaagcttcttaagctgataaacaacttcagcaaagtctcaggatacaaaataaatgtgcaaaaaaattaacgttactatgcaccaacaacagtcaagctgacagccaaatcaggaatgcagtcttattcacaattgccacacaaaaaataaaatacctaggaatacagctaaccagggaggtgaaagatctctatgaggaaactacaaaacactgctcaagtaaatcaaagatgacataaacaaatggaaaaacatctcatgctcataaatagaagaattaatatcattaaaatggtcatactgcccaaagcagtttatagattcagtgctactcctatcaaactaccaacgacatccttcacagagctagagaaaactattttaaaatttatatggaaccaaaaaacagccaaatagccaaggcaatcctaagcaaaaaggacaaagctggaggcatcacactgactgcaaactatattacagggctacagtaaccaaaacagcatggtgttcttcaagtattatctctttcccatattctctattttctcttccttggaactccaattagacttgcattctgcctttgaagtctctcaatcctgatttccacactttccattttcctctgctgcactcttggaaatttatttagatctctctgccagttaatgaattcttcctttagtcactgaattcataatttcagtgatctctctctctctctgtctcacacacacacactcacacacacaaacacacacacttctagaaattctgttagtttaaaattttgttttctggtttcctttgataggatctttttcctttgttgtatttttagtccatgttaaatttttaaaaacatgaaaaacatttatttttatgacacgtattagataatactattatctaatgttattattagtcttatttcactgtttactcatgttctacttactttcactcatagtgtctttttttcttattcatctagtagtaattttggattgtgaacttattttcagcagcaattatcatagggatcctgtgaagcctggattaaggatgtacctgcaagtaccagtactgtttaatagaaatttccacggtgatgaaaatgttttatatcttcagggttcattaatagtagccactagccacatgtgattattgagctcctgaaatgtggctaatgtgagaagccaattttgtaacttaatttaattttaattaattaaaaatgtgaatttacccaccttactggatagtgcaggtctagagagctttgctttggcttcttctaagtgcatttgggaactgctaaccttgggccactctatgttaattttttggaaatggctatctcactctacacaaataaataaatttgaccttgaaactgtcagtgtaggcctgtgcttatacaattctaggggatatttttatatatacaaggaagacatattcctcattatccatctcccttttctggtgggcagataaatttttagtccacatgttccccgatgtatgcctagttttttatatgcatacattgcatatgcatagagccccagctttatttaaggatttaattttccattttgagaaaatctaaatccttctctgctttcccaaacagtcatcgaaacctggttatagagattggtaaacagctccaaacagttatttgggcagcaaccacttatatctctcttttcagtccctccctcctttttttgacccctgcaaacttcccttaaattcttacaagctcagagagtcatctgaagaagggtttgctatattttatccaacattactgttttgtaatacgcagttttcaggacatgtattctgccttattgctggaaatggaagtgtccccagttctttttgactgattaatttctttattgtggacaggtattggtagattttcttgctgggcatgaagagagatgtttgttggttgttaaataacagaacaggaatgtaaaaatgttcctttcatgggccattaaattcaggaaaaaaatagatgaaacatgatactatgtattggcaactgaatgctgtttatgtgtttatagttagggtttaacatacctggcttataagcgaactgcaagcatccattctcccagctgcatcagggcacaaaggattattaatatatgagccacgagtccatgttgtgaaggtcatattgccttattgcaactgtacaaaaggcctggaagataataatgagattcaatcagtgaggcaatagatcataaatgcttttgttgttttatgtgtttttggttgtatttggaaagataatcttggtttgatgagtctattggttataactagtcaatatgttttctatgactctccatttaaaaatgcatatgtaaattagatgctaacacaagaaaaacaactatatgatacagaaacagaaggccaagggtaacttctactagaaagagaagtatataactatatttggactgaggtaaacagggaagggttagcactgctggcttattttctgatatttgcttggctaagtttttcttaccaactcaaacgccactgccaatagaaatctttcctgaccatcctggtctcttactactctctctgtgctgtggccctgttttattttctccattgcatttatcatgatctgaacacactgagatataattttggagagagtggggaggggtagattagctcaactcaacagtgtggcctgtggaccaatgctggcctgcaaatgtgtgttactagtttatgacaagaaaaagactttgctctagactgtaaatcaactatgtcactaagcatgctgtttatttcagatgatttttttgttcatttgtctgtttgcattgtgttctttctagcaagactttctctttgaaggaagtagtgagtgctgacttacattctgatgtgaactccttatcctgtggactgtaggaaaaagtactcagactaaccactttgagtaacactgggttagaggatgaagaaggatcaaaaagatcaagggggtgataaggggttgaagtgacactagtgggagataaatgtaaggtcagaggtgaatttgaaggagctatgtttaagggaaaggggaagagtttgagataagaatgactccaggaatttttctttttcttttttttttctccgagacagagtcttgctctgctgtctcccgggctggagtgcactggtgcaatctcggctcactgcaacctctgcctcctgggttcaagcaattctcctgtctcagcctcccaagtagatgggattacaagcatgtatcacaacacctggctaatttttgtattttgagtagagacggggtttcaccatgttggctaggctggtcttaaactcctgacctcaggtgatccacctgccttggcctcccaaagtgctgggattacaggcgtgagccaccacacctggccaggaatttttctttttaaagtttatgtttactctgtcacagaaaagttttatatatgacccctaaagaaaaagttaccactgctcattgattttctagatggagcaaaattcagtattctggggaagatgcgtaccaaggtttctggtaaacatcttcaatattattattgccaactggtacaattttcattgtataaaacaaaaaggtgcaataatatggcaggtttgcctttattgagtccccatttaggaactaacagagagaaaaattcttatctaaaatgaataaaattggagggtaggaattcccaaaggcagtttgaggtcattctggagctgatatatatctctaatgcccttattctattaacccacacctttcttggcttttggtgttacaaagccctcttttgaaggagctcaattttgttgcaatggatgcaataaatcttaataactttgtagaaattgtataatttaacttttttaccaatacaaaagtaacatgattattttgaacatggtggaaaatacagataaaatataaataaaaatatatttcctcctaatctcaccagcctaaaattatcactaatattggtattttttcccggctttttttttcttgtgccctcatataatttttttttacaggttgaaattattacacacacacactatatatgtgtgtgtgtgtaaatttaatactaggcatcatgtgaaaaaactatttcattagaattacttgtaaacatcaattgaatggttgaacaatatcctatcacaaagagaataaaatatataaatattctacttctttgaacatttactttgctttacattttttcctattatatgtatgagttgataaacatctttttactcatctttgtttacattttgaggaaattgctgtattaattaagtagttgtatgcaaatgtattatcgtgcatcaaagccttgtatctctctaatatttatacctgtgcctatattcctgcctctatcatcttgtgctctttaagtcatggatttgttggtagtcctggctcggacccttcctgatatgagcacaaagaaggagctggtttactcttaatagagattttttatgtctgcttggacactggattttctccatcagtatcattagccagtctttgacttctttggtcctcatagccaatcttagattaaaaagaccagaatgagtagttcatccaatttcagtagttttcatggcaaatgtttaaaccacttattactcatattatcttggattgttagaaaaaaataactgttcgctgacctaatataatttataaagctattacacatcctgtttgtagcatgaatcataatagaccttaaaattctaaaaggataccattgtacgaggaatgattaagggagagcagaggaaaaaatgagattgtcaaggtcagtaatcagtgtccttgctttaaaagcaatgtcacctgctgtggctttccagctttcctttgtcaactttctcctattttataaatatctttaatacattatttatgaaataggccctttcttacatctataagcaagctacaatatacgattatgttgaaagaatttagagaatgattcctttggtcataatttgacatagtacagtgaagagaacaatggcacttgactgagaaggcttggtggaaagtccaagccgcactatcatgtatcactgcatgactctcagcaagtctctccactgctttaaaactaatcttccacgtcaataaggtaatgccttaccttgcgtagtcgctttgagttaacacaacatagttaattgttaataaaaatagttaatataaatataatatcatggcattaatggatgaacattccatggatattgagttcaatttttaggctacttttttatagcaaaaagtcagagagtcacgtgaaaggtaactgagttttatttctcaccagctataggttgggtggttagtatatattaccttatcacctttcatgatgctcacaaccactctggagaaaatgtggttccaagagaatgtgtaagttgctctgtaagaccatagttccagttgcttgcagaagtgggatttgagctcacctgggtctgattcaaaaattcaaggtttttatactagaccattattcacaaagttttaaaagtggaaaatggacaagaaaacctagaccttgatttagttatgtttattctaatagtccttaaatatgtacaaacaaaatcaggtgtatagtgctaataattatgggtcttacacaactacaaagaaagttactaggtaactgtaaacaaaactacagtcgaatacaattcaaattaattacaatgatttaacatgaccaaggatggtgttttgctgaagtgaagtcagcactggcagtgtgtgtgaagcgtggattctaaggtacaggttctttggggctggtgtgtgcaccgccacatgtggcatggtgattcatgtttctcttcttgctatatttgaaccatcgctaagtcttcttttgagaagcatgctgtaaataccatcttgccttcatttagcttgaatacatcatttatgaatcaagtctacttttacgttttttctcatttgctaacaatacttaaaatataacctcttaacacaatgtattataaacgaaaaacaaaaatgggcataaaaattgcatggcagtattcagttataaagaattcatcaaaacaatccagaatatgcttaaatgaaaatgttaaggctattgtcaaaatatattgttgtatgggattcatagatcctggaaacatctatgtattattaatgtcctgtggaaccattttcagggcagtgggccatagtgctatgggccatactactatgctcatgagcagcagcccacagggaagataaggtttgagaggcaacaggacaaggggctaagaaaatgaatattcacaggtattacggagcacagtattgctgtggagcagtatccattgaaagagtcaattatggtgctagtccaaacagcacatcacctacatcacccagccaaaagctggggcctcagatgacagagaagccagaagttgtctcagcaccaggtgcctgaaatggaaacccattctggagacagtggcttccttactgtagctaccttcttgtcatctcttggtggtgagagccagtactttgccatactgacctgaggacttgcaggtgatgacgtttgaaaacatctgaggtaaatgggaggtcagggagctgtttccaacataaattccaagctgtgtgttccagctctgtttgaaactgtattttaccgtatttggcttattaccatggcagtagctgtatgatacagaatatgctttgtgagatttcatttcatttgaaatgcctatttttttttatttttagtgaatcaacatgtcttttcataaattgaggacatagaatgaatagcaattgcagatctgtacattgaagcatcttctggaattgcaataagcacactgaaaattgcttacggtgctattaataactcatagtggtggaaaagggggcatggctatgaaaaaatatatttttaaaacaactgaagatggatgcaagaaaatttgccagtcccatttggggagaaagagctggtgtgggcaatgagagtactgctattcattcaccaactttaaaagtatttattgtgcacctactatgactgggcccaggcatctgtgttcattgcaggggatataacagtaaagagattgaaaagctctggctctgaacttgtgaaagttatattctgggtgggagatggatattaaatgagaaaagaaacaaatggacagattttaatacatgctagatgtaaagtccttaaggttagaaagaacatggtgtgttctagggagtgtggcttttgctgagagagaaagggagacagaggcaggtcatgatgtgcctccaccatgatgtccatgtaagggttcacgttatgaaaggtccatgggctatgttaaggaatattcaatttttctaagtgtaagagtttactagtaaaggattctaagcagagatgtaacatgtgatttagatttttatgtgatccaacgactggtttttggtgaatctattggaggaggcaatagcgaaagcaggaatgccagggaagcttctccagtgagagaggatggagattgggtggttgctgtgaagataaaggaaagtgaatgagtttgagatatatttattgaagttaaatgcatggtactcgtttctgaattgaatatagtagggtaaaggagagggaggagtcagggatcactccagggtttctggctttagtaaccgcagataatggagtcactttgagaagggaaattgcaagatttctatttggaccatgttctttttcagatatctgtgaaatacataagtggagataagcagtagaaggttggacacattaagtcttaagttcaaagatatctgctactggagatatatcctgggagttatcaggatataaatgacatttgaaaccataaaaatgcttgagattggcagagagaatgatagggctcagatcaaatcctgaggatgcttgaagtttagagttagggtgcagatggagaagccaacaaagaggatggatacattgtgcccagggtgatagaaggtgcctttagcaagaaagcagcagcaggaagggattttaagaaggaggagttaattctgtcaaatgctgctgagatacattaggagatcagaaacatatctactgtattttacttatcaggaggtctgttgctggtgaccttgttgaagcagttttcataggagtggtgagggcagaaagctgccagaaaggaagagtgaattaaaagtaagaatgtggagaaagcatgttaagcaacgcatttgagaagtttggcgtagtagcagaaaaatggatcagaaagggcagatcaggggacaaatggaaatttgttttgctgttgtttggttatgtgtatgcatgttgatgttttaagatgagcgataccagagcatgtatataagtgaatgggaaagatccaatagagatgtttgaagtaggaaggaggggaccttttaggagcaagtggcttaacatctaggggtcaagtggggaaactgcccactgataggggaatggacatgcctttttttcttaacaagaagtaaaagatggatgcaggtaggagtgttgatttgatggttggaggatgagagtgtttctatattagacagtgtggtttctctgtgaagtgggattatcaaatgagagctgtaaagtatacatctgcggcctctgaaggtaagagaaggtttgactagtctcagagatggggaagaggggctaaaaggaatatgtagtaatgtccctctgacactctacacagctggttgtgtgaacttgcttcagttagttgtgtgaaagcacagaaaagtagaaagttgagttcaaaaaagtttagagtttagcctgggcaagtacatcggaaaacagatggccaagggagttgagcttaggaaaatgattaaaaagaaagattatccagggcaagtaaaggcaggagggcaggctgatgaatagtgagaaagtaaatagattaacggattggtatcctctatgagtgagaaatgtggcagaggctaaacaatgaaagtgagttgagagcctaagagatagtattttgaatcgtaaaaggttttaggtgagatggttggagctagcacagtttctggttatgataaggcgagggtgtgaataaagttgtgaatgtctgaagtggtttgagggaagagagtgttgaaggtgacaaggtcaagaaactgagagtccagggagactttttcatagtagtattttgagtgtttttcaaattgttctgtggcatacagaaattatatacataggaaatgttttatagagaagagtttcatgttcaaatacacttggtaaacactgcatactattctatcaccttcttcctcacaatctgtattagcataatagtttatattagcatatagaaagctccaagaagctctgctggaaagatacctgtttaatgtacttaattaatttatgttaattttattttagaacttttctgttcttgaccacctcctcatttcttacctttgctaaattttcttggctgttttcaccattgcagtcttccagactaacatagccacatttcagtaataatcctatatggactctaattgaaattaaattaaacatataattaaatttcagaataactgccttttaaacattctttagtttagtcataaatgcctttccacgtattcaaatactcttgagtctctaggtaaagttttataatccccccaacacacacatatgtcctctctgaatatttcttgttaatgttatttctggttatcgtttgttgtgctgctaatatggtgattatctttttccattgtattttgtaccattttattgcaggcatttaaggatgctattgatttctgtatatttactttatatctgtctttattactgaactcttttgtgagtattaatggcattttaattcattctctaaggcagtgtttttaagtctctgtaaggtatagaccaatttttaaagagaaaaaatgttttgagcaacctgacaatttaaattatttttgagataataagaagaatatttctaaaatgtaaaacttataactaagagtacacttcttattctggtggcttttaatcataaaccacaaaactaatcaacatcaagttaacagcacttatcatatatgttcttactaccattatttggctgaattcaaaccagtgcttttggtatggctgtgtactgactgtttcagcctagattgggtttagcatgcctcaactataatgtgttctgtgcaggctcaattctctctctggtttcctcttttcccatcactgcaagaccttcgtttatatcattacttgatgaaaatgcaaaatttatgttatgtccgactttgttcttttcttatcaatactcagtgattaaaacagtaatacttaggagcaattgtgtcccaatcaagtgacattcacaactataattattcttggcctgcaggccaaatgcagctttgcccatttatttactcaattatttatttatttatttatttatttatttatttatttatattgaggcagggtctcactctgtcacccaggctggagtgcagtggtgtggtgtgaatacagctcactacagctttgacttcccaggctcaaggcattctcccacctcagcctcccaagcagctgggagtatagccatgtaccaccatgcctggctaatttttaaacttttttttttttttgtagagatggggtttccttctgttgcccaggctggtcttgaatacttgggctcaagtgatactctcaccttggcccctcaaagtgttgggattacaggtgtgagccccagcacctgggctatttactctagatttgttaaaagcttatatttgtttttcagatgattagaggaataaagatacaagtatagaatcactgttggagactggaggatccctgataacatacccatgaacttttaggcttctgtgaatttaagtatgagaaatgttgctcttgggaagtctagataaaacaaaacaaaacacctactttctgcaaaaaattaccaattatatccctttcttttcagttgctatatatgtttgtcagccagaactttctgatggtagctcatgtttgaaaaaatgatagtatgcatccccccgtttttttgtttataatttaatggaaatacttttttataatacaattttataataattggtgtcaaattttaccacattgactttaggcatgtattagatgaacctaatggctattaataaatgacttcttgatgtcatgtaatatgctaatagcttttctaatgtcaagccattttgcattactgaacaaatgcctacttagttagtagtagtatacaatttatttaacatttcagatgtacaatttctagaatttctaaatttcttaaatactgtttcctagtattttacaccagaactggcttttatcttggagctatctttctgattctttcgtgttattgtattaggttttagtaccaagtttatgctaacatataaaatgggccaggaaatgtttagccagacttcagagggctagtttaggttcaagaatgataactcacaattagtttaatgttacttctacttggtttgtttcgtgaaccagctaacatgcagtctaaaaggtgtacagcagctgaggatgtgagcgaatggacactgctccccagcatctctaattcttcagagaagtgtgccaaaaactaggtaaccagcgcatcacgtagaaggtgaatgcttcaagtcagggaggcccagagctgaggtcttttgcctttacacccttatgctgatggcagttccacactgaattgccctataaggcatttcttgtacagttgggtactactttctgtgttctgtttctgactcttttacccaccctagagtagacccagttatgacttattaggaaacatccatttttttttccttaactcaggatactaatagaatataggagctattggtagttttgaagtttgaaacaactttctggtgaaaagagatctggagctttttttgaaaataattgctagatgtcttttcccatttattgtacactttttgatctactcacgttttatacttctgggtcaatctatggtcatgtttcctaggaagttatctgtttcctcagaattttcatattcatttaaaaaagtgaaagtgtttttcatacctttgggtcttctgtgaaatcctcatttgcattcctaattatgatgatctgtctctttgcttccttcactctgttgatgtctttgttccttttacaatcctctcttggataatgtaaccatgttcccttgcttctcatcctccctcttacaggagaggagtttttaacctgctgggttccttttaattttctggcacctgtgacttaggcttgaccttttcttgttgtaaacaaagatgattcttgctttccgggggctatgcaaaccacagggagacagccataagcatgcttagcactgtttaccaactaccttacgattcttaggctctcacttccctcccttcccttccatgcacatggaatgtccacgcctccgctggcttctctcattttcctctgttggcattgtcctgttatgccatggcttccctccatgcttgctgccctttattgttccagctggcaagacagagctcagtgctgctgagagtctctaagatgtgcttccccagaaagcacactctgacttggagactagcatgcaggaatttattggggggtcttctcaagatcgatatctgtgaaaaaaatggaagaaacagagcaggaaaatagagaagttgaactgccatgcagtcacaataaaaccctcagccagttccacaggaagctctgatgctggtatggctcagctgagttgtcctgcattgaaataaatggatcacatcaacctggcagacgctagtcattggatgtaccccctaggaaggagacataattctggtaatcctattccgacagaggcagctcttctccactaagggaaattcccagaaagagactcagctgaaagctgtcagttacccacacttccagaatcggaaggaataaatgtttcaggcctttataagggagctaggccataaagcccctgcagttattaaaggaagctttactgttacccttttcaacgtgcttttgattttgtttttgaaacttctcctgagcagccaccccattgtaagagttttcaaatttttctctctcccaaagaaattacatctcttttagccaactttagttgatttggcttctagatgatgccagaaacttgtaaggtctgtcattaaggaacatagagcaaattacccccaagatgagaactagattgcatttgattaaatgtgtggaactgcacataaacaccttctttgctaaccagggccactgccatagggtgtatctttagagtctgctgcctcagagtgagatattgactcaataacttttttttttttttgagatgaagtctctctctgtcacccaggctggagtgctgtggcatcatctcagctccctgcaacctccatctcccaggttcaagcgattctcctgtctcagcctcctgagtagctgggactacaggtgcatgccaccactcctggctaatttttgtatttttagtagagacggtgtttcaccatattggtcagtctggtcccgaactcctgacttcaggttaattaattcgtgccattaatttgtggcctattgcaggcctgaattcaatgctttaaaagttaaattgggaaacatatatatgttaattaagcgttagtttgacaactgatgccacaagcaaacgcagatgtagacatcaatcactggtgatggctaatgctgcatcttaaaagctttcagaggcgatgaataaaaaatataagatataattatctgcctttgtcagcagtattattaacttggcttgccccactccttcttagcacatgagataatatgtatggttttatttagcattgtgatattagaggtatgtgaagaaactgaaaaaggaaaacttgcaaacccatccccgccccccacttttttttaacagcttcaatctttcttcagtaaactaataattttaatcagattcctggaagtgacaatctgaatagagattacttaaaactcataaattatataaatgtaatttttgagacaatctattttaaattggcttttttttttgaaggaagttgatttaataaggtgtcatatgaatgttagatagcacaggctctgaaatgactggaagaattaaaatatacagtgttatctgactcggagaagagaaattatttctaaatcttctatgacacataaatattcagacccatatcctggatcagcctacaaggcttggttcagggtcagtaagaactacttctaaagataaatgatttttaaaaatgttttctctgttaatgtctgtcttcttctttaactaggatgaagaaataccagggtcacctcagcctcctaaactctctgggacttagttttctcatctgtatagtaaggaggttagactctaggaccacaaagattccacctgattctgatactctgtaattctgagatctattctagatagccaagtggctgtgtctctatagatctggggttcaggaggctacttcttacaattcctcaccaccttactggctccccgaggttgtcctagctgctgaggttgatggctttccaatggaaacggatcccagggtcaggagcctcatatagacacctttctcacttcctggactctgcacccaatgctcgaaacccggtggttgtctactcagaggaaagaaagtacttatacaaaaaagatacttgacatacatgttcatagcaacccaattcacaattacaaaatatggaaccagcccaaatgccccttaatcaactagtagataaagaaaatgtggcatacatataccatggaatactactcagccataaaaaggaatgaaataatagcattcacagcaacctggatggagttggagaccattattcttaagtgaagtaactcaggaatggaaaaccaaacactatatgttctcacttgtaaatgggagctaagctatgaggacacaaaggcataagaagtatacaatggacttttggaactcaggagaaatggtgggagggggctcagggataaaagactatacattgggtacgtgtacactgctcgggtgatatgtgcaccaaaatctcagaagctaccactaaaggacttattaatgtaactaaacaccacctgttccccaaaaacttgagaaaagtaataaaacctgagaaaactgagaaaaataataataataataaaagaaatccagtggttggattgttattagcatccgtgtaactatggcctcccatctatgggacatgacacttttcatttgtagattccagggctaggagtggtgggggataaggaagtgatcttcactgcatgtctagcaccagtgctgccaaaataaatacttgttttctctcttctcctggcacattctttcattcattcaacaaaaattgagaacctacaatgcatcaggcatggttctaggggccagggagggggctgtaacagtgacaaaagactgagaaaaatccctgcttttgtggggattacatcctagcaagagtaaatagaaaataaacataatagataagtacattgtatagtatgttagaagatgacaagtgtggatgagaaaaatacagcagagtcagggagacgggaaatgctggtagtgggaagcgtacgatttttagtagggtgttcctcactgagaaggtagccaaaaacagacctgcatagagtgagtgagctatgtaggtatctggagaagggtgtttcaggctgaagaaatagccagtacaaatgccacaagacaagaatgaacaaccaggagaccattatgtctggagtgtggtgagatgggggaaagtgggatgtgaagtagagattagggtaggcaggatctccaaggtcttgtacatcattgtaagaccttttgcttttgctttgggtgaagttgggaccacagaagagtctgaactgaacagtcacatgatctcacttacatttaaacaggatcagtgtggcaagcggggaggcaggcagatcacttaggaggctcctagaaaaatccaagaagagatgatggtatcttggaccacatggtagcaacagaggtggtaagaatggtaacattcttcatatatgttgggagtatagccaataatttatgaatgtagtgagtcaatcaataaacatttatcgagtaatcttctatatgccagctacagttccaggtatgaagaaatagtgaggaaggaaatctccagctgtgctgtgaaggaaataaagtgggttatatttgggactctggagagtgagtgggcgagaggactggtgcatttagtttggtcactgatgaggttgctgaggtctgagtgaggagaagcccccacatcaaaccttgcagtagagcaatccacttcagaggggatacggatgcaaaggccccaagacaggtacaagcttggcctgtctgaagaaacaaggagtccagtgtctgtgggtgagtcgagggagtgggaggtggagataaaagatgaagttggaatggtaggcaggaccaaatcaggtggggaatttgtagataagggaagagagtttgggtcactgaggcttgtggcagagacaccaggcagcttgaagggagatagacactctgtgtttgatattagaccacccactgaagcagaatgtcagctgtctggagcccatttgcaggagggctcccgtcccaacctgaacagtgggtaaagctggaactggtctgtgttaggatgacccattgtttttattattatactttaagttctgggatacgtgtacagaatgtgcaggtttgttacataggtatacgtgtgccatggtggtttgttgcacccatcaacctgtcatctacattaggtatttctcctaatgctatccctcccctagccccccaccctgtgacaggccccagtgtgtgatgttcccttccctgtgtccatgtgttttcattgttcaactcccacttataagtgagaacatgcggtgtttggttttctgttcttgtgttagtttgctgagaatgatggtttccagcttcatccatgtctctgcaaaggacatgaactcaggatgacccattttgaacttaattgcactcttacagctttgagctttcttcaagagccttgaagacttcagggcaggagccctcctcagggaacacagagggatgcactcagtactgcatcctcagtgttagcttagaagtagcagatggtgctaggaaaaccttcctgagtcccatacagtgaagggaaaaaaccatcagcttttctttcagtcttttctgtcactttcaagagcatcctgccacagtctccatcagtcaaaaacagatggagctggagaaattgtcaggcctgggaaggtttccctaaaacataattgtttggcaaaattgcttttctttgtatatgtgtccatgtttacactagatctccttcaggctgcagggtgcctttctggagcgaatgtgtctctctgataaaccagattcttggtcaaaatcaatttctgcttatatgaaatctaaacaataagaataacaacagcaataaagaacttagtttttttccccattcactattttgtaggttcttcctacgtatctttcaaaacatgattgctttccatgatttcagaagcaatacattttcattacagaaaagttggaatgtagaaaaatcttaaaaatgaaataaaaccatccataatcctattacctagagataaaccatagttaacattttgatttgaactcttccaatttctgcctgtgtgtttccctctctttttttctctctctcttaccctttctctgtaatataaatatttttctttttacaaagttaggataacagtgtagttactatttgccaacattctttttcaaatagtaataatatattcttcaaccttaaatattgaaaccataatttttaatgatttcttgcattctatcttttatgtactatagttatctaatgtttaatattgtttaaacacagtgttgtgattatcttgtatatatatttttgtgagtatatttattatttttcttacagtacttggaatggctaaagaaaatggattctatcattttaaggttcttcttaaacctcagctgataaacctaatttgtcctcaaaaaagtgtgtaaccatttatattccacagcatagataagtgctattagccctaccggattgtcttcactaatattatagtttttgactttgttaatttggtaggtaaacaagcgagagcccatttttgttttaacttacattatttttattgctaatatgttaaacatttttgtatgcatattatgcattttatttcttctgtgaattgcaaattgatgtcctttgctcatttttctacttgtatattcatcttagtcttttttatttttatggcttaaaagatggtcagttatttcctaagtttataatttgcctcttaattttctttaatggtgttcatgaattgtcagacatttttgatttatgtcatacccttaaaatctttatcatcttgcttctttccttgcttttataatttgaaagtcagtcctcactggtagactatttttaatttctatacaattttatagtttaattttaaagaattaattgtttagttgtggcttaccttgccttatggtgtgaggtaggtgtctaatgttattatttttttctcaaatagttgatcaaatgtaccagaactacttattaaataatcctaattttattgctaatttaaaatgtcttttattatatggaaaaaattatgtatacctaagtcagcattttagtttttgtagcattatgctgtgtttttatcatcaggttatacatatttttagctcagcttattttcaattttaatttttctctctttttcctttaaaaattgttttattcttcttttttattgatttttctaggtgttcctaatagttgtatcaaatttcaaatatacattttaattggaattgcattagatttataaatagttttgagagtgctaacgcttttatgtgaacacagtatccctcttttgcaagtcaacttctatatcccttaataaaattttgaagcttattttctttttatagaccttacataattctttataaatctgttactgtgtctttgagcatctggttcactaatatgaatagaaaccttctttcttctgttatctgttctaattgattgttggttttatttaggaaagatattgaccgacggttttattttttgactcatctcatactgaatggagggagtacccaggagggattggttaaacatggccaaggtgggagaggtgggtcagggatgcctctcaaggcaaaacactgggtcatggactgttcctttcattttctattcctatacagttaaggactgtgttgaacataccacagaagctcagtaaaaatcatttaaaaatgcttttttggttattcaaataatccttttttacttctggtaataatgaggatgggaaaggagggctaaacagcaatattgacttccactctgtatactttggagtattataatatctaggtcaatgtattaccaactgctaacagttactgagcactatcagtggtctaggctctgggccagacactcatcatggattaatgcatttaatcttcacaacatgctgatgaggatatcctctatttgaggatagaaaagctgaagtgagagaggtccagtaatttgcccagatcacagagacagtagggatagagtcagactgaatgaagcagggcagcagttcaatagccctggctcctaaaggctgagctacattgcttcttgggcattcccctcatgaaagtcccttccaagaataatatgacatcgtattatccatggcattatgatattggcaaacaatgataccttatttgctaacttttagaagtcaaactgattatagttgggatctcagggtaaagaggtactgtagcagaaagacttcccctcagaagtgaggaggtttgggtccctgttttactcttcatctaactccttattaagtcaccttccctttctgacctcagtgttgtcatctaaaaaaatgagggaggattatgtaaatttcagggaacattttaggaacactaacaaactgtggttgttataatacagtcttctggaaaatctaccttttaaaggaacattcatttgagacacatgttttctcgctggacagaaagcttattcttttaacaaatcaattactttagcaagctcttttctccattacattacatttcattttttattaaaacttaaaataaatgttcctgtaaacataaatgcacatcaaatgaaaacttccatatttgccaattcatagaagtactgaattttagaacatgaaagtatattagagattatctagcacagataaggaaactgaagctctgggatcctgaattacttcctgaaattacacagggagtaagtggcagaaatatgattgaaaaccatgtttggcttctagctacagcctgtattatgacagtgatttccactgtaaaaatatttgggtagcaaaaacaaaaaaaatgaagaaatttctaggagaaaaaggataagaaaaggggtttatgagttttaaagtttgaaggcttgaaaaacaaaagataacaaacttgccatatatatgagtgagtgtatgcttaatatattaagaactttgtcaaatcaataagaaaaaaggtaaacatgtaaattttaaaaatggggcaaaacaaaacacataagaaggcatttcataagacataaatggcccattgaaaactgttaaatttctctgctaatcaaatatatgcaaactaaaatgattagatgcatttttcatctatcgaataagacaagattaggtaaagatcacaccagcaggaaaaaggacaccctctcacttttcttttgggaagtggatgggaactactttttttaccagagaaatttgtcagtttcatcaagtgtcttaaaatgttgcatatcctctgagccagcaattttactcttaggaatttatctttaggagtgattatgcttgtttgtaaatatatcaatatatttatctacctattatttaaaatagaaaaagtcttgaaacaatgtttaacaacaagaaactggtcaaatgtattagtctatatccatacaattaaaaagtagtatttaaaataataatatagaaaatatgcaatgaaaagaaatgaatatttggtatattattatgtatacaaaacacaagctgcagatgggtgtttaattaaattcctattttaaaaaattataccagtacttaaaaatgtatccccaaaatataaaaactgactatagattatggatagtttttaaaattttgcctatctgtgatttttaacttttctataatgaccataaattagttttatgctaggaaaaaattaatactagaattatttccaaacatgcttacatggtttaaagaaactgttattatttttttcttatgctttctcctataggcagagtttgttgattaaaacctgctatgtcaattgtttgccatctttcagaagaggaggttgagtttcagcttgaaatctaggccatagaaagttccagaaatataaaaaatgtcactgtgtacaaggctaaggagattttaatactcaccagtgggcagagctctcataatatataactgatagactgatggatagaaagacaattgtatgggtatgggaccatggaaggcatatgaaacaaatctgtacaaatttggtttctggtttaggcatacagattcataagttcattacaattttttaaaattagaatacattttgaattactttgcctaaaaatgtattgtctttatatcctccttcaattataataaaatagtttgagtctgacagtcatcttttgaaatgaaaacatgatttaatgaaatgacatattccaagctctaagtgaaacaaatgtttggtttagcttgtttaaattaaatcgttgttctcctttgctgttattagtaagcacacttaatgtcatttcttgtttcacactgtgcatttagatgtattatggaaatggggtgggagactttgtagcattttatcttgcttgcagagtgacacttaagcccctgattggcaaaactctaatggtgatgatatttgtgtttatcccctactagtaaagaagggtgatcttctagatctaacatgaactttttctttctccacagtgccaagtgcattttctgtgggttttgggggagatataattaactgacatgtagtgatgtattatttatataaacagggctttagcactctagaatatcttatggaaatgtgacatctaattttgatgagggcacttggtcttgcattgagtgtcagagggactagcttagctgtgggacttcccacagatttatagaacctaatttctttcatctttttattgttatctttttggttttgtgtcaagttccaggatgagattcatgatttctgtgcaagtggaaaataaaattgcattgaatatggactcagagccacctttggtggccaatcatcatttttttctgatcttctctgtttgagtaccattggcctttacattctcaacacttaataatatactgggcacaggatgaattgtgaaatcctgcttatccttcagggctcagcacaaatggtacccttctttatggtagaacagaggtttacatatgtttcaccttttttatggcagttgcattttcttaactctccatctctacatctacactttgagtttccaagcttcctgagggcacagaacaagttttgttttgtttttttttttttcaaatttgtatctgcagataaaaaatgtacctaactcatagtcagtactcagtgaacatttgctgcctttgctgaccggaaccttgggatttttccagctgcttttcatacttcattctgaatccattctaagaaagcctttcttaaatgtagccttcacccttactccccaagaagaatctttgctcttctcttggattttagtcctgatgataccaaaaggcatcccaataagaaagtattaattaccctggtataatattttatttcaccaagccatagaaaaattggtattttaccaatttggagaaattaagagctttttactttcggatatacactagggtctgaaagtgattaacgtaatatgacttaattcccctactctgtaggacagtagtcatctcttctatgccctataggaccccaggaataacagagcatggggatgagtaaacaggtttgcctttcgctactgcatcttcctttgctgctactggaattaagtagaataggcttttgctgagtcagaggttggagctatgtccttaaattaaaaaaatcagttcatcttatgacatcttgtgattatggttgtgcataaatatgccaatatatttctctctattatttaaactagagaaagtcttgaaacaatgtctagtaacaagaaactggtcaaatttattaaaaagctcttattttctcaagagcccatctgcctggacccagcacactagccatagtagcgtgccttatgctaatgaaccacatggggttaggcacattaattaggtaaataggaccttggtgtcactctctgcttctgctaggaagaccatgctgtcaccattcatttctacaagctgtatctgtagctgtagcctcacttggcacagctatggctctgaactcccacagcctggtcttgaatcttgactctgctacttattatctttgggacactgggcaagtcacttaacctctatgagtctcgatttctccttctgtattatgaaaattttatttccttcataggattgttgtgattattaaatcaaactatgcatgttaatagcctgtaaacacttaaaaacgttagctgttgttgttaattaataagttcagtcatttgcttcctgtgaatatgtgccttagctatgccatcattattatgggggattgtctttgtgtgtgtgtatgtttctatataacattgcaacctagttctcattatacttgctgacatctggtaaaatgttatattattgatatcagcattccattatgtagcaaataatgagccagagagttgggagaagtagagtacaaaagaagaaaattcttgaattgtctaggactagctccattatctctgaaagcacttgtgtttgtggacatcctccacctttgtttttgtttttgatttcgtttttgttttgagacagagtctcactttgttgcccaggctggagtgcaatggcatgatctccgctcactgcaaccttcgcctcccaggttcaagtgattctcctgcctcagccttctgagtagctgggattacaggcatgctcagcctcctgagtagctgggattacaggtgtgcaccactatgcctggctaatttttatattttttagtagagatggggtttcaccctattggtcaggcaggacttgaactcctgaccccatgatccgcctgcctcggcatcccaaagtgctgggattacaggcgtgagccaccacgcctggccccaccctttcttttttatgcctaaagggactttgatattgcaaagcctaacaaccagcctaaatctgctggtagaagtgttagttcttcctactgtgcattaaccacagatttaaatcctggggatacaacagtaaacaagacagataaagcctgagttcacatggagtttatattctggtggagccagacagtaggcaaacacataagtaaggagtgtatgtgtgtgtgtaaaatgatttcaagtcatgataaaacactaaatcaaccagaataatgaaatagaattgactggagtggagtgacagtaggattggctttatcaaagagatcagggaagacttcactgaggaagtgatatttcagtagaactttgaagggtacacaggagttgaccagataaaaaagaaggagaaagctgttccactgtaaagttttagttaggaagttagactttggggccagatccacttttgactagctagccttggacaaggtatttaacctcattatacttttgtctacccatctgaaaaagggatttgctataaggattagattaaaatgtatttcttacattgctcaatttggtgctgtgctcaagaaacatgaactgtcattaacatttgcaaaggccttagagtgagagaaagggagatagtcttcgctgatacttcggattttgctgtcggtggtagagaagcaaaagtccatttttgcttctcctccagagaactggaggtgggagcatttatgcttctttctcactcacgtctccaattagactggtaagagtctgagacattaactgagccatgttttattagatgaggtaaatctctttaggaatggtctgtgttcttttcaattagctgaactctcattcttcctccaactcagccttagtctttctattctctctccttgaagggagtgagttaggcaggacttgcctcagaccatacattctccagattgtctacttgcaactggttggtctatttttccccaaggtagtttcaaatgtttagaactatgcatccaatatggtggccacttaccactgtggttattgatagcacttgaaatgtggttagtcgaatttgagatgtgttataagtgtgaaatgcacactacattttcataaattaatgtgaaaaagtaaaatcattaataattttttagtgttgattataacttaggctaatatctaagacatagttggttacataaaatatataatgaacattagctttacccttttgaatttgttaacggtgattactgaaaaacttaaaattacataggtggttcagatttgaggcttatatttcttttgagtagtgctgatctagaagtatgagaagactagaagcttccattctcccttagatctaagccacagttgtcaatccagttattaataaatctattaactagaaagcttttggctaaactttcttttctgtttcatgaactagttataaaccaaaaggtagaaggagtgaactttggttcatttgcctttagtgtttgagggactatattccaacatcaattggtatactgcaattcagttctggcactaaccccctggaattaccattgatcctacaagctaaagggcacattccacggcaagactgccctcctttcatactaactgactataaatctggggattcttatggccttccctgggcttgataattcatgggaacaaatcacagaattcaggcaagttctacagttatgattatagttttccttttttgtttgtttgtttatttatttatttatttatttattttttagacagagtctcactctgtcgcccagactggggtgcattggcacaatctcagctcactgcaacctctgcctcctgggttcaagcaattctcatcccttagccttccaagtagctgggattacaaacgtatgccaccaagcccagctaatgtgtgtgtgtgtgtatgtgtatatgtatttttaggagagatgaggtttcaccatgttggccaggctggtcttgaactcctgagctccagtgatccccctgcctcagactcctgaagtgctaggattacaaatgtgagccactgggcccagctgcttatagttttgttaagaagaatacaaatcaggaacagttaaatgatgagacacagaaggtgagttctgggagaggccctagcacagagcttccatggcttcttcccctggaatcagggcgcatcaacctcctggcacactgaggtgttcaccaaccaggaagctctgctgagcttcggtgtccagaggttttattggagttttattacacaggcatggttgattgaatcactgaccatttagttgaactcaatctctagtcccccttctctccctggaggtcaaattgcttcaaaatcccaaccctctaattataggcttcttctttttggtgaccagccccaatcctgacattatctaggggtccaccatgagttatttcattagcataaacacatgtgtgatacaggaggctcatatataacaaagacacacttatattacttgagaaatttcaaggattttagaagctctgtgccaggagcctgaaacaaagaccagacaaattctttgtaacacaacagactgaaaagtgcagtgtgagaagagcaaaaagacgaattcaccatttaactaatgtttattgtgccgcatttttctagacacttcagatatattagtgaatatcaaacattcctgttcttgaaccttacattccagcaggtgacacagacaacaataaacaaactaactaataaatcaattataaaaactatttgaagttggtgctatgggagaaagcaaaaataaaacagattgtcagtgttggtgtggtgtgattggcaaactgtgggttgtaatttgtaatacactgttcagtgtagatcttctaggagagtggcactgaagcaaagacttgaaggaagtgatggagttagccttgcagcaatcatggagaagaatgttttagtcaaggaaatagccagtgcaaagggctgaaggcaggtatgtttctgtcatagtcaggaaacagctagaaggcccttgtaaccagaaccagggaagacagtgggagaggagagaaatagaggcagcaaggggccagatggtgtagggactcataggccattgtgtagtctttgacttttttctgagtgaactcttccatttggagaatggcactaacttcctctttaataaatttacacaggctgctgtggtaaaaacggactataacaaacaagaatagaaggaatactagttttgaggcagttgtcattttccaggagcgagatgatagtagttcagaacagggtgttaagagaggagggggtgacagtcggtcaggttttggatatgttttgaagctagagccgataggatttcctccgaaattgaaaactgaggggttgagtagtccaaggtaagactgggtactggatgtcttctaggctatggtaaaaagttcagattttatcctgtgtgcaatggaaagctgctgaagagtataagctgagtggcctgattatattagcatattataaaagtcactctggaggttctatggaggaaggatgggaaagtggggaagagtggagggtggggggtggagaggtagcatttaaactccttgtaggtattaagtgctcttaagttagatgacccatgtcatttcatattagacattaaaacacacccacatctcctattaaataacaattttgctataaaaattgtaaagcagtttaataattttgcttgtgaaattatttgacctggattacccatttaattcacaaatcactttgattcctcagcaatcattatgcatacttaagtgagaaaatctgacctacaagttgatttcagatgtaaacatattttttacaatttgtaatttttaacaatgtagagtttaatgatacagtggtacattgtgtagacaaatcaacacatcttaatattgattatgtctgattatgtcatcttctttttgcatttttgagcacatactttcttttatacaagtctctaaggtttttataggctcctaaaaaccttataggctcataagcctaatggattaaatgactctggataccccgagaacagttagaaagctgtgttgtctgagagggacctttaaaaggatctggttttcactagcttcataaaggcaggattttagagaaatccaagtgtttaccatgtcctagggtttgttatataatttctacattcatttttcagaagttaccttctgtttcttgtacaacttatcttgaacttgctagaatgattggatgattttgctccttgactcgatttgctataatacggtctgtttatgtcattgtggaactattttccactctgattcagtgaggatgtctatagaattattaagaggctgaaaaaaagacacaaaacattgattttgtttttaccacccttgataatggattctctttttattttcctggtaacctggcattggattgcatgcgttgcattcaaagagaactctagtcctagctatattacacagggctagatgtcaactgtggagtaaataattctaaggggacactgctcattttaactctgaattcacttttagttactataaaatggcaaaagattttgcaatgaatatgcaaagaaatgtcttttctgtattcaattgaataagtgcttttgagattaaatgttctgatattgtatgtgctacacaagaaagaggaaatagttaagaaaaatcaaactagaatttttaaagatcgagttattttccccttgttcatcagaatggacttgctaggaccatttataaatacttgttcctttgtaggggaactcacccatgtctaccctacatgttcctaattcagttgtaattttgaatattacaatttatctgatttgcagcctattcctgagtggtattcttagtttcacttttaaatgaatacggttcatcagatttgattgttcttttgtgcccatttgctttggagtccttgctagtaatgaaacaaaaggcttttcagatggatatttgagtgatgaatgatgacacctttttctctttaccttacttcaagctgccaatctcttcacaaagacattgtgtctccctgttctcttagtacaccattttcattgctgtgatagaaaatcttaacagtcagcactgaaattgccttcctcacgtgatcatctcacactttgcatggatagttgcctgtgataagtattttactttcttctcttactgtattagtggagttggtagcaggatgattttttggcctttatttttgttttaaatacaacataaaaaagtacaaaaggaaacaaccaaaaatatggactagggatttagacttttcaatccacagcttttcctttctctgcgtactttgggcaagttaatttatttctctctgtgttcatcagctcactaatctgtgaaataaaggttgctatcattcattcaatgcatatttattagaatgcctatctttcaggaagtattctaggtactgagtatatataacactgaataaaagagttccaggtccagtgtggtggctcatgactgtaatctcagcactttgggaggctgaggtgggcagatcacttgaggtcacgaattagaaaccagcctggctcagcaacatggtgaaaccttgtctctactaaaaatacaaaagttagctgggtgtgatggtgcacgcttgtaatcccagctacttgggaggctgaggcaggagggtcgcttgaacccaggaggcaggggttgtagtgagccaagattgcaccactgcaatccagcctgagcgacagagcgagactccattgcaaaaaaatttaaaaagtaaataaataaataaataaataaataaatagagttcctaccctcttggagttaccttttattaaggtgtgaaggagacagcaagtgagaccatctgacacatatattccttcctatattgctatttctttttaccttttctcccttcacagtaaggaattagcttcatgaaagtatatttataattattatttttgtgcttcatttttgttgctttgctttcaaatctgaaaggggaatttgtggtgaagttgtaacttttaaacataagagttcctaacaagtacaaggaaaggaaatgattaggagaaatttctggacagcgctgaagtcaaatgtcctagattctgactgcttgggagagttaaaaccttctaattttgcaaacatgatttttttttaaagtcttgcattttaaagtagtgttcaaaaatctcactggcccagtctgggatgtaacactactgtctctaattagagtaaggcttgctcttccgaggcctgtatgctgggaggaagacaactcacagtgctcagaggaatatcttcagaaatgtttttgaccaaaggaaaaactaatgaagaaattttacagagaggaagttctctttccttggggaaaaagatgtgttaacgaaggagtctgaaaactaactgcaggtgaattgcaaaatgctttggagagcattggcttagtatataccatgaataagatatatttctaaaatagtataatctatattctttaacagatttgtcactttgtttagaactctattctaggccgggcatggtggctcacgcctgtaatcccagcactttgggaggccaaggtggatggatcacttgaggtcaggagttcaagaccagcctagccaacatggtgaaacctggtctctactaaaaatataaaaattagccgggtgtggtggcacacacctgcaatcccagctacctgggaggtcgaggcgggaaaataacttgaactcgggaggcggaggttgtagtgagccgagattgcatcactgcactccagcctgggcaacagagtgagatgccatctcaaaaaaaaaaaaaaaaaaaaaaaaaaagacctctattctagaactatattctttaacagatttgttgctttaagtacatttttctcatagatggagatgtattcattctggtgtctagtggcctttggatgtatcctagaccctgtgcctggatgaatggaggtctttgtgcaagaaggggccctattgatataaatgatggctaacatttctggagtgcatatcatgtggtatgttcagttttataccttttacatatattacctcatttaatcatcacaacattctctccattttagaaataaacataaaaggcttaactaatttgcccaagaccatggagttaataaatagtagagtcagaatttaaagtaggaccatctgagtcaagtctactctttccacttcattagataaacaacggataattctataagaattagaatccactgagtggcctggaataaatgtagacatggaataggaacttgctatattagtctgattcttactctcttctcacttctctttgcccttcaacacacacatacacactgaaaacacacataatacttgaaaacacatttgtacgcagagataaatgggtgcagccagtgggcggggctgctgagcaaaaaggccagtccaccgataatgcagattgtttgctattgacgattagattcaggatcccaagtgcctccaatagctgtgcagtgtggctagaggtgcattgaataaatacttggggctgaattaattgagcagaactaccttttgaatacctaaagtttgcctgaaggaaatcttcagggccttggagagtgcttaatatgtattaaataaatgaggctttcggggcctggggagcccctaaattaaggcagtgacaaagggaatggattagctctaaacatgggtgtatacataaatgtacacattcctttggagtccacatttctttggactcaaatcctacagaatacaaccagacactgcttttcattcagaattttctttcttgtggaaacactccatttggctcttgtaatttggatttgaaagtagtgaatgtctgtgtccatttggcacgaacagaaggccttagaatttggacacaggaagaatagctaatggatacagggcttaataccttggtgatgggatgatctgtgcagcaaaccaccaggacacacatttacctatgtaacaaagctgcacgtcctgcacatgtacccttgaacttaacataaaagttagaaaaaataaaaaagaaagaaaacagacatgtttgttcttcaactcttttgaatggtttattgcatggaaaattgttactcacagtatcatccatttacagtgagagcttctataagttgtcaacaccacttaaagacatcaataagtagagtctttggacactactgatggctggcacctgacttaatagagggactggcactctggagggaggaggaatggaagggaagcaacatggggagtaaaatctatgcatttagtccagtaagtcccacccttttgtgaagctgtttgacctgatgtcatctaattaaagctactcttccatacaaagcattgtgtgacatatatatttaaaattatgtttaaaattaactagatttttggtttgaagtattatttgtagaattttagtatctttcttgactgaaatgattgtgatactgtagggtgggaatcactgattaagggccggtggtgtagactagaaaaatatggattttgcaggcaggaggccaggctcccctgtcaatttcaccacttgctatctgtgtgatcctgtttgggaaagccatgtaacctctctgagcttctttaagctttaaatagttgaaatgtgtggacacaatgtccaacacacagtaagtgcgctataaatccttactttcattccttcccttctttcaaatagatagacgctcatagataataatgatgctgtcaggaaccatgtgataacgtatattggagggacaaaatagtttccttgcctgaaatgacgggtttgctcatctcacacctcgactaacctacttactgagtcactccaaggctgtttttttttttgaagtagcctaatgccaaacatatgctgacagtgatttcaatgtggagccttgtactaaattaaatgagaagaaaactcaaaggcagctggatgtacactagtatctatacatatcttgtctccttggaggttttctcatttaatagaggtagaaaatttcaggagttaaactgcccttataaagaaatgaaggttttaaaattagtagacttggtgtttgaggatcctggatgaactttaatctagagttttttatactctccaaatggtattataaggttggcttctcagagactaaagtaagagctaaaaggaattagaaaaccagatgttggggctgattcaatagcagtaaatcttattgctgttccaggggctccatgaggattctgctactgaaattgaacaatatttttcctaatttgcaaaaaaatacattaatacagagagtgtgcttattttctaggtttgcatccatgctttttcttaattttggcacctgctatttcttgccttttccagagtcttgtgtgagccgagcatataccattcagcacagtattatttgagtataatgtttcaatagttcatgatgagttgcagagcaaccatgacattcaagttagcgtctcataaaatctgagaatcattgtctgagatttgagcctaaagatgccttaaaaagcatctttaagtatgagtgaccttagccaggtcaactatccctcttgccagatcgaaaatatcagaaaaatactttttctctcccttattctgacaacagggagcactacttatcatgcttacttaaaaactgacaaacacatctcccattgtaaagacgctaagcattttaagtgctaaccttgtttttagccctcctacttcatatagtccaggtttgcctcagaatctcagaacatcaccatagctatgaggttaagagtgtagttttgcagtcagggtgacttggttttaaatcctgccccattcgctgtgtaatcttgggcaaatttggggcctcagttttattatttgcaaaatataaatagtaacacctcactagtaagtttgttgtgatgataaataaattaataagccagaattgcatactctctttggagaagggatcacctctggtttaaacattgcagtaactccagtgcccatagcatacactcagtaaatattacaaaagaaaattaatggataatgcatcttaagcagttggcaacatgtctggcacatattggcctctcaataaatagtaaagatggcaataataataatggtagttgttgtatcattatcattaagttactacatcttttgaaataaattttgaaaaactacaaagaatattttgcggctggaagactggatatgtttaaaatgacatttccgaaggcagcctcctaaacttcaatgcccttttcatatcatcagtgtagctttggacaaaacagtctctggccatgtcttatttcacaaggccaaactttgagaataatctgacttccagtctccctctcttgcaagctgtgtttccagactgttgagtggctcctggaagcagcaggtggttcatggatgcagacatcaggaatcaaagctcggctctaagaggggagaggatggaaagttctttgagtccttttggctgaataggtgtcttaatgagatgatcactccaggaagcatttctatttccttcctttaaataatgagagtatctttgagtgaatgtatttaccttccttcaggcttagtttctttgatctctgatgactcactttgtctcacaacaatgatcagggtcttcattatgctgcccaatttggtagcagaagcccatgagaagcaaaaatttggaagccacaattttctcattatcatggggattaggttgccttgtcaacaatatatgcagaagagaataaatttaaactagcaactaagatatatttatcaagacctggtctattaacttgtttagctttgttgtgcaagccattcaagtttctaatgtggcaggtgaacttttgggtagcttatgttgctaatagccaaatggcatataataatcaaagcaataaatgtgggtattattaagcacaagcgcaatggcccgaaatagaattgctgagtgcttataaattactctattattatttgaaggaaagaacaatccaagttgaaatatggaagctacacaccacacagttctttcactattattgtcctgtataaggtgatctctgggttttatttacaattctcagataagttattttttctccccagctgcagaactcagtcttgaattccattttcattttaaacatcaatagttcattgtataagagcattcttcatgctgcaagttcttggcattttctatgaggaatatagcacagtaacaattctttatagggataggagaaataagacatgacagactaaagataggtggttaagttgtaacaaaacccagcatataaagcttggcaaagatttatacagagaagcaaaactactgttcatgccagagaaatcagtaaagaggaactgaaaaagaagtgaagaacgtatgcttcaaagctataatgagacttggctgcctcaggcagtatcagtaaggaataacatgccctaattttgttgtcttagaagcaaaacatttctttttctgttgattattcagaatatgtgccattagccatatgtgtacattttagtcagcaatacagctgtagcccatatttcattaacatgtgttctgcttcctgctcgaacacacaacacgcagaaatgtgtccctgaccttttaatctagcttgctctttcttccttcatttccccatcgtttataatagcaagatccctgaaccctctcctagaccacctccctcctttttctctgttgctggcattgtaggtgtctcgtcaatttggtagaagatgtcttggaatagagcctctcaaaacctggaaattatgttgagtctgtttgatctgattaccttggaggcagatgacaaactttcatcagctctagcattttgtaaataatctttggtaaccatcatgggtcatctttgagtagattacttgggatccatctagagtctcagtgcctggagattttaaagaaaaaatcagagggtacacgttccaggatggcttgggtcagtttgctgaatggaagaaggaaaaatacaggtatacaccaattttgggtccattgtggtctgacaattttgggaatctatggttggatatatatggacgtcagcaagtacaacttatctaacgaatgagttgattttcaagttgagtccttgtgtaatggcttagtgttgagccaaagaaatgccagacctttgaatctgcatgtcttcatgggtagggcaagaccttgatgcttaaagcccatgtatggcatcacagctgtatgtgatcaaagactacttggtggggtctgaaggtaatacaagctcacagaaccaaatgttattatgaacaagcacagtcagggaaggcttcctggaggaagtagcatttgcaatgagatttgaaggaagtaaaatgaaaacattaaaagtagttgagttgtttcattattttacattttagtaatatatttctaaacgttacttcggttgctagattcaaccaattaattcgagtgctataaatagaaaatgaataaatttttcaattatctgtttagaaatgtacaaagagaatggaggtagttttaaagaggcttcttttaggcaaacaacaacaacaaaaaagatttaagctaaagaatataggaaactacctcattccaataggtgttgaatgtcaagtagtcagaaattttttaaaaattggaattatatactggaaaactagaggaaggctggaaaagtcagagtctttaagccttattggttgaggatgagttctcgtgtcaaattacatttctaagagaataagattcttgcgactcaagatgtggttctgggaccagtaacatcagcataaactgggattctattaaaaatacataatctgagtaccctcccagacctactgaatcagattctgcatattaacgagactcctggatcatttgtacacactttaacatttgagaggcagcagaattctcagatggacagcctgttgtaatgctgtggtacccagctgataatcagcagaatcatctaggtggtatttgttaaatttaattaaaacatttttttaacagtaactcagatctaatgagtcagaagttgggggctgtggtaggcagaggttgtagaaactgtattatatataatatagaggtttctacatttcaaagagtttcacaggcaattctggtaatccaggtttggatgctgctgatgtatgagactagagtagtgattcataactctaactgctctctagaatcatttgtgatgtttaaaaaaattataatgctaggttcagtcctccagagatactgatttaattagccttgggtggaatttacacatgtgttttttttttaaagcagacttacttagatataatttatataccacaaagttcatccatacagcaactttttttaaaaaaggtttcaggataattctgatgtgcagtcaagcctgagaacccctggagaaagactagcaggaggctcttatatactcccattgggaaacaaagagatctgattttcagtagtgtcaatgaatgaagtctgtacggatgtgtgaggctaagatgtagagagaaattcagagaattctctgaggttgaattaacagattttaaaaattaattttgcatgggtagagaactaattcaatagtctaggattatgtcagtttcatttgaccgactagatggatagtgacacctgtgggctcacttccctctttcctgtgtagggctcatttttattcagagattagggaaatggcaagaggcataaaatatttagactttcagattatttatgaaattcaacatagccaaattcagcaggagcaacaataggtatactacacccaagaaactcctgaatatcggaatttagtaccttttaaatctgcaattaaagacaatctgtgttgtgatctatcccttgtttgttgcacagacccttcttcatacctccatgtatcttccttaaaggtgggttgataagaagtacatatattgctacactctgaatactctttatttacacatgcctgtttttactataatatcacaaggaagaggcaggagcttcatgcttgaggtaaccatgagtggttcattctcagatcagtctttgtttgtttgtttgttttttgagacagggtctcactctgtcacccaggctggagtgcagtgatacactacaatggtacaataatgtctcactactgccttgaactcctgggctcaagtgattctcccacctcagcctggataatttttaattgttttcttgcagagacatggggttccattatgtttgcttaggcttgtctcaaacacctatgctcaagtgatcctcctaaagtgctgggattacaggcgtgagccaccagacctggcctaagatcagtctttgacaagatctcagctctacagtgttttcaactcactttactcttgaattcataagaatgtaaatttccagcaattttctccttttatttttctataatcggtcatggggtacagagttcagaagaagtatagttattgagcatggtcaggagataaacctggtcttagaacagtaggaataattgttggaatctattagaacctctaactatgaatctcttggaattttattgattctgagcaaatttttataaacacatacaaacacatacataactggacattttaactgttaactaaggatgactaaaacagttttccagagtctgagggaagttttattgagttggattgaaaaacagctgtggaaacggtcttttattctctgtatgtgattggcacagttaatagaaaaggattggaagcaggctcaacgccttcagtgtttaggatgaatgagattccacatcaaccagaaatggggctgaccctgtgtaacacggataccacattctaggtggatggagtcagggtttcccctcagttcctcttcattggcccctcactttcatccactagagcctgtaactgtaaacaaggtttgggacgttgttgggatctgtggttatttcacacacagtggtggaggcaaggctgatggagaaagtgacctggaaatagtacatgtgttaggaattatggcttttcattggctgaatttggttaaagaaggaagttaaactctctcagtttcctaggacaaaaatccttctcagactcacagagccaggcagtggaggtaagagaatacgttatctctagccagcggagctgtatttgatgagtgagcaaaggtttattcatgttgctataatttggatgcttgtgccctgaaaactcatgttgaaatttgatccccagtgttggaggtagggcctaattggaggtgtttgggtaaagggggcagatagcgcatgaatgccttggtgctgtcctcttggtaatgagtgaattcttgctttattagtttccatgagagctggttgttagaaagagcctggcacctccccatctttctctctctctgcttgcttctttctctctcactgtgtgatctctgtacacgctgaatccccttcccctcctgccatgagtgggagcagtctgagatcctcaccagttgcagatgccaacctatgcttctgtatagcctgcagaaccacgagccaaataaacctcttttctttataaattaccgagtctcaggtatttctttatagcaacacaatgaactaagacacatgtcaacccaccttcccattttaagtatggaaagggcaaataatagcatgcaagggaataaaagtagtgataaaaagggtcattcacaccgagttgctctctgtttctttaaagatgcataaaaaggaaaataaatgagctaatttaaaaattcacctgagtaacatgacaatattattctaaagacatagaggaaatgcatactcttgtaaatgatgctttacaggcaacaaaaggcaatttaagatgctatctcattatgataggaaataaagatatatatcacaaagagatatcagaatgctataaaaagccaataagccataaaaagtcaataatctgagatgataggcatcttgactgagaggaagaaaccaccacaagaatattgaaaattcaagagcagaattagggccaggaatggtggctcacgcctgtaatcacagcactttgggagggcgaggcaggtggatcacttgaggtcaggagttcgagaccagcctggccaacatggtgaaaccctgtctctactaaaaatacaaaaattaccctggcgtggtggcacgtgcctgtaatcccagctactcgggaggctgaagcacaagaatcacttgaacctgggagacggaggttgcagtgagccaagattgcatcaccgcacttcagcctgggcgacagagtgagactctgtctcaggaaaaaaaaaaaaagaagaattaaaattcccatactgtaacataaataaataacatattacaaaatagaactaatggtaaataattcaaaattaagaagttgtcttagaaagcagagggaaagaaagacagaaaagatgagtctgaaggtagcaggtaagatacaaccacagcagtgtttctcaaatgaaacataccaaaatatagattagtaaattatataataacattttataaagcagaaccatacattcatctgtagaacacaaggctccaggtaacaataatagagtgttacacctaattacgtccttatgattttttcaaagataatttttttcaaggatacaaaattctatagaggaggataaaagaatgaaaagtataacctcaaagaaacaaaaatctagtgcatcccagagcttttctctgcaaaagaaatcaaaacataaaagataaatgctactacattttaatggagaaaattatgtgattcaataaatacatatccagccaaatttttctttctatatgatgataataaaaagtttaagagttcaaaaaacacattgaataaggcactccacataccagcaggtaatttaaaataaagaccccaagaataatcacttcattaaagacacagaaaagaatatcaaagccagttgctcatagaagagaattaaaataattgttttacataaattaactactaaggcagaacacattaaaaagaaaatataaatctaaagagaaaaatgttccataggaaataggcagtcatggtgcaaccgcaagggaaaatgaatgcatattaaattttatatttcacatgtgagtctgaagtgatatattgctctacaactatctatatgtctctatattctcacataccaacatacacacagagatacacacatatatacatgcatactgcatgggtatgtgtgtatgtatatattatgtcatacctgcaatatatgagagaaggtggggaggcagataagatttaggtgttgaaaatcttaaaagtaaattctagtagaattaaagatagattagttttccaaatcaccacatcaggtacaagcaaactaatcgtagtcctcttaataaaacatatagatttttaaaagataacagggcagcctacaatatagaatgtcaaatataaaataataaaatattaactatatggtataattaagtataaatggtttagcttcccacttataaagcaaaaactatgcatttgtattttaaaaatcaacaacattaagttataagactgataactaaaaaaaaaaaatccagaattgggcaaatgtaaagcaattctgaacagaaagaatgcagtggaggtaatgttaatatctgtaaaaatagaattcaagggaaaaaaccttgaaagaattgtgagtgactagacacttaatattgatgaaaggtaaacttcatcatatagacatcatagatatgaatctgtgtttactaataaaacatgaaaacacataaagcaaatatcttaagcaaggaagattggcagaaacagacttgcagtggcagattttaatgcaccgttctcagtttgtaacaagcgacacagaaaataaatacaagaataaggattaaataattcataaaggtgaattaccacatatatctcaaaatttgtaccctatagagaatattcctatttttcaagtgttcatggaatattaccaacaatgatagtagaaaacactagtcatgtttgtaaaccaggaattatttggctatacacagtaaaactctgaaagaatgacaaaagtttccacaaaccaagaaaccacaactactgagaaacgtctagtaaagtaaacctcctaaataacaaattgttcaaagaaagaataaaacatgagtaacaaattatttagaattactagaatatatgggaataaacacagcactatatgccaaacttccacatggccaaaactatattttgaaataaattcatatctttgcatattttgtcattccaggaagtgtgctctatagcactgcctagaacagaaggtaagttattggaaataaagttaaggaaaattgaaaggggcagttgtcagttgctaaagtgctatgaatgccacttacagtagaagataataaagtttcttagtgatgtgggtggtactttttgaaagtgatttctggatgaggaggggaatagaggattggtagagaaaatgatgaccttggttttgaacatactgatgtgtgattcattactacattaaaacaaggtaataattacaatcataatgacagtaaatatttttattaagggtttgaaatgtcctagacactgtgctaagtgctttacagtattacctcaatgaattcccattatattcctatacctttaaagtatttgtctatgtcttattttttcatttcaattaaatataatggctttatttttaaaaagcaatacagcacgtcataaaaatttaacttgtaaaagagattattgaatgaaatgtgttaatatagctacctcttgctatctcagaccaccaacagccctgtgtagaaataattacttttcttgtttcttggatgtccttttcatgatctggcatgaatattcggaaaatatgtacgtatagatttatgcatataaccctttttatttataaactagaggcatattatatattgttaaatacctcctttttcacttagtatgttggatatagtctcatgtgtgcaacatatagaatcatattatatctttctatgcctatattgtattcttagtgtggctgtggcatgatttatttaaacagatcactattggtgaatcttttaggttttttccaggtttacttccaaaaagaacatttcagtgaataaacttgtacctatctgtgcacatggtacatgcatatgtttatctgtagaaaaataatcttgtaagtggattactatgtcaaaggtatgtacattttaaattttgatagatatttccaacttgccttccaaagaatttgtagcaatttacatttctaatagtaacatatgatagtacatctttctttacatcctcgccaacaaagtagtgttggattatatgatctttgccaatctgatatatattacatacacacacacacacacgcacacacacacagagataaaatggtaccttattattttaacttgttcttctttgagcctttttttttaaacaggatcttgctctgtcacccacatcctcctcccatccatatgacctttcaagtcattttcttagaattggctctgtagattgttgtcaattctttatccacatccattccataaactgttccaattccatttccagccttatcactcttctctgacttaatgttggcagctccaggagacatatcactgctgtcaccttatttgatgtctcagtagcatttgacctttgtcaatcaccaacccccttcttgagacactttcttctcttttctgtggtaacacattctattgtttcccttgccacctttctaattacccttttttaataatctttgcaggctcctgttctatctaaactaaatatgttgaagttttctaggcttccaacctggtttctcttttcctttttttcccccctataaacgaaggtgatcacagatcaacatctccagcccatatcttttctttgaggtctgaatttgtatccaaatgcccaattactatttcagctcacaaaatagtgtgtcttaaactcaacttctaactttctactctaaatatatctctggcagtctttactatctcagcttattatagcaccgtccctccaatttgaacactggaagcatgagagtcattcttgacttcatctagcaagtcttgtctagtttctctggaaaatgtgtctcaaattcatataattttacccatgttcaaactgctatgatctcttttgtgaactagttaaataccctcctttctgctctccatatctctccttctactcatccaatctaatgcagccagagtgatcttcgtaaaaagtataaattaaatcatgtgaatactaactgtgtgttcagggacttatgaaggttatctcatttatttttcaaatgatcttatgagacaggaactactatagcccttaaagaagttaaataatttactcagatgggggaactgagatttagacgcaggccacttggctttagagcctatactctgaaacactacgccatactctctcacaaaaatgtaccattttcttcctaacagcaacttgaactattgtagcttaatacttcacctgtattgcctctggggaccttgaaaattacagctgaattctttacaatggcgatcatttcttttcctggcactcggcatcaaagggagtcttggtttaggcagctgaattaggacatgcttgttggggctgcatcctgaactcctagagggctccattcaggtgaacaggattttatacacactattttatgatgctgttgatggggatgcactacaggaaaaaatcattttctctgaaagtacagattaatttagaaaagcaccaaggtgattctatggaaatagcatatttacatacatttctcagcaactgcagaatacctactagtctcttatcagttaatcatagtaatcaaagatgcagagagagaccgtgtcattatatgacaattttcccatgacgatctgcataaaaacaagcactgctagttctttctctccaatccatcctctctatactgttaaattcatttttctaaaatacagcccaaatccaggaagttcgtggtttaaacttcaaagtcttctcttcccaacaaaggccagatcttgctctagcatttgaaagcctctaggatctggttcctatgctattttttctcagacttatctctgtctattccatttatgtacatgattcccctccccccaaaaaaacagttaatttttcctacacaagctctatattctcactctgtgtcttagtcttctttgttctcatatcttcttcaactgaaatgcttcaccctacccaacgtctgcatttaaaaatccttatttaaggtgcgaaaacatacagcatagtgctaggtagaaattaaattattgttactatttgctactctttatttttcctgtagcctgacttttagtagagaagtggctcaggaaattggattaataagaatgcagagtacagtggatagactatgttggtcagctagagcctgcggcttgaataatgaatattcagatagaggtctctgaatctccaggctagtcagcaagagtaggcatgtggccagctcttggctgaagtagagagaaaggagcaagtccatacataagaattaagtcagtatgtgtttttatggggccattggtaggtaaaaaatatcaaaggtgtcaaccacggggccattggaggaaaatgatcagaagtgtggtagacaaaagatagcccgtagcagattgctgggtgtgtgttactcatatggcatcaaatggtctgaggtcagagggtataggggtgttttgcccagtcaaggaccagtcttcccaaactttactgctaaatttccttttataagagccttacggaagaaaaggaggcttggagaaacaagtgacttgctcgaggtcacactgctagctgtattccttatggtgccagtgttaacaggttacacactgcttctcagaacaattcttgttggcagttacaatacaaattgtgataggattcaagccctatcacagggtgagtggaaggaccattcacacagatcttgaatgctaaaataacatctagcctttgcttgtcagccactgggaagacattgaagtttaaaaaataaactagatctgggctgtatcttagtttagagtatgtatatgtccctgtcagcttatacctgaactacagagacattctgagagtattgaaagtgttcatctgtcattcaactttaaacttgggtcttattactgtccctcactgcatgtagtatcatataaattaaaacacattaaatacttttattattgtcttgccaatgacaaaatgaaaatgcactattatgttaaaagtgttaatttatataaggcaaaagttattaccatttttgtaatcgtattttgggatttcattaagaaatatacaaggagccttataaaatagaaatgacttggcagggacatgatcatgatggtgtaggctgcacttggcactaccccagggagctcttgtggatgactacagtgagcgttctcattgtaattactgcaggtttatattgttattatggtgattttcaggcagatgacattgaaatattgtaagtaagagatgctttgtttcccttgtttgtccacgattgccgttgcagataatagtgatgctatgtcctgagcttctcctgaacactgaggtcctggacatatgtgcatcaatgttagtgtcaaagatagtttatgtatgcatcatctccattttctagtttttctggctgtttaattgctgtaaaatagaccaatatgccattcaaccagcaatttctttatctaataatagagtgattataatggcacctactgcatatgattgctgatagcataaaatgagataatgaatactttctaaacatagtattttgtccaatagatgttaactcttatagtgatcgcttgatttattgatttatgaagttggctctgggctcagtaggtcagagatgagagtctcgctctccacattacgatcaaggacttctctggccctgggtgaaatggtggtttgcagggctaactctaggggcataccaagagaatagaggcaccaggggcatttccggatgagtgccatttattagtctgtggtttatcagtagtggaattgccagtcatcttactgtgtttagttccctttgtcttgatagcgcaaccactgtgcgtttgtgtcttatgtttctaccccctctcacaatactatagttgggagagcttagtggcaagctgtgcatagacccagagacattaaaaatacactgtccaggattttcctttttcagtgtgataatggttaagcgcacatcctccagaattagactacctggtattgaatcctagctttgccatttattagcagagtgaccctggactagaacttgaccacataatatgtagtttcctcagttatacaatgggggtaagacatacttatcttttatggtgtaggaattaaaggtgataattcatacaatatatttataacaatatctggcacctaaaattaaataaatgttaactattatttctgtgtttacatgtttagctattcatctaaatatttattgagtacctataatatgttcaacattattctgagtattggggggcacaatgagccacactgtcatggaacccacatgctagtggaagaaataggtgacaaataaaaagtgaataaatgaactccatactttcaggatgatgtaaaaggtagaggtgacttttgagttgagacataaaagggactagctttggtcaaagtttattttagtctgggcacagtgtctcacacctataataccagtactttgggaggctaagttgggaggatcacttgaggccccaagtttgagatcagcctgagcaactaatgaggccccacctctacagaaaaatcttaaaaaattagccagttttggtggcccatatttgtagactcagctactcagaaggctcaggtaggaagatcacttgagcccaggagttcaacgttacagtgaaccatgatcacaccactgcactgcagcctgggtgagactttgtctattaaaaaaaaaccaaaaaacaaaaaacgattttctagtcaggggacaacaacaaatgccccaatgcaagaaggaatttgaaacattcaaagaacagatagaaatttggcattgttagagtagaataggggacaggacaggcaaggtgataggaaacatgggacaggtcgtagaagaaccagaagaaaaaatggattttattctaaatgtaacgggaaagcaaaggagcattttaaggaagagaggggtatgacctgatttatgtatttcacaaaagtggctcaggctgtgggaagagtgaactttgaggaatgagttgaagcaggaacaccatcaagctgttggagtttatgttttcacacccgtgagcttctgaagggctcatctctccattctccatttttcagaatgcaataggtacttagtaactgcctattggatgaataaataaattgaatgaaccaggaaactctgtaaattccacgtatgacaggtaccttgccctcatcccttgtaggcaggggctgtgtcataccctaacacctgaccagatctgttttgttctcagtaattggagtgaatattcctaaggaaaggaaaatggcaaatgatttagaaagaaaggagagtgttctgtatctttttttttcagcctcttgattttcaaacattgaacctagtgacattaaacaaagtttttactttctgtttgggcacatgaactattttagaataagaagattttgtttttgcaggatactaaaagcactagtattttcatttactaaatattatctttacgtgtggggtaggtagcattggtagaagtcttttcaggtcatcaatatagtagctaaaagataaaatttgggctgagtctgataccggaatcttcacccaccaccagcaacaatcacctattggcttctgtcgttggattaacttaaacggaaagcttgatgtacccagttacacgtgggaacttcttacttcatcattgttgatcctagaagctttcatttcctttcataataattcattaaccctttatcaacttttaccctaaaataggttctaactgaagataaaactcagtgtgactttcagataaagagcttctgatttgaaaggcagatagaaaaaaccttgaatagaagagaaaaagaatgaataacaagtagactgttgagtcttaatggatctttttttttttttttttttttgagacggagtctcactctgtcgcccaggctgcagtgcagtggaacgatctcggctcactgcaacctccccctccccagttcaaggttcaagtgattctcctgcctcagcctccagagtagctgggactacaggcgtgtgtcaccacgcctggctaatttttcgtattttttagtagagacagggtttcaccgtgttagccaggatggtctcgatctcctgacctcgtgatccgcacgcctcggccgcccaaagtgctgggattacaggcgtaaggcgccactcctggcccagtggaatggttttaactacatataaaacttatctttgacattggaggtagcagaatgaaaatgttccttttatttcattgtcaagagcaaaacaagtagaatcaaaattttcaccaaacttcaagtgaagaacaagataggaagaggaaattttatgttcatatcctggaactttttaagaaaatttttttgtttgagtcgccttaggttttgactaaggaatttaatgctggtgtgatctgaaaagaaaaaaaaaaatattttgctagttactagagttgcaaattatagcagaatgccaaaatttatggaaagagatctttattctctatttttctattatcatactgacaaatattattatatgtgaatgagaaattattatgttaaggccagtaagaacttctttgcttttctctaatatcatttatgaatgttcaaaacctgatgtcctgggaagttgtttgggacataaggtgctttaaacaccagggtcagctgaaatgcagcaggaaggagggagtatgagatattgagtccaggcgaattgtttccctttagattaggagtcagcaaattatggcccatgtaccaaacctggcctcctgacggttttttaaaaaattgatatgtattagttatatagctgattgtttttgtaaatcaggtttgattggaacatagccacacttacttgcttatgcattacctatggctatttttatgctacagtggcataattgggcagttgtgtcagagacgtgttccagaaagactgttactatctggccctttataagaaaactgctaatccctgtcatagtgcagattttaaagtttgccatccctaattccccaaagcaaattgtctatcagtcttctatgatgacagcttgttttctgtgagtcccagtagctctgtgtgtgtgtgtgtgtgtgtgtgtgtgtgtgtgtgtgtgtgtgtgtatcactgaataaattttgtagcttcaataaaggctattgttctagattttatgtacctggccataggagtttatagatgaccacgaccataccctccgggacatagagaatgtgcttcaaaagatacatagcagcagtttgggcaaaataataatcgtgatagaagtaaactgatattgacagagtgcctctgtattgctggatctgtgtttcacaatggtttttttctcattatcataattactatgcaaagtacagttagagtttcacatgaggaaaatagggaactgaggctctgagaagttattttcttaaaacaacaaatctagtgagtccagactcaaacctgcctttggctccaaaacccatatatgtcctttctatcaccacatttgggctcttcttgggtaaattatacacataagtcagacaaattcaacagatttgtattgatagcaacaaatcatttttttcttaactttacacaccatcttatactgcatgtaatcttatgctgcctatacaggtcaagtgacttttttttagctgcgaagtgagaaagtattagtttcttaccacgaactgctattcatacctcacgtctaatttttttaaagtgtatcttcaaaatggttatagagggcaatgttcatactctttgggagatttgaaacataggtagagtgagacataccccatcagaattttcatcagcatttaatttttcaaagaggtacgaagtccttcaaaatgccacagctaaaggttgttggggtcatggggaatttgagatcaattatatgggtagcctgctacgatttatcatttgaagatagcatctatgtgaattttaagagaggctagtcaatatcacagcacagagacaggacacagccagtataagagtattagacataaaaaagagagaagtgaagcctccctactgtggcccctcatgaatgggggatgggacatagataaaaatgctgagtgctattttagcataattgcttagagtaaagcaaggctaagacaagaattacttatttttcagtataataattcagtgtctatcctgagccaatagaggaatcagatgtaatggcttacaaaagtgaatcatgtagtagccaagtggaaattggtttaattacattaatttgtctcatttttcattctccaaggtgagtgaaaagcttttatgaaaactaaccaaagtgctaatcccttgaaattcatccaaacatttaaatagcattacataaaattatcaattagattagaaggaaaaataattgtggatgaatgtcttctcccctgtggtgcatgtcttctctctttgaatggtttcttatggacagcaatggtgggctatatataatgaaacaaacccccctcagtaggatgcatatttgtacggctaactatataaattttgtcggaaacaaatcaaagaccaagacaaaattaacaaaggctgtttattcgtaaacttgtggcaaggtaatccatctgccgttatttgtttctgcaagctgcaaagatatcagaaaggagagtaagttttatagaattaaaagaggaaagattgaggcagtctctgattggcaatcattctatagggtgcgattttaggacgcagaggagactttctcattcatctttaggaatattggtagtccttggttgatggctagggagcaagctagccatttggggatatttcaaaagaggaaggattgttcaatcttagggatggaggactttctgtggttggccatttcctggaacaagtgcgggcaaacgaggtgcttttattgtggttaggctttcgtatggtgcttatttgaaagtgagggtctgccatggcaggcagtttctcagtgatttcttactagctatagtggaggagagaggcagggcttcctatggaccatggtgtatttgtgagctatcttcatctcttattggagattagtttccattttgccacttcctgtagtttgagatgtacaataatacagaaaataaatagagtctacaaagaagaggaatggtcaaagaatgggtgttaaatggcccagaaacattggtctcagctgggtttataaaggctagttcatctttccagtattcaacgacctcatttgttgttgttgatggtgagggtgttagccacaaaattatggttaacactcatctctaggagggtaagcaaaatatagtacagccatgatgtggatcatacataatagaaaaaggcattggggttctccctatttgcctgttcagtgtttatttctctagttctaacagagctattttggctctattaaaaaaagcatttatgttcatggtgtggccatgtatttctaacaagcagcagtgaacttggggtcaggggtttgagatttgggctcggctctgtcactttgcagctgtgtgacgttgagctcatggaaagacctggtatattgagcaagacaaattaggagggttgagaacaatgccataaatgcagagaggtctgcttaaactttggctacctcgacctgcttacttttcacttatttttatgtggatcttaacaaataccttcatgagtaaggctgatgggggattctttctgttaggtgagatttgaattgaggcaaaacctccagctccttgggaggcaaatgagagctttacccagatataggacatatatgatttttcttaatcaactgtcctattattggatataatctctttatggatatcatataactgaaagagcctggagtgtcaaaacaaaatagacttggatttcaaccctggctctgccatgtgctaagcataagagcctaggaaacttaacttttcaaaccttagtttccttttctgaaaaataaaaaatgccttgcagaatcatgtagattaaagatgatgaatacacattttctggcacataataggtgtttaataaactgtagctatttttatatgacatagattttgcctcaggcaacatcaggaggtccatttctggctcagtatctcctcaatgataaatatccccttctctgaagatcttttctggagctgggaaatatataacattatctggtagattttaccccctctatttaaacagcctagataaagacctcagaacattttttgagcattataaagaatgccttgaggaatttccagctagttaaaaactggcctttatataactctggtttaaataactcagttatgtgagaacggggactcagcgaataaagttatttctaagccaacagcgaatgcatggaaacatggataaaatggatgataatctgaaaattcattttcaactttagagagcagatatttttaaatttttaatgcattttcaactaacagactaggcaaatagggaaaatgatcattctagggtctactgttatctcaccatgcttctaattttgattttgattttaatatataacatattcaccatacgtcttatccattgctgtgtttgtttatccagctatccatccattcatccaattatttgtccttagtcatttgtttttaaatgttattcagcccacattcgatactagattccatgtgtgctgagggttaaagatacagaaatgtaagacatcccctgtgtttaaaaaaaattcaggccattgaagtagatgcatgcacaatgacaatgacaatataattgaactttacagaatttaacttcataaaaactgagaagggatggtgattcttctctcagggtaggccctaagtcaaggacgtgtacaaggtaccatagggggcctagtgtaaggatggaggatgggaaggcagaacttttttgtggagtgaatctcaagatggattttgaaggatgagaatatatttgctcaaggaacaggtgagtagagcatcccagatggaaggaacaggatgagaaatggcaccgagtattccaaggtgatgtgatttttttaaaacacataatatctactggatggctttttcattttcttggttcaaatctgtcaataggactcagtaagtagttcaggattttggtcaatagcagcttggattagaagggcaagttaggtagactgaaaatattcatggttagtagaaggacagtgggaacagtgtctatagggacaatagctcagtggttaagggtcagcaccctgtagctggctgactagcattagacctggatctagtaggttttggctgtacagtcttaagcaagttacttaactattctgtgccttagtttttcccatctgtaaaatggaatgaataaagatactattacatgaggttctagtgagaattaaatgagttaatacatgtaaagggtgtagaacaatgtctggcacgtgggaaatgtgcagaaagaaactgtgtatttcctaaaatgataatgatgatgatgataatatatgccccctagagaggagaaaaattgaggcccatctgcattttaggtacagctctaggaaatttacatacctgatcaatttgctgtcaaaaaaatccagtgagggtatttctacaaaatagccatttgtagaaaaggaaacagacaaaatgaatgtgtgcaatgttattacatagcaaggtacagaagctgaatctacatcaaagtctacttatctatggttaatattatgtggagacctgagagctagagaacttgctgatgggaagtagttgggaggctttgggacctagaaggcctagggatagctctaggatgatagcatgtaaaggagaatctagatgcagatgaacgcagaaatctaggtgaacagacaattctcttctaggtggtctggcgggatcagagcagagaagagtcagcttggagtctggtatacaagtcttgttttctgtgagcaacaggaacagggctaggcaggcagtggagagctactgaatgtttaccattggttcaggggtgggaggaggaaaagcccgatttgtagtttattgatttctttggtgtaaatatttccatcaacaggccaatgtgaaatcactgactgtggatttgggaagacatgtgcagagtcagctttcatgagcctgtgtgaacttggggaaacataccactgaagccagggccccagactgagatgcaagatgacaaactgtagggattattctggtaacccacaaagtccatctttgccatttgggcagagtcctactgattgattgattttttttatttttatttttttgttatcatgatgcagtcactactagttgtacttcttctttggccaactctctagcattcaatttggtccccaacaaagattgtacttgtcaactgaaccatacactgccaggttcgtcaggcctttcatattgcctcagatcctctcctgagcctcctgtagccatacagccatctctgttactgtattagtttgctttcatgctgctgataaagacatacgagagactgggcaatttacaaaagaaagagatttaattcgaatcacagttccatgtagctggggaagcctcataatcatagcggaaggcaatgaggagcaagtcacgtcttacatggatggcagcaggcaaaaagagagagcttgtgcagtggaacttctgtttttaaaaccatcagatctcatgagatttattcgctatcatgagaactgcatgggaaagacttgcccccatgattcaattacctcccactgggtccttcacacaacacatgggaattcgagatgagatttggttggggaaacagccaaatcatatcattccacccctgtaccctcccaaatcccatgtccttgtatttcaaaaccagtcatgcattcccaacagtcccccagagtcttaactcattttagcattaactcaaaagtccacagtcgaaagtctcatctgagacaagacaagtcctttcactaatgagtctgtaaaatcaaaagcaggttagttacttcctagattcaatgggggtacgggattgggtaaatacagccactccaaatggaagaaattggccaaagcaaaggggctacaggccccatggaagtctgaaattcatcagggcagtcaaatcttaaaattccaaagtgatctccttggactccatgtctcacatccaggtcatgcagatgaaagaggtgggttcccatggttttgggcagctctgaccctgtggctttgcagggtacagcctccctccaggctgctttcacaggctggcattgagtgtctgcatcttttccaggcacatagtgcaagctgttggtggatctactgttctggggtctggaggatggtgtggcgctcttctcacagccccactaggcagtaccccagtagggtctctgtgtgggggctccagccccatatttcccttccacaccgccctagcagaggctctccatgagtgtcctgcccctgcagcaaacttctgcatgagcatccaggcatttccatacatcttatgaaatctaggtggagtttcccaaacctcaattctagcaagcttaacaccatgtggaagctgtcaaggcttggagctttcaccctctgaaaccatggcctgaactctatgttggcttctttcatcggtggctgaagaaggctgggacacaggtcaccaagtccctaggctgcacatagcacgaagaccctgggcctggcccacaaaaccattttcttctaggccactgggcctgtgatggaaggggttgctgtgaagacttctgacatgccctggagatattctccccattgtcttggggattaacatttggctcctcattacttatgcaaatttctgcagctggcttgaatttctcttcagaaaatgggtttttcttttctatcacattttcgggctgcaaattttctgaacttttatgctctgcttcccttataaaactcaatgcctttagcagcagccaagtcacctcttgaatgctttgctgcttagaaatttcttccactggataccctaaatcatctctgtcaagttcaaagttccacacatctctagggcaggggcaaaatgctcccagtctctttgctaaaacataacaagagtcacctttgctccagttcccaacaagttcctcatctccatctgagaccacctcagcctgaaccttattgtccatatcgctatcaggcttttcatcaaagccattcaacaggtccctaggaagttctgacctttctacattttcctgtcttcttccgagccctgcaaattgttccaccctctgcctgtaacccagttccaaagtcgcttccacatttttgggtatcttttcagcagtgccccactctactggtaccattttactgtattagtttgttttcatgctgctgagaaagacataccagagactgggcaatttaaaaaagaaagaggtttaattggacttacagttccatatggctggggaggcctcacaatcatggcagaaggcaatgaggagtaagtcacgtcttttttctttttttttcaagacagagttttgttcttgttgcccaggctggagtgcaatggcacagtctcagctcactacagcctccacctcctgggttcaagtgattctcctgcctcagcctcccaagtggctgggattacaggcatgcaccaccatgcccaactacttttgtatttttagtagagatgaggtttcagcatgttggtcaggctggtcttgaactcctgacctcaggtaatccacccgcctcagcctcccaaaatgctgggattatagatgtgagccactgcacccaggcagtcacatcttacatggatggcagcaggcaaagagagagctcgtgtaggggaactcctctttaaaaccatcagatctcataagacttattcactgtcatgagaacagcaagggaaagtcttgcccccatgattcaattacctcccaacagtctctcccacaacatgtgagaattgaggatgcaagttgggtggggacatagccaagccatatcagttgcctttgcccactacccagatcaccaggcctttttatgacttaccctcttctagcgccaatgtccggttctatttttgtgtgtcctaggagctgattcttctctctgcctgttcttttcccacccaccacactgtgttctttggaaaccttattgcattgtaaaaaaacgtcccctacatcctcattgaactcttcacagaatgtccctctgtctctcagcctttttgaattcctttggggatacagctctcctacagctctctgagtggaggttgtattttctcccagaagcagcatcaacttttccaaagacagctttgctgcatctagagtaatttcttccttcctcatacaaaaccctttctcttctgaagccccagccatctgcttataacacctgttatcccttctaattgctgtcagtgacaaatctcctggccactccccctcatttgttgaggtctttggcacctacctgctcaggctttatctctatcataaactgtaccatcattctaggcagaagtccagccttgaagatttctattttggggactacaatcatcttcactccataccacttccatatgctcttttgtttgttttttctcttttttgatacggggtctcactctgtcacccagtggcacaatcatggctcactatagccttgacctcctgtaagtgattctcccacctcagcctcctaggtagctgggactacaggtacacgccaccacacctggctaagtttttgtattattattatttgtagagacgggttttgttgtgttgtcctggctggtcttcaactcctgggtttgagtaatcctccttccttggcctcccaaagtgctgggattacaggcacgagccaccacccctggccttcctaatgctcttgaccttgccattgcttaactactctactcctaaaatcataaattcagactaacctccaggtagaatctttcagcccaaagtttttgcacactctcactccactcatcaactcgctgcagccagatttctacgttcattctacttgtactgttcttaacgtagtcaccgatgctctgctgactgtcagatttacccttcatcctgctttcaaaatgacattgttggatataaaatgctccaggaataaatgcttggtgccgtgaagtaaaaccagcactcaggcaaaagtttaattctctcagcaaggcaatgtatttctgcagaagggtgccactcgcatcagtcaagattgcaagagcacagagaacaaaggacaccagggggtttttatatcctggacgcagtccttatctctttgtccctccctatgggctggggatggactgcacaatctgaactgacccaactggctacttgtacatattttcctaaatgtactgggggagggggatgtgaggtacagaggtggagtgtgtgagatgtgcaatttcgggggaacaatgggtacaggtagccgagggaacagatgtgagttattgattagagctgacgggaagcagggtaggctgtttacagcaactaggggcaaggaagaataagaaagttgagtttgagaacaaaggataaggaagttaacaggctaaatcctttgaagagaaactcagaaagatttattttgtcttacaatgtgttaaaactgcatgagttatcatgtcatttcctagcttaaaaacttaaataattgtatattagtttatgcattcattcagaggcatagaacagtgaactaagcagtcaagaaaacactgctctcaaatgcacatatctcatttgtgttttttaagaaagaaagaaaaacatttttaaaaatctccctcccaactccaaaaaaaaaaaaaaagctaccctgatcagtttgtagtttcatgcagagcatatatccccattgtcctcaggatgaagtttacactctaaagacattcaaggtctgcctggatctgaccttccttatgccacagctaagttctggttcctaacaccagcttccaattctgtgaagtcacattcatgggtggggcttcttcatgccctgtgtcttttctatggtaattatttttccaggtattcttttcttttccatttcttaccttctcctttatccatcttttatgacatcttgtgtcacgaccttttctagataggattacttatcaccttcttgtgacagttccatgcatatttcgtacatgtcagggtcctttatttttacctctgtctcttcttattaacggtgaaaggcatggccaagcctgcctaatctctgtaacctcatcgcccagcatagctcctgggcagctgagctcctaagagcaggtgaatatctaagggcttgtgtaggactcaggtaaacactctcaccctcagaaactcatagtgaaaacacctacctggctctgtcctaccccacccaaaacagtagagtagtatttggaaagaccagtggaaatttccagtgggactttttccctgatggtaccactttgttgaaggtctttatgttgaagcaggtgctccagggtcacaggtgtgtgaggaagaagaagctgtcattgattgaactctggcccatttttttactccaggtttttcccccagtaaaactttttagatcagcatttgataataaataccccccaattcctttgctaccctctacccttctctctctctctgtctgcctctcgtgtatgtgtgtgtttgtgtatcctaaaattctaaaatttgtttgtaactctcaggcatgtctctgagttagacatcaacatatatctaaaaggagtgatctcagcattttttaaccttcagaaaattattattattattatatttgtgtattttaattgtatttttccaaaaactcgtttcctttacctaatgtaggacgaccaattcatctttgttatcagccttttatttattcaagtctcttttattttgctactcctaaagaaggtttccactcaaaaggcataaattctgagtttttttaaacttaggagttttaatttctttcacaatttattggaaaaagacactgaacaacacacacacacacacacacacacacacacacacacacacaaacacacacacacacacacggatcagctgtcatcccatggcatagtccaaggaatagcagctgggctcaggcagggaaaaggaaaagtcagtttgcctgagcaggaggcagcagccctggggttgtcagcagggagcagcagtccatggaggaagagaatgcctctctcatctcatcttgtgaagggacagtcaaggggcattggctggctcggtggatgagtcagggtaatcactgacgggtggcaacaccaacttgaggagacgctggctttcgcttaggtccccaaggctggctagcaaagcccagtaacctgtcaagaatggcttcctttgaaccaaaaaaatgagaggcagcagcttgagacatgtattgaggcataagacgtggtgcaaggtatattatgtgcaccagctcactggatcttcacaacaaccctgtgttcctcagatgtggaaacccaagttcagaaatcttagggaactttcccacagtaacactaataggtagaaaatctggcatttgaactatttgtcacatttttttctttccagctatgtgacattcagctactcaggggcatgcctgttttcttgtcctctgagtgaaaagaaatacaggcctgggattggtaccctttttatttttcaacaactttactgagatataactcacatactaggcaatttacccatttaaagggtacaaatcaatgggatttcagtatattacagtattttacaaattgtgctaaaatgtatagaacataaaatttgccattttagccctttttttttttgagacacagagtattgctttgttgcccaggctggagtacaatgtcacagtcttggctcactgcaacctccacttcccgggttcaactgattctcatgcctcagactcctgaatagctgggattagagacatgcagcaccacgcctggataattttttgtatttttagtagagacagggtttcgccacgttgcccaggctggtgtctaaatcctgagctcaggcaatcctcccgcctaggcttcccaaagtgctaggattacaggcatcatccaccatgctcggcctccattttagccattttaagtgtacagttcagtggcattaattacattcacaatgttgtgcaacaatcatcgctattttcaaagcttttttatcactggatacagaaactctgtgctcattaagcatcgactgtccaatcttttctcccttcagctcttgaaatctcccagctcctggaaacctcaaatttatggtggaaccacaatatggaaaacagcttagcggtttctcaaaagcctaaacatggaattaccatatgatccaacaattccatttgtagacatatactccaaggaactgaaagcagacacttgaggagatacttgtacaccaatgttgcagcattattcacaacagccaaaaggtggcttgttctaatcccaaccacatatagagggcccaagactctgctataccatagcagctttgcttaattctattttatatattgttcttccaagttaggtattattccagatagagacagtatagcaaagtacaatgtttctttctttctttctttcttttttttaattatactttaagttttagagtacatgtgcacaacgtgcaggctagttacatatgtatacatgtgccatgttggtgtgctgcacccagtaacttgttatttaacattaggtatatctccaaatgctatccctccccactcccccaaccccacagcaggccccagtgtgcgatgttccccttcctgtgtccatgtgttctcattgttcgattcccacctatgagtgagaatatgcggtgtttggattttgtccttgtgatagtttgctgagaatgatggtttccagcttcatccatgtccctacaaaggacatgaactcgtcattttttatggctgcatagtattccatggtgtatatgtgccacattttcttaatccagtctatcattgttggacataagggttggttccaggtctttgctattgtgaatagtaccgcaataaacatatgtgtgcatgtgtctttatagcagcatgatttataatcctttgggtatatacccagtaatgggatggctgggtcaaatggtatttctaattctagatccctgaggaaatgccacactgacttccacaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaagtttgtttgagttcattgtagattctggatattagccctttgtcagatgagtagattgcaacaattttctcccattctgtaggttgcctgttcactctgatggtagtttattttgctgtgcagaagctctttagtttaattagatcccacgtttctttctttctttctttctttttgagatggagttttgctcttgtcatccaggctgtagtgcagagcagtggcgtgatcttggcctcccgagtttgagcgattaatctgcctcagcctcctgagtggctgggattacaggtgcttgccactgtgaccagctaatttttgtgtttttagtagaaacggggtttcaccatgttgtccaggctagtctcgaacttctgacctctggtgatccacccacctcagcctcccaaagtgctggaatgactggcatgagccaccacacccggccaaagtacaatgtttcttaacctttttgttaaaaaattattgcttccctaaggagtcttttaaacatttttaccttatccctgtcccatgaaattttattaccagagatacactatctgttcatgagcatggccctttggggaaccacagacctttataatatctaatatcaccaccattactaccacctctagacccagtttttcacccccttagaggtaatgtcactctagttgagactgcatggtgtagaggttagaagcaccacattaggagccaggtctgcctggatttttgtttggctctgccccttacctgctgtatgaccttagactagttgcttagtctccatgtctcaatttctttatctgtagacttgggatgctaaaaaacaatacctacttcaaagggttattatgaggattaaatgagttaataatataggacagcacctggcacttgcaaaatgttatacaaatgttacctgttgttatttttaacagagttctttcacttaaaaaatgacttaaaatccactggacattatgggcaccagattctctcctacttcccaccttttgcatggtgttttccgttccacctttgggttgtgttttcagtgataatatgaataattattatgcatttaaaattgttttctcttctttccccatccattcatttttgtctcaacaatcacattgcataggagtctggacttagtgattttttaagaaccagcttcagtagtttatggttttcataataaggtcatagatatagtcacatatataagaatttggaattgggaataaggttgatttcagttaaagaagcttatttcatctaaggactctctacatggcgaaatacatgaaaaagtaacgtaactagtcttcttgagtacatttagctgatcatcattcatcatacaggtggtagaggacaaaatgtttttaatgaaccgaggttgtgttcattaactacctgctcataggtccacaggcccttgtttgtttgtgtaattcagtctggtgtttaatcattggttaatttgatcctgtagtgaatcagatctaaacctctggcaccaaatcatttatttttaaaggcctaaagcctgttcactctattttgactgcttgaggggaggggtgaatgaataatttgaccaagtaactgtgggaaattgctatcgaattaaccaagaaatgtgaatacttttaaaggggaagctaagtttgccttgtagagaggcacaacagagtagatgccaggggctaaaattccccagaggtcaccttcctgctagttaatctcttgagcctccataaggtaaaaatgttaataatacctacctgtgtggtacttgtaaaggtgaaatgaattgatacatgcaaaatgcttaaaactatgcttggcataaagtggtggttaataaatggtacctattattatataaaaaggtacaatcagagataaagaggatatagacagctttgctggtagtattgcactcttacatcttgtttactcttgactgaattttctttatctttgcaaaacaagagtagctagctaatggaatcagagagataggaaagaccatcaatgttttatgaaggcatctttcttgcattttcaagactcaaaacaattattattttctgggggattccttccccagtctctttcaacggaattagcctcttctttctcttgtagaaattttattgtttttacaaagttcatgttcttgtgactgcctctctgctggattgatacagcttctgtgaaggcagagaccacatcccactgacatttggaaactttacggcctatagcatttggtagcctctcaatattttttgaatttccttttccaatttcagggaatccaaaagacgatagtagcttttacatttctagggtgttctttgataagcccaatggactgaaaagtcttaagtccattggacctttttggaagcactcactgggtttgttggtaccatcagttgaagcagagttcacaccctgacagattgaggtaggctgaggcacatcctaaggccaagactgaattgatcacccttcactcaatgtgtttctttccgtgtggacatttaacatcagttttatggacaccctcaaaagtcagaaataccaggttgggaagaaagtcatggggtgttgtcttatgatgcctttccagtgccagctagaaattcgtatgctgtgattcccaggggcacaaaaagatatgttactttatgacagtgtttgattctgaaattgagcctagcaaggggaaataaaaatgacttagcatgaattcccaaatatttaacatagctacatgtggaaaatacttgaaaaatgtcagcaatccaacactctaatttgtatttcatggtgtatgtaaccttgttgaagaagacttctttaccatacatgggatgaccaaaatgtcgtttgaatttttaatctgaaaatatttgatctggtaatcaacacatctgcttgacgcatatgttagaagatgatgttaaaattcatttcactgggcacctgagaaatgtaaagtgttatgttatcattattagtcagctcaagctgccataacaaaataccatagactagatggcttgcacaacaaatgttattttctcacatctctggaggctgatagtctgggcgccagcatggtcagggtctcatgaatgctctctctgacttgccttttccttgtgtcttcagaaagagagcactatatgtctgttcttataagggcactaatcccattgtgaaggcctcaccctcatgacctcatctaatcctaattatctcctaagggcaccatctctaaataccaacatattgtgaggtagggcttccacatatgaatttgggggggacacagttcagttcatagcagttatctaggcatctccctagattgtcttactgaagcagcatcattgtctggggtaaatacccaaggtttgttgcctcatgccaaggaaatcaaggacacagacacacgtggagtggggttaagagtggaggtttaataggcaaaagaaagagaaaagagaaatagctctctctcctgcagagagagagagggccaccaaagtgggaatttctgcccaaggcaaagtgcacagtgttttatagacaggcttgatgagacagtgtctgatttacatagggccaaaagactggttgaaccagatgtggtgtttacgtcacactcaaggaagctggccaccccaccttaatcttttattatgcaaatagggtctctacctggccattgccatgttgcctgctccctactgtgaatgtggttgacaaagaaaggagaagatggagccaccatgttggacatgcctagggcccggatagccttttcctattggcacagctgccagcatttgcccgtgcaagcttccagcttgcttatctgtgtctgcagctcgattttatgggttgctctttgttagaaaagaaattgattttggtgctgcttttcattaaaaggaaaatcttaccaaggacttccttaccctcactatctgcctaaataatttcttcctaactcctatatcattacctctcccctcccctcccctccccaaccttccccttccctcctctccccttccctcccttcccctctctcccctcccttccctctctcccctccccctccccttcctctctcctctcctctcctctttattcttcccccttccttccctccctcattccctccctccctcccttctttcctccctccctctctttcttcctttcatctttcttctttctctctgtttctctctcctcttggctcactaatgctccttgtgataacatgccttaaggcacagacctccatggattaaatctgatagatagctatgttttgcttggttcaaaatgtttggagaaaaatatgaagccaatatttaaaaaataatgctaagattttcaccttctctaaaaagatcagagacctagcccacaattcctgagaggcaatacagactgtggagttgtgctgcctgaactcctctcctggcagtccaggtctgcttcctagctatgtgaccttagacaatttactgcatgtttctatgcctctatttcctcatctgtaacatgaggatgattctaatatgcacctcatagagtgtgaatattaaatgagttaatccatttaaagcacttaaaacttcctggtgcatagaaaatactatataagcactgtttcttatcacaccttcctggtactatttcactagagctacagttttctacagtccacactcttcctattgtttttctgccactggggttaagtgtcactttttattaccattggccttgcatcgtgttttttctcttataaaagagatccattccattgttcttggagtaggaaaatgagaaagaggaaaagaaagagagagagagagatagctggctttctgtgttaagaaaaataagaaagacttgatttctttgtggaaaggacatggtttgcatatatatttttttacctgacttctgtaggtatttgatttatattcctaggttctataggcatttgtttttccccccttgctttagggaggacgctataattatagaaaaacatggaacattgagtaaagcactaatttcagaattagaagactttgattctattcccagtgcaatgattatctgtgttcctttgggcaagttggaaattttctctgggtctttactttctcatctgaaaaagggaagaataatttacatcttgtgtgcctcgatgtttttattgtttttaattttaaaagtatttttagagcagttctacgctcatagcaaaactgaaagcacagagattgcccatatacctcctgctgttatccgttatcaatatccctcacctgagtggaacatttgttacaattgatggaccttcactgacatgttataattacacaaagtccgtaatatacatttagggttcactcgtggtgttgtatattttttgggtttggacaaatatataataacctgaatccaccattacagtatcataaagagtattttcactgccctaaaacctcactggatttttataagttcaaatcagagataataggcccaattaaaaaaaaatcagtatgacacaaagggaaagtagtgattgttctaatataccaaccagttagccaacaccactgtgtttttatagctcatgatctctgcaaagtcagtaggttcaagtctgataaaattgctctgcaagttatcttaccagtccatgaagaacttgccaagagctatgcttttgtgtggatatctgcttgttcaccctagttgctcttagttttcaggggagatgtcaacgcagttgacacagctatcaagaaatagtgtgggggctcgggtcatctagatagtattttcctggacctgtatcttgggaaaggcatctggaacatctgcaagctcctcttgcaaaaagagggggtggcccaagagaagctgctccagaagcaggcttgtatgatgtggacaaaatacctgaatgtgtcaagaactttagaagtgatggttggctaaagggtttctggtccaactccctgaatgtatacgtgggaaaaaccaaggtcttgagaagaaaagtgacttgcccagtgccacagttagctaaatgaaaaagcaagaatagaacttgactcttaactgtcaatccagtgttctttgtccaacagttagtgtggaacaactatcctctttggagtcataagaaccttggttgaaattttaggcactctacacgtagtatccgatgtcaatccctgggatggttaggagcaatgagatgagaggcacacagtgcttgaccaaaaacatgttctcaagagctgttgatcttctttcctttttaaatgtacacagggagtggggaatgccttttcccctcctaagtatatccctccctgggttctttttctagtaaatgtttatggaagaagtctgagtagatcatatcattttattaagagaattctttgcatcgcttctatcggttacccaggccctgccttctaatttaatgatgatgatgccaaatttgagtctgtgtttgttctgaactcttatgcagatggaacctggtgatacatgaagaatcattatgccacatcaagtttcattttacagtccataagtacaccttttaaaacaaaaacaaactatttcaccatcctggggagggatgtaaatcatgtatttttattacctcaaaagaccaccagaaaatgagctctaatatttcaaaagcgacaagcaatttatatgaaagaattgcaatttaagccccattatactcaagatgatatatgctgcaatggggtttatagatgtttctctaacaatagttaataataaaaaccttaggactctttgttactcttttctaattccatagtctcaagcgttatgagtagacgctgtgtcagtctgtgagttccagctgggagcaaaatgcttctgtctgttttggggccttgggtcactggagcctaaagtgtgaaagtataaggatttgatttaaaagagccaaggaagcagtgatgcacggagcagaattgccattttaacagagaatgtaatgccagaacaaattcatgaatggccttgcacacggatatagaatttggagatctatttgtttccatacacatcatgatgcatctaacataatcacagtcataaacatcagctacagcgaacataatcatagcatcaaaatgttattgagtgctaaaactggcacagtgagaacaatgacaactttgtggtcatattgtttggatccagacccaggtttctatgcttactgattttgtacttgggcaagtgaagtcacctgataacctccgagcctcagtttcgtggcatggagatacctaccacgaggagtcaagataaatggaaggatgagatgctccatataaagtatctagcatagtgtctgatacctaaaaaacagcatctattttttgggtatttaccaattgccaggggctgttcctagttttcctttataaggtacgtactattagactcttagaatatgggtatcagcctgtgcccaaaaatgtgcttttaaaatagttcgtccttccagtacatgtcaggttaactgtggttcttcctagtaaagctttctggactgattcaaatttttagcgtgaacatggatttgtgtatgttcaacttccactctgagattcagcttcaggcttagcctcttcttgtctcctggcttctggatgaatatgaccattgctcaagatatctgcttcaggcagagtactgtcaccacctgggcaaaggtcagactgcatttcaagtctgtggttagcatactaattgctttggtccaactcaatttctctctttaaatgtcagtttgttctttcattagggagttatgatttttgttttgtaattattcaatacccttcagagccttttttctgtgaacaaaaagcagcctttgtcctagactcatctataaaatttataaaatctcaatcattcgctatttctgaagattgttttctcaggatagcccagctctctaaagatgttaattccttttttactccgtttataatcagatttgcttttgatacacccttgaatcctattgaaactgtcttctgggttgtgtgtttccctgaggatggagaggcaatcctttggcaaacgtgttgccattccatcctctgttcccatcccaaaaccgtgagagttgccaatttctttctttcttttatcttcttgtttcaagagaatcagctggagtactccacttcactttctctctcttctccccaccatttttaccacaagatagcttttatatctggtggttacatgatgaagaataagcaatgaaggcaagattgtgacattttaattttctggtacattcatcaacttttcatctttatttcagtgctttctctggactagtaccaggaaattattagatatgcaagagctgaaattaataatggtataaactgaaaacctactcaaaaacacatcagcagagcatcagggacgtgtgggcacagagtctcaatgacatgtagagagcaagggttggattaaatccatgtaaaaaattctcactggggttttctaaccatcccttgtttgatttttgaaaatatttttattcagggccttggaatcttatgaaacaaagaaatagcttggctggcttgactcaaaataagcttgttatagccaagtaactccttcaaatctagatgaggcagaggcctctcagcagcttggtgatggcctaagaaaaatgagccaggaggtttctctggaaggtgttgacaagggtccatgacagggaaacattcattgcagtcagcaggctggctggcagctgtggcccatgggctgaagattgaattgcctctaaggcaagtcctgactagtttctcatcttaaaggatggctgggcatcccagcagagtgagatggagttcagtgtggctgtatctctgtgagtaaaataccaatgtgatttagccttcagcgtactctgctccaatcaattctcttcactacagccagagtgatatttttaaaacagagaaattgaattgtgttactaccctgatgaaagtctgagctccttcacacggcctgcaaggcctgccggaatctaaaactggtaatattttatgaacagcacactaatgtccacaaagaatctggcccaagcttatttttccagtttcatttcaaatacgcaaagctcctttttgtaattaagtcttctcaaacattcttttctgtctggtaggttattgctcttcccttggcctgtttcacttctgtttcatgtctcagatgaaccatcactaccagagagaatccttctctgactctctcagagtaggtcaaattcctcttgttgaaagatctcacatccttggtagaatttattacacattttgctcaatgccttgcctgtctgcgaggtctatgtggcattttgttcatcagtccgcctctgggcttagtagaagcctaattaatgttctttgaatgtacatgactaaatgatgctttccatttctaacttgacagacaaaaactttagcctctatagtttccctaccttcattctctacctgatgaattcttgctcatctttcaagatgaagcgtaattatatcctttcttgagataacttttgtagtcattctctgcaccaatcagggaaggcatggtggcttaagtcaacaaaggcatatttctagctcatgcaacaggtatatggtgcttgcttatgcaacaggtatatggtggcttgctcctcacttgggggcccaggttgaaagagtctccatgtctttgcttccatgggttacaaggcagaaacaagaaaatgtggtaagctggatgctggctcttaatctttccacttagaagtgatatgcttccactcagatttcatgatcaatcatgagattaatttaaaccatgcttaaatttgaaaaggatggggaaatacaattgtgctatgtgcccagagagtggaaaactggtaatattttatgaacaacacactaatgtcaagcagccctctctaatacctggcttctcttcttgtttccagcctctcacttgttatgcctattttcacccaacctttcatcgtcctaccaaagaccttataagcaacaataactaaatcacttccaaaatcttaatgtcaccatactactctatgactccttcttttagttttccatctcttggattccagtggtctgactgtaataattccttgccttcatcaggattcttggtggaagttgagttccccaggaagcaacctctgtggttggcctgcaggaagttgattgcctgagttatttcactgatttctggtgttttgttcttatttcatggttatgaaagtcttgctaactgtgggtctccttcttagatctcaatgacctcgcaataacttttatttataggctgtcagatctttagctctgaaaagaatctgatgttatttcaatatattttattaggaaataaatcaacttacttttcttttaagataaatagattaatgagtttcctagtgactcaatgtagccatttttatcctcggtttctgtacattaataatattaaagctctaatgattattgtaatagaaatactgtatttgactaatcaccattttcaagaagctttcatgaagtaaataatagtaaataacttctgaattcaaatcccaggtctagcgtgttctaacaggatgactttatgccagatatttaacttctctaagccccagttttctagactataaaacgggagtagtgtttgtattttgctcatgggattgcatatggattgaattagataatatctttacagatataaaacattgggttcagaattgaccattgggacaaaatgatgaggatacttggacccagagtagttgaatgcaagtcatagactattaatcagcagaaccagaactagagctcacattttctgtcttggattcccatgatgtactcatgtccttctttctctaaccatcacacacaagcagtctgagtaaaaggaacataaatctgtttttgaaaacaatctccagaaaaggctaaactctgtgcttaaggttgtaggttattttaatccctatcacgaacttttatgagaaagcaggtgatgctctgaactccatcccaaaaagaacaagactttttgttgaatcagcccattattctatcacatggggaggagctccaggtcaaaggatgagagacattaatttgcatcaggcaacagcagttgtctatattcatagtacaacatgggagaaactagctacaccatcattttgtagcgtttgaattgaagcatgtcttagtaagacatacaagcagagaggggctggattcccttgatccctctgataaaagctataccatgtactgtggacacctaataaatattcattgatatcgacttagtggacacagaactccttgaatttggacatttaaaaagagtattctccttggtaagaaactaatagttgtaaattcattcttcatacttcttgggctcttacctgttttgtctcaccatgcatcgttctggaaacactttcagctcaggatgggatctaacgtaccaagctgaattttcacctaagcttttgtgtttaatgcatgttactttttctcttggcttctatggacatttatcttttttaatttatctgcaaaatgattacactgttgttccattattttgctaaccatgatcttacttattttttttccttcagatattgatgagtgtgcagctaagatgcattactgtcatgccaatactgtgtgtgtcaaccttcctgggttatatcgctgtgactgtgtcccaggatacattcgtgtggatgacttctcttgtacaggtgagctttaagaagcagtgttgtttttttaattcatccattctctgcaccatgtctgtgttattatgtttaattcctagtgcacaaagtactatttttatctaaatagttcttctctttattacttcaccccaccttttgagaaaaaagcaataataaataaattatctgcataattgatttccactcccaatatttctgcctctgtgtgtgtgcttgcatacatgggtgtgtgatttgaaactgaagtcccagttgccaatagtaacactgagggagttagatatactagttctaaaaatagaaagtatcaattattttcgttgcatcatgatgaggtgtttttgtagataagaaaatgtactttgttcccactgggaaagacaaggattaaatttaaagaggtgacagggagtacttggtggtcaaagtttaggtatatgggagctggtcgaaactgtatttaattaatatatgcttgttgtctgtgtcccacctctttctatatcccttagcactacagtggtcactgactctgttggagtagcgctggttttatggggcatttggtttggctttccagtatattttcaatcatgtacatacagacatgaacagtaaattggataagggtggtagaagattccaagtttttcttctcttggaccaaatgtgtttaaatactaaatctgtaagttataagaaaagggtcccttgaacccaagatttcaatcatgttgtaacttttcctgatgtctgcatctttctctttgttccaatcacgttggtatataaaaagtggattctttactcagaatataataccgctatttttaatgtactttttttttctgaatgaccttttcagaagtgcaaaaagttgcaaaagttaagggcacatgttagtatgtccaaatttctttgccagtgatgtctatttataagttactattctttgggtgaagggctggagagttcagattgacacaggtttctgaggaccacataaagtcacatctcacttatctgtcttttacatattataattaatactcttaggaaaagaagagagagactgcataaacatagtgcgctaggatttcagtgttttaaaggatcaaaactttttcggaccaataaacaaacactttctaaaaagctgtaaagttacagggcctatcaatctgttcttaatactaaatgtggctcttaacgtcttttaaccctaagattagaagaaggcagtgaatatcctcctagcccaagagcaccatattatgcaacttaataaacattaattaaagccctgctgtgtggaagaccttgttgaaattctaccagaatgcttgactttgctcggatttcctcactgagaaaggaaggcaagagctggcacttgtcgaatgccttaataggataggcgctctgtctggtggtttatatatggaacaagatggaaaatgtgttatcttaagaactggctccacaattacttttagaaagggaactatgtggtttggaataaaaggtaacagtgtgggtatcagtgggcacccaagtgcccttctcccccctacacaggaaagagtaaggctctgcaggaaaagtctacatcaaacacacacacacacacacacacacacacacacacacacacacacgcttttttgttttgttgtgtgtgtgcctaagagggaacacaaaagacagaacaaaagagagaaagaaaggaggggagaggaaccagtcagagaacagaaggttgggtgctgtggaggacagagggctggtgaaaaccacccaatagtaggatagctgaaaggatttttaagagaagaaatattttatgtgagtttttttttattgttttgccatacagtatgctatgtgagttttccttcttaccctcaaatcttcaataaagtcttcccaccctgaatgcctcatgagaaccgccctccctcccctattagaatgtaagttcacatggtggacaacagaaaggataccagtgcatttaggatgtggggaccacagaggtaaccattatcaagtaaccattgttacagttctttctgctgcccccaccaacatacacttactaatatacacacacatcattatcatcactgcctcctctcaggaatttcagaaatcttgatgaggactgtggattttcataggtcacaaaataggtgaggtttttttttctttaaaaagccttcctttgatcccagatttctttcaacctgcttccctatttttctgcttttcctcacaacaaaacttcttaatttgcctgtggttattgtcctcaccttacatttattcagctcacatatgctcctcacctctctccagtcagacttccatactcaccattctgcagaggatacatttatcaaggccatttatgaactctgttttgctaaagccagtgttcttatctcagcagcatttagcagggctgaccacaccttgctctttaaagcacatgttttcttggcttttgtgccatcctatttcctggttttccctctttgtcacttgtcactcttgcccaatgtccccagctattcttgtgctgctgacttctgaaaggttagagtaccctccggttctatcctggtccccttcccctgtttacctataggttctttttagatgccttcatcaatcttagagctttaatagtatctttatgtcaacaactcctaaatgtatcgctccagttccaatcttttttctgaacttctgaattatatattcaacttgacatgtacacatagatgcttagtaggaatttcatgcttaacatggataagacagaacttgatttctttccacttctacaaacctccttctctcccaacttctcccattccagcaaaagcaccatttacccaatttttctagccaaaaatgtagagataactccttcctctccccaggggttacacttgatcacccctccaatttcaatccatgcatctgtcttgttgatgctaccctttacgtcttgtcctaagtccatccacttctgtctatatcacctattaccatcttagtggacttcagccatggccatcacattggactttctgttccagtcttgttccatcataacccattcttcacatagcagacagagcaatttttttaaaaagagaaatcatacaactctacttaaaactttgatctagtgtctcattacatggaaaatcaaatccctgtttcttatttcaatatataaccctatatagttttccttctttcccttctgtcttttaccgtttctttccttgtccattatgacatggccatgctgacctttgtctttttctccatgtaacaagcttgtttctgtttgttaagacctttgcatgagctattgcccttttatggaagtctttttcctcttgatatttgtgtattgagctctcttctcatttacctcttagcctaagcctcagagaggctttccatgatcaatataaatagccactctgttgttttctgtcataccacctgattttagttctctgagtaatacatattattatctggaattttcttatgtataaatgattcttttatctgtctctttccactagaatgtaaactcttgagagcaggggcctttttccttttgttctctactataccttgactacttagaacattacctggcacaaagcagtgctcaataaacatttgttgaatgaaataatgcataaagctacttgactttgggcaaatttttcacttttgaaaacctcatttataaaatattgctcacatctgtcgtacccacaggttatagtgaacgtcaactaatatatgtgaaagtatttatcatagcacttttatcagtaaggataggatgttctgtaggatgttcagaacattctattggatgttctaaatataagtgacttaagataaattttattttttgcttatgctatttgtctatctctgatcaacagaggcgttctgcataccatattcactttgggatgcaagctgttggaatggtcactatagtgaacatttccaatcatcaagacagggaaaagagatcctggaggccctccatcagccattaaatgttctgaccaggaagtgacacaaatcacatctacttataactcattgactagaactaatcactagttccatccatccacaaagggatgagaaaatactgtcctacctcatgcctggaatggtagaggaccagaaacatttggcaaatggtacccatgcctatatagtgagtgatactaacagattgccaacaaatatggtttattttgacatgagtagctgttgattaggataaccttttttcaacagcagttcataagctatgtaggtattctcaaaaattaattacaatattaggcacattgtattaagtgctatgatagaaatgcaagcaaaatacaatgaaaaatggcccttgattgccaagatgaagtgtttgaaatgttttctgaaagcaatggggggctgtgggaattgactgaggcatgctagcatgcaatgactatactatgttagggatttacaatggggaatatggatgggagacaggagacaggaggagagcctctaggccagattcaaggaccttcattagacgctttcatagtaagcttgagtctttggaatgctgacatttattttgtgtcctgaaaataagcttgttagaccaaacgtgctctgtactctccaagatatattatgtccccacccataacctctgccattttttataggcaaagaagacttccttcccttagtggtcatttgcctgtgtaataaatgaggtgtatgatagatatctgccactataaaatgtcttttcaaatgtttcattgccagatgattatttgttgggagaaattgacaggcctaaaggcattcctttatttgactccggatcctgatatagcatttccattattgacattccttatttccaaagaccattctagtctcttctcaaatcaatcagtacctgctgacgctgttcagctggttttataaccatgtcaaggtcatatttttttcctttcttttgctgttttatgtcatttagctttgctactcagtttttagaagtcagtagtcatactgaaaaattctattcaaccaaaaataggaagcctaaagttaaagaagatatatcagctttggtgattcattgatttattggatgattgattaattaattattttactatgtatgaaatattcagttagtgtctgtcacaagtgttataaaagatagtcaccaagattattaaaaaataatgtctgtgccaaggggttcatggtttgttaattaggcaatatcttcaaatgagaaaactcaaatgttcattcaccatcaaaaatattgcttgccaaatcaatccctctttgaaatcttagtagtttagtttagtattggatgtttcaccctgtggtagttattactacttgacaagttttaaagaaggaaaaccaaactagtctttcccaattctgtgctgacagccatggtcctttcagaagactacacctgagacagtggatgctaagcatgatggaggagaaaggcaatgcattacacagaacaggaaactttagctcttacccaacatttttcttgctaaaaattgaaaaaaaaaaaaaaaggattatatatatgggataataaagctccaagagttcaacattgagaataattatctagagcttaaaagtgtgctgtaacttaatctttacctccctggggactggggtttccctgacatgagtatgtgttatatatggagctctgtacttttttgtagggaagtctcccttggcctttgaaagggtgaaatctaaaacatttggcctttgacccttgggggagtttttagccttggaattttcgtgtggattgaaattgcgttgtttcttgtaagagatcccttagttgctcttgctcttttatgaattttgaaactggaagaggtccctgaaatggaggtgttacagggaggaggggtttttcttctctcccccgtatgcttttggtttttggaatagtcaaccagcttgatttattggcctctgactttcatttatccccaactaaactccccgtgtttctggctgtttgataagacattatcattagatacgcaggcagttttaaaggaggatatttgtgatttacaacaaaagcatgcagcgataagacagatacttcacagtaacgggtaggcattcatttttatgccaaaagcttcccatgaaggtaagaaataaagggaacaagtgagataacaaatatcccatgtgatctctattaccttgctaaaaggatttttattttcttgatattggcatggaagaaaccttaaaggaagtttatgtttgaaatagagaaaacttaaagacttagatataatagcctattaatttaatggtttgaattaagtacactataatgaaaagagattagacaacagtttaaatgccttaaaagtaatagttagttgttagaaatgtcaggctaggtctctggaatatgctttactcccatgatgaactatacaaatatttttgatgaaattttattataattttggtcaattatattgatgaaatagagaatattttcaaatatgagatatctgatattttctcatttagcagagccacatgaaatggaactaaaacagaacattccgcaacctgattgagcaaaatggcaaattttccacggatcatcattatctttcaggcccataccatgtacttgtgtcagaatgcttgtccttgtttaccgtaggctgtgtggcagcattaagggacaagttacaggacaattgcttggctttcagtctcagcagaggtgatacatttataagaatgaaacaggtcacaggcctctagactattttactttagtaaaaatatgctctatgaaatgctttatagaatgcaaagctactttttgcttgttaaagataaccagaaactatttattgatatattgaacaagaaaagtcaaaataaagcatgtgctactacttttgcatatttcaaaaccaacctagaaggtctgatgatagttatttatctgttgttttcatttgtatggctggaatttctctctttttttcttcctttcatataaatagataattggctctgtaaccctccttccctacgccctcagaggaggaatgctactgtaccaaaagcaggattccaaaatcctaattctttatggcagagattcccaattctcacctcagggttgaatcacttggaatctgggatctatccccagagattttgatttttggctgttctggggttgggacccagctttggtgggcttgtttaaaagtaattctaatgtccagtcaaggtcaagagccactgctttagcatagagcagaagaacagagagggttggagtatggagagaatatcagagggaaatgggaagggatatgaattgcccactgtattttgtagatgagaaaaaagattccatagaactggtggtgagaaatgtggagttcaggaagtcatgaagcagggacttggatggttcctggaggaggggtcctgcttccaaagctgcactctgagatgtataagacgctggatagacaatgactgtgaggtatctctatagatggggcctcatgggaagatgttgaatctttaactgtgacattgctgctgcattgcctgaaagcgccctaaagacaaatggagcatatctatggtgactttgtgttccatgggctgaggattaggcagcttcttctgtgccaatgccttggttattgggggtcctctagagccatgatagagcctgatggaagtggggaacacttaaaatgactgagacatttcagtgaccccactatctcagaagaataggagctcacaaccattcaagttgaattgaagaaattatagaaactttcatcacttgcacaaacacttttgtgactggacttctctacctgtcacatacacaaaaaatgaagtcaataaaagaacgaaacagaaaaaaattaagaggtccctctaaagagggattatagtataaaaattcatcgaaagtttgtttttccagaccaattttagttttccatatgtagtactggaaaagccaaagaccacatatttatttcatttagtgatagtagtgttaaaataatgttagggtttattaaatccagcacatatatcttagggagactatcaaagctcatttaccttgaaatttcatgatgaaaataagtctgaaagacatgtctagtgtttgattgttttgttgggtttaagtgggagttcctttttattcctacatgtgttataaaggacctgaaccactttggctgttgcagaacaaccaggatcaatgatggagcttgcccctagggtgtttgtgaacaaacctattaagtactgtgttgcccttgacccaaattcatcataaaagccttgttaatatttctgtacactctattgttagatttgtgcattcagaatcacaataaggctttctcataaaggagtttcattaaggatgctttagcgcttacaaaattgttgaggctggtcttgcagctccactctatccacattcaggtcatacaatgaatggacatttctctttaacaaccagtgttttatcttatattctttatttctatcgtaaagacatggtacatgcatatctatctatctatctatttaatctatctgtctattgttatttctgtactttttagaagtatagtgaagtgccttaagattttttcttttgctaagataattgagaatatatactaactattctttggccaaaatgaaagctataaattctcatggttaaagtctagtgtataaattctactggttgcaagctttgattatgtcacttatttactctgtgaatcagaaagctatttaaattctctgcttcttcatcagtattcactgtacatcctcacagagttgttaaaggataaagtgacacagcgtacgtatatcagtttgagtgagtttagctgaaagaattaaaaaaaaacagaataacatcaaatgactcaactggcttaaatgacaaattctcacataaaacaatgactgtgcggacaggtttttcagaaatagttaattcagctgctccatgaaatcctcagtggaacagattctttctaactttttacttggttattttcagtatgatagttttggaacttgatctagctcccctcaagatctcaaaatggtgaagttactccaagcatcaaatcctgacttaaccatgtcccagagtcagaagggaaaagagatttcccttttcacagtccctttttaaaaataagagtaactttattaaaaacctcaacagatttattgtcatgtctcattaacaaaaatagtttgacctacctattcataaaatataccttagaaagataaatagaatcaagatttatcccctgaggcttgggcagatcccagcttcttttgtagtacttggataacttacatctaaacaaaatgtgggtttctttgtcaaggaagatgtgtgtgcctgcgtgtgtgtgtgtgtgtgtgtgtgtgtgtgtgtgcgtttccatgtatgtgtagatccacaattgttagagtatattaacagctttgaaaacatgtttcaagcttaggattaataaaaagaaatgcaaattaaaatgaaaattagatagcagttatactaaatttatgtgtgtgactatctgtgtgtagatatatggatacacatatatagatagacatatatgtcaatcactcttttctggagaaggttcaggaattcagcactttcatatatcactgatgagaatgtaaattgatacaacctttcttgaggctaacttgacggtttatagccaaaggcctagaaatgtttatttatagtaacttatcctaagaaaacaatcagtcacaattatttatgtaagaagactttcattgtggccatttattccatttattatttgtaagaaaaaaactggaagcagcgtaaatataaactcatggaaattcgattaaataaatgacaataaatccatatagtggaacataatgcatattaaaataatgtttaaaagaatattatgtgtcaatggaaaagtctcatcatctaacatgatttaagcaagtatgtattttatttttcacttcaaataataaaaaatatgtatgaatacatatgcacatacacatgcaagcacagacacatagaaacacagacaggaaatatcctcacactccttcccaaataaacagagaacagagggtatctctgagtgaatggttaaacatgatactttttctttatactctatatattttctaaattttctgtagaaagaaatataagacaatgaacctatatacatattattatgagaaaagtgttattaaaatattagaaagcagaaaatgctagacaaaggtgacattgagtttttttccccccgaagtctcctaaatgttacctcagtaaattaaaaaaatatatatttatgacctggtagggataatgtctttcatcttttatgacacagattatagttctgaactaaagtgattaaaagcaatggctttgcttcatgttcctggagaatctgcatggccaatatggcaactgaaggccacttgcaattatggtgctgtcttaattcaggcagctgtaatgaaatacctgacactgggtagcttataaacaataggaatttctttctcacagttctggaagctaagaatttcaagatcaaggtgcctgcagattaggtgtctggtgagggcctgttcctcacagatgattttttttttttttttgagacagatttcgctcttgatgcccaggctagagtgcaatggtgcgatctcggctcactgcaacctccaccttccgggttcaagcgattctcctgcctcagcctcccaagtagctgggattacaggcatgcaccaccacacccagctaattttgtatttttagtacagacagggtttctccatattggtcaggttggtcttgaactcccaacctcaggtgatctgcctgcctcagcctcccaaagtgctgggattacaggggtgagccactgtgcctggccagatgatgttttcttactgtgtgctcacatgatgaaaggggtgagaaatcttcctggggtctcctttataagggcactaataacctaatcactcccaaggccccacttcctaataccatcaccctaggggttaagattttaacatgagttttgggggaataaaaacattcagacatttcagatgctgtgttcttcctggcagctgatctgatagtggagtcctaccacactacctctcataagctttctatgaagggttttcagaaacaaggcagttggtccagatttttctggatcagggccaagacaaagagagatactaaggggagcctgaaaagacccagtatttccataggaaagcaaccactgaatgagaatcagggaacatacattccggtcttccccctaccaccagctcactgaaagttatcatgtcaacatttttcttggactttgaaagattaaggtttaactagctcaatggttttcagtcagaataacttggattctaaataatctttcttttgaaagagttcagcttcttaaaaaaaaaggattattttacaaactattacttttctaattctatgattctgtaagatatggtttctgacctctaggagattgtggtctctttgggagacataaaatttacatttaagtagaataattttatcaggcatataactgagttctaaattgtgagttacaggcattaaatgctatgggaaagagcattggtactgggagaaaggacatttattactaactggtggagaggaaatgttttctatccttccacgggtgtctgaaagggtttgaatttgatgttaggtgggagtgcattgagaagtaattgtgcctgttgcttgagaaatagatccatctccatttttattgatctacaatgtgaactggaggttacctgtgtagaaatggaaagaacacagggctctgaatcagccaggcctgggtttctgccccaagtagggtatttattcatagcaccaactcaaatcatcttcagagaaatgggcacatcttccttctagaatcttacaaggagtgaatgagagaatatttgtaaagtgcttggaagagagctcagcatagagtaaacgctcaataactgttagcaattactacctctacacatgaggaatctatgttaaggtgtgggaggttgaggaacttgtctacagctgtaggctagttggtggtgaggcagagataggaaagtcgacattgtaactccataggctcaaagataggataggatagcaggctgtgttaactccagaagctcaaatataacctccatcagagctcttttgaaaatgtctttaaaatgcgaatgcagacaagatcgggtgcattcagaccaaaatctcagaaatcaccactgaagaacctattcacgtaagcaagcacctactgttgtccaaaaacctattgagataataaataaataaataaataaaatgctaatgcgatgtgttcagcaagcaatagccattgttagaaagaaagaaatagcttgggcttgtgaccaagtgaacccatatttaacccgcagctctgcctcttacaagctttggagtcttgggcagattctttaagtgctccatgcctcagtttataacaccaagaaagacgattgggttttaaggtttgatcatgtgaaagaaagcccaacccaatgactgagtcctaggtggtactcaatattgaagccctaagacctgttcaccatatttcctttttctccctcaccttactaagtagctcttaaagcacttaaaagaataacagggcaccttaagatacatttggaaagccgcttgccttgagaagcccaggctgtgtagacagtgttcagactgggaagatgagcctagaatcagatgctttaggctcatgagttaacaaggagatgatgtagtgtaaagtggacttcaaaacagagtttataactaccaaggaatacattcctttaagtcaagagaaatatcaccttcctagagtcattagtttgtgagttgctgtagaacagagctttggaatgtgctctgttagctccctttaaaaatttaactttgttccctgagaagggaagcccattaaactgcaaacactttttggcatttatcagttctgctggctggcatctagttattccttaagggtggtcataggacaaattgttttcaagagaagactggtctaggttggacacaaggatggagtctttggcactcaggaaatttccttagagggaattcgcaacacacagagagacaggtaaagaaaatagcaagtttaatacaattataaaaagggtttttctagttataaaaatagtatattaatactatagtaacattaagaaatttagaagaataagaagaaaataggctatatatggtggctcacacccataatctcagcactttgggtggcctaagtgggagaatcattgaggctaggcattcaaaaccagcctggtcaacatagcagcaatctgtctctacaaaagaaaaaaatttaaaaaattagccaggtgtaattagccaggcattatgacatgggcctgtagtcccagctactcatgaagctgaggaagaggattgcttgagcctagtagttcaaggattcagtgagctatgatccgagaagaagaagaggaagaggaggaagaggaagaagaggaagaggaagaagaagaggaggaagaggaggagggggaggacagggaggaggaggaaaatgacgacaacctctattaacattttgcatttaggagtatttatcttatgtctgttttcaatgcctgcatttgtagtctacattgtggaaatcacactaatgatcaatattcaattttttctttttacttatttcataagcattgcccaaattataagattatttgaaagatatacttgtttatggttaaaaatattctctcatatggacatcttatcatagctgttactacattagagaagtattaacatccagttgcctctctgtcttcatttgtttttaacagatgcatgcattttttttctttctgtattatcatgatgatcattgtttttcctcagtttggacaaagagtgcgtcacagaacaaaaactcaaccagcccaacacagggactatgcatgcttacggactcctggaggggagcatcttagtttgtctgatgttttctatttagggacattttagggaaaaataggaggttaaagagctctgtaatcttaataaatatcgtgatgttttaaggaccccacataattattttacagaaaagcacgttgtaactagacagtggtgctctaaagtgagtctttgcctcatttatgagatgtggctttcatatttgtattttcttactgaattatttgtcctttaaaatttgaagagtattccctagatgaattagcatttttccccccttttggcgtttattttcccattctcgttgataagcagactatagggaaagtattaaagtattaggagtttcaaatagctgggatgttagagacatataaggcatcagaaatatcttcagattaaagccatttgattctgaattttgaggaagtgttgaagaaatgtgcctggagaaatcttacttgtgaatcatcaaaatctttagtattttttctcattaggagagctatgtcaccctcaagcagatcgtccatttaattggttataataaaaatgcggcattgattagaagaggcagaccttatcccttactatcagtgtgagagggggatgaaggaacaattattgtcccagccaggggagtgtggtagtaaatgactgttacatcacggccacccaggctgagtggtatacagtacaggggagggaatcaagtcaagatttaccctgtaatgcttttcttggcctcaagcaaactgtttattttttaggacaggttggaacagcttacagctttggagccaaacccaggagggataccagagactagtgccctctatctatttttaggatttagaaaactgacaagttacaaagtagcactcacatgttgtcatgcttagctctcaaaccagctggagttctgaatttattcaacctctacttggacaagatttattttattttgactattcttctagctcccttttcctcttgactctattctttggtggattattatagcttttctccttaaatcttgttttctttaccgtttacatttgtttcattattgtgtgtatgtgtgtgtgtgttgttatttatgggtgaatctaataatggtctaaatgagagacttaatgccatgaaacagaaaataacaggtattggtgaggatgtggaggaactggaaccctcgtgcactgttggcgagcacgtaaacatggtgtagccaccatggaaaatagtttggtggttcatcaaaaattaaaaatagaaaaaaatagaaaatagaattaaatgatctggcgattccacttatgggtatatacccaaaagaattgaaagtagggtcttgaagagatatttgcacactcatattcatggcagcattattgacaataaagtgtggaagtaactcaagtatccatcaatgaatgaatggatatgcaaaatgtgatacagacatataatggaatattattccgttttaaaaaggtaggaaattctgatacatgctataatgtggatgagactagagaacatcatcctaaggaagataagccagtcagaaatagacaaacactgcatgattccacttatatgaagtacctggagtaatcaaattcatagagacaaaatgtaaaatggtggttgccacaggctggagcaatgggggcatggaaagttattgttaatgggtatagggcattagttttacaagatgaaaagagttttggagatggatggtggtgatggctgtacaatataaatgtgcttaataccactgaattgtgcactgaaaaatggttaagagagtaaccattatgttatgtttatattatttatattttacttcaactaaaacattggggaaaaaatgccaccaggggaaagatctcttcccattagtaagttatgcaaatgcagtaggtctaatttctttactaccataggtatatgaaaggatcacagaggagagtttttcagataatgtcaggcatccacctttttattttaatttaattttttttaagtttatggaataaaatttcaaatagtcatctgctcgatgacttaggattaggtatggatgcttgttaaatcagtaaactccaatcagcccttctctatcctgtgagtatctctagtactgtcttgtggaatgaagtgcatgggttttacagcctcagagactcctttcacagattctgggtcatggctgtcttcctaagagatgaggacgatagaagtctggctatgggatctaataaggttttactaatttttttctataaatggaaagcaaggacttaatggtgattacctggacagtatcccttctagaagaggaacagagttttgggtggggcacttcacacacagcatttaggaaattcagtacccatgtcccatgtctgataacaaggcctccacatctaaatctacagggtaaacatggcaactctagagtcagggacagaaatatctctaagcaaccagggagttgaaagaggcttgctttttttctttcttgttacatctatggtattacattttccctgctgttgataaataattcagataagaaaagaatattagagccatgaccttttggaggacaaatacatttgcaattggtccccaaacacccacaggctcttgtgcgaaggtcagtattttgtatttgttagttggcagtatgttctttggggctttgaaatccatgggctttgtttctgtagctagaaggagagtgaggactgcatgtatgaaatgcacagacctaatggtgtcatcttgtcacggtccctaattgggctgctgagcaacaggtaatagactggtgggcattagtgggctgtgcagcttttttcagaagacgagattatctgaggatattttatgacatcatataattgattttcaacctaaatagatgtggactagactaccacactgagtatctggggacatgcatgctgatgtggtggggggagatgtcaggatgcctaatgctggaacttttgcctcttgcaactaggatgtgcatgcacacctaacaatgccacctacccgtttgttcacttctgaaaatcatctctaatatgaggataataataataatgatttaatttatattatctataacaataattaagaaggtagactctggatatagttgtttggattatttatgtttagaagcaatgttattatccacctattaagcaaatcatttgtgtcagcattcaccatgaatgctgaatatttggcaaggaaatgcggtagagaggaaagcatttggtattgggtattagagagactattttaatccagactaacatactacatagcctcaggcaagtcattttaactctttaggcctcagtcatcatctgcagcaggagatttttggattataaatggacttttagaagtaccattaagtgctgacgtctttgaagccaagattcatggcctttcatctcttcatccacagtgcttgctacaatgatatgtacttacttgttccttttttgtttttttgttttgggggagggaggcttaaatatacatctataatcatttggagcattgcaattttgtttgattcataaaactttattgtaagggtcccttttagttttacacttaaaacttttgaacagatgttttaaaagaatgtgtgaacatcattttgacatatttctttggtggtgtttgttttgctgaatattgcatgtaacttttgcatactgactcaggccataatgatgttttattaaccactattgacttgtgacttggaattgtcacacaagtgatcaaagaaccttcctttgcacatcaggagatttctgagggaaaactggagacacaggtacaggatggacagctggtctcccctttgaagttcttgtcatgctgagtttcatacacgcttttgaacacttgttggcaaatatcacccctctggcattgactatgctgtttgtttaaactggtgcccacagagccaaggcagtaacatagaggctcatggtgcaatgataacaggttccagttgtgcctttcctcaaggattagcctgtattttgtgtgtgtgtgtgtgtgtgtgcatgtctgtgtgtgtatttgtatatgcacgcgtgcacacacacagggcaatggggagggtaatgtgggattgtcacgggatccttggggtgttgcctcaccagctggaaacctctgtggctgacggagcctcccgtctaagtattgctcaggcccattgggctcgttccatcctcttggcccagcaggctgtgcttagcttatactactggcttggatcccacatctgtcaagggtgagccaggtacagagcggtgagggatgtgtgagcaagtgagcacacagtccaggcactgcacacagccaggcatgctggctgctttggtggggcaagcagctgctggcacaggtgctagctccgtgtgaggctgcggctggaccagatgtaccacaagtggcttccactgcaggcacctgaacaaggggaatacgttggtgcccaaaagcttggaaatgccaggaaccacagagccccaaagaagatgctacagccctggctcggggagcccctaaatctgggctccctgaagggtcgaagctcttctttccttcttgacatggtgagcagtggggtgggggaggggagtgttagagggggttcagtgcatgtttaaaccctgtttgcgttgctgctctttcagtcctgccatttgatgggtcccaatttcttgtcccgcatccaggatgaatgaagtatgcagaaaactggagggtgagcaaggtgaagaggagctttattgagtgacagaacagctctcaggagacccgaagtaggtagatcctttctgcaggcaggtcatcccaatgagtatctggccctcagtggagaggagacccatagtgcgggtcttagacggaagtgaggatagatggaagatgacctttccacagtcaggtcatcccaacaagtgtccagcttaagagaagacctgtggtgggtagcttctttcctcaggcaggtcatcttgatgaagagacccaaagtgagtagctccttcccacagctagtagtcctgacctctctctttgagtctggctgagtttgaatttttataggctccagaagggaggaagtacatgctgataggtccatggatgggccaagataaagcaccgaaagttttcattccagttggcagaactgacagcccagcccccaggcttcagactgtcctggtttgaaggtgaggcttcaccagggacccaccacttcccacccaggagcctgtctgcctcttgccaccatcaacctgctgtccctggcacccaggctgttcctgctgaggggtgcctgcaggcccccacccagccatcctcagcatccctctggcctccttcccatgctcatcagtgcccaaagtccagaaggggccccaaggtagcatgggactggtgtgtcagtgctgccctgagccctcgctcacctggtcaggatgcaaaagcacccaggtttggcctcaactttgctccaaaatcagagcaggactcgggagcaggggtggtgtggggcagttgttgggggatggggcttggtgggggggtgggggatgggctttgagagcaagcacttccaagccttcaggggtacaggggcttcctaggccctgagagcaaacggaggcccgggttcacaactgtggctgggtggctgcagctgcacctggagggtggggctcctaccccaccaactcagaagtgggcagggcttctgcctgttcccagctcttgcaggctccatggggcacgtagccccagccatgcctcctccactgcagctgatgtctttgcagcaaccactttcagacaggccgcagctgccatcaggatcatgaaaagagtgggaactaaatgccagaagacctgcattcaagtctccgctttgatatggcgagttttatgactttggggaagacactttacatgactattgtcattcttctttggcaaagtgagagtggagacttctgttttagtgcttctgaaagtctatgattctaagtggtgtgaatgaccaaggaggtcagaagaaaggcagcactcaggctaggatgaccaaagaaagcttctttgagttggtatctctggagctgtgaaatagggttttgtccttattgttgttgttgttgggactataaggataggagagtcttcctcagtggaaggacaggaaggagtcaaagcatagaggaagaaagatccaaggcctgtttaggcatcttctctttggtgtgatggcctttagccttcactggggatgagagctcttgaaaggatgacacactcttaaccaaactcgtctatgctcctttggcatctttgctttcaaattcctgattttaacagttctgataatcacttattccacagcaaatattttttaatttactgtgcttcagattctcttttgtgcactgagggtagatggaagagacagaatccctgtcctttgtgcttggttagaacatctgatctatgcagttggcatgggtagaggaagccttttggcacagttttaagtatcatttgagagaggcgtatatgcaacccacagtaatctattaaatagagcgtgctttgaaatgtaaagtccaaatgattgagtattggaggtatgactgaatagcatttcggagccagcagaaccatgtttactagcttaatgcacttgtatgaattacttaactttgctgaagtttaatctctcatttgtataatgtgcataatattagtatttataacatagggtggttttaagtattaaataatcagtgtaaaagaccgaatgcctagcatataataggtgtgcaaaacatgctagagtcactgttactattattataatttctgttatttttgtttttcacttaatgttgaacatggaatcacagtattgcttaaaagtggggaaaagcacgctatcacctttatcattgtgatatttactgctttctcttaaactcacagagttccttggttgttgggaacatgtagatcataagagcaatctatttatagcttttatgacagcatccatttgtggcttccttgcattttaggaaggaaaaaatatatatcctcttaggtatgatgatgattatatttcttaggtatagatagacatgtcctatggatgttaactcatgaagaactcaggcagagaagtgtgtaattgtctggtgcagtacagatacccagaaaactgaggaagatgattcaggaggcgttttgtttatatgaccagatttaccaactaaatggaggatgcaattcatgatgcacttgagcccaactttggaaccaaagagacctgaatttgtgtcttagttctacaactcatgtgacttacagcaagtcactttaacccatctgagcctgtttccttatttgaaaaacaggaatgataacaatagctgctcctttatcatgacataatatgagggatatgtgagctaagaaatataaaatgcttaatggaattatagcatatagaatcagcaactaaaacatataacaacattctatatatctagtaatacctacaacatagtagttgctcaataaatattagatcatttttctctctcatgtaactttatgtattttcatatggttatatagatttgaagtaaaatattaaaaatattcttttgagaatatttatcaatttttggtccctaaacttggtgtttcactttcatatctgaaactgtttctgtattctagcacgtgagcccccaggatttggtctctgccattgtggagtttatattctacatggggaaatagctatttaaaaatacttattatttcagttgttataagtgctgcgaagaaaaccaaaacagggtaaaggattaggaaattattggtgtgatccagagggctaaattacatagggccgtaggggaagatctagtgaggcagtagcctatttgagtgaaaatctgaataaggggatagtatgagccctgaaaagttctgtgagaacatttcattcagagggaataccaaatgctatgttgccaaagaaggactgagcttggtatgtgtgaggaaaagacagaaggcagccatgcctgttgtgaggggggtgggtaatgaggttggagtaataaggggagaccaggtcatgtagggccatgtgggccatggtaaggggtttagatataattatgaatgttttgagaagccattaaaagcttattcaactatagcagtggtaggatagtcactattggtgacatcagtagttcagtaatctatgtatttagtagcatttcctatatttccaatatagaaattgttgaggtagagtaagggtagttgggtattgttgagttcaaagaggtggcacaggaaatgactctgtccataaggtacttaatatttaagtgaggagacaaatctattacaaactgagtcatttgcaaataatttgctacactgtattactatctctaagtgcaaaagaagttaaaagtaggaacagtcccctgtggtttggagcaatttaaaaagactgtcattgttactgttatcatcttcatcatcatcatcatcatttgggttggtgtccacttttttttagagtacaagactattgtaaaaaatggtctgcagtaagcaatttagtcacaagtttaagtggatgttttcttcaccagtcaaatgaaattgtatggatttggaccaaaatacccagtctcaccagtaaagaagagaagagaaggtgagttggctaggcgtatccttaaaggcagtcattctacctgtattaatgtagaccaattactgttatggaatctaactcaatctgattggtatgcccaactcttacagaagagagaaggaggaggcatgtggtaaagaaagcagtggagattttctcttccttcctttaaattcatggtgaattcatcttataagtgaatggaaatactggactggattacatggaagagttagatatttgaaatagagatgtgaatcatcctgatacagataagtaaataaggatgaaaaagtgtttagagaaaagggtatacgaccagtgtcctggaggagaaccccatgtagagacctggaggtggaagaagcagtagtaaaagtggcaataaaattaagagattataaaatggaaataagaggcagaaagagttggtggttggcggtactgctagaggatcatacaggctcaggagggtgaaggcactgaaaattccattgtatttggcaagaagagagtcattggcagtattccaaagaggagaatcattgctgtctctaataacaggatttaaaaagagacattttgatagaaagttggatagcgggtagaatttggagggttttggcagtcaaaggattagaaagaattggagaaaaacctgatgaagacagcaaggtcaagtgaaagatattttgtcctcctcaggccaactgttaggatgaagaatacttgaaggctagatgggaaagcagaataaagatgcttaaggcatcatttcaggcaggcagcatacaggtggaggagctggctttgtggaagaagaggaaacattttcttcttaggctagaaggaagggttaaaaggtccaagccggaagagggggtctattgttaaagttaaatatacttggagagatccatgcctgtgaatgcactggctcgatcttttcattcagtacattttctgtaacataatgtctttctccatctttcagaaaccacgaaaaccagcgctaccctatgtaaatagaaacgtaaggtttctccctggagggacctttgaaatgtagtgtacactttattgctctctcacattctcagcactttgtttggcaaaggtgttttctgagggtggagagaacctgatggcattatttgtgcagctaaatctgggtttgagagctctgcaaaatggcatttaattcttattccctcggtgctcttggggaaatctcataattgctctctcagtctctccatctgcaaaactggtataaaatccctcttttccttcctagggcattgcggggattactaagttaatgttttataaatctctggaaagattctaaatgtgaagttccatcattacccacctactagatatgatgacactcataatgatatatttattacctcatgttcatttccacagcaatagcctgtgcatttgtagagatatgctttctgtgccagggcacaaactgagacaaaccatctatcactcagagacacgtcaacaagaaaataaaaagtgaacacatggtttgttttgacctaaatattgttttgggtgcagagcctgttgtgaatttttctcctgaaaacaaagtctgccccctaccttgctggaaaaatatttaaaaggagacctgaaggcttcttgggtcatgctgggtttgagatgtcaataaacaaagtatgaaatccaactgtgaataggtgtgatttatcagtgacagcaatttaaaaacatttttaatttttaaaattaaagttattttaatcaaataacttgattgttcaaataacaatcaagtcaggaatctctgaattttaattaggaagaatgatagtttctgtttgaaaccgtgactcatggaggggtccttcctctttgtgaagtgttagtgtaaggaatttctgtttgtctgctcttgtgccaaagctctggattacaatggatctagcatccagctcgtcatagtccataaaatatctgactctattttagttaattcaactaatgaagatggagtttgtcatgcaatgtcctcattggagtagttttgtaagaataatacaagtggaacgtattgagggctcatgcttctaacaaaagtttggtgtgtaataacctctaggtaatgcagagatggcttgtgaagaatcaaagagagcaggtccatcttacttctgccacccaaaataccatcttaaagtagggaagaggaccttctttggaaagtaagagtgtggtctttttcttttcctgcccattttctcacttgcctttgctgttttctaaatgtgctgccatgactggtgaagcctaaaatagtaccatcaattcagtctctagttatccatcctaactcagggacacttgcttttcccggtgcctggaaagcacttcccctcacatctgcatagctggctcccttacttccttcaggcctctggcaaaggtctccatttcagtggagcttccctggccatctttccaaatgttcagtccctactgtcacttgctttctcctctctctgttagttttcccttcttacaacttatcactatccaccacattacatactttactcatttaccttaatcatgatctgtctcttccactagaaaatttgtaagctctgtgagggcatgaatgtttgttgcttttcttcaatccatatcctagacactagaatggtgcctggtacatggtaggcacttgataaacatttgttcacattgtaggtgatcagtaaatatgaccagcaaatattcaatgtcctgggtactgtggtagatgctaaagatatattcagttgcaagtaaccaaaaatccagctcaaaataaacaataaggaagctttgttggcccatgtgcacataagtctggaggtcaggcagtttggggactgggttggcacagcaacacaaggatgtcatcaaggacctgagacctttcctttgttcccatttttttcctatgattcagctttatgctaagcctcctgggatctctctgtggatttgagatgagtgtcaagaacaacattatctttcatatctggggaaacagataatgatctctgagaaactctatcagaagtgctagaaagctcctttttcaggagctccccagcttgtatactcacttctgaactaaacaccgtgactggcagatacactgattcgctgaagcttaatcacatgctccatcccaagagcctgggttggacttgaaatatctcaaagcacctgggctatgtgtgtgggcaccctaatgaaaatcaggatatttataaaatgaaaaccaaatggataacagggagagaacaacaaaactcttttaaaccagtaagatcacatgttgtacaaagcctaatacctaccgagggaaattaattatgtatattacaatcatgtgctgtgtgctataggatgggaatacaaatgtgagagtttaatgagatcacatatgtaattgtattggaactgttagatgcactggagtttaataactgcttttaaaattgctcttattattacttcagtacacagaagctttggaagagtattctgaaggtcatctctcttgaccatcactagctttggatgaggctttggtcacagttctgaaagtctgcaatgaattaactctaaggcaatttgttttatcttctaaggtctgacatggtaaaatttatccaattatatattttttgtttaggtcatatcataaaaaagagaaatgggaattaaaattgtttagattctgatttttaatatattgctagctctttatagaaaacctttcttcaattggaggttttaaagttaggaaattaatcgtcatctagctgtcatccttattttaatgaataataaacaggcccatggggttaacttgctccaaggttatgaagttagtgacagtactgggaattaaaccctgatcatcagactctggttgagtttttttccaaattatgtgtcagaattatcttggttattgacattgtggaaaatacctgaatgattatttttatagaccctgcaaagtagtctgcctgtgtcccagtatagcaagaaatgaagtgctctggaagatttagtttttacagatgaaaaatggtcaattttatggttttgagaaattagagactcaattttattccagcttgtacccatatgcacatccattgcacacataatgtatttgcagaaagaaatcttgcttgattaaactaagtgatcttgacaatcaaatttgagatctcaagtgcaaaagaaatagaatattaaaagaaagaatctcactggaaaacttttagtctttgatattcagttaattgttccttcaggacacaatctgaagcaagccaccttccctcagctctgtaggttttctctaagcatctagagctggaagatttctttggcaatcacatacaatgaattggcgtttcctatttgttttttatccttctgtttcactgtgtgatcttgggtgagccagttaacctctgtgtgcctcacataataaaaaccagttcctccctaccctagtagtcccatctctactagagatgtggtcaagataaattatgcttcagtggattttaagtaagaaatctgaagataaattgatggtagtatatgagccttataaatccaagaggaatgataaaaggaggtgattaaggaaacagcagtagcttaaagcacagggcaaacttcaagcacttaggaacgcagagaacagtggtattaccattgtataccctcctcctctatcctttttatttatttatttatttatttatttatttatttatttatttgaggtggagttttgctcctgtcgcccaggctggattgcaatggcatgatctcggctcactgcaacctccacctcctgggttcaagcaattctccttcctaagcctccggagtagctgggattacaggtgcctgccaccatgctcagctaattttggtatttttagtacagatggtgttttgccatgttggccaggctggtctcgaactcctgacctcaggtgatccatctgcttcggcctcccaaagtgctgggattataggcatgagccaccacacctggcctctcctttttatttctgtatctctctcctatcaatcttgagtaaagtcatgactcaaaagtcatatgctctgaaaccaaatttcagacctgtctcttccatccctataaaattctaccagctgggggcgtctgctgatcaacagaaatttcctgttaggatgagcctttctgctcctctcaagaaacatgccttggtggtaatgaactatccacagcattatcctgggatggcaggcactgtggactggtccattcaatactgattccagtgcctgcaggcatgccttcctgttgttctacagagtctgggatgactagatccacatttctcaaattcccttgctatctgggtcccaagtatgacttagggtcttctaaatagataaattgttggtagctttgacaaggaactgagttatatataaaaataggatgggacagaggtttccattttgcgggcttaaatcacggcagaggcatggtgtcagcttcctgctttatttgcaggccttgtgacttgacaccttccagatcatggccgaggtagtgtggttctgaagtaatagaagctttgtgattctacagcctcctgatggtggcagaagctgagttttccttgttatcccaattctgtggtgtggtttgggggattgttcctgaaagttcaccctggagtctctttgtcatccttcctctgttgcctccgtcttctcatctgcaaaaggacacaatgatcaaagcccagcagccatcttgaatcatgagataactaaaaggatcactattttgtgttgctgaacctaatcctaatggatacataggccctatgaaacagacgcacggtatggcacaattaagactatttctaggcaggtggcaactgagtgtagctcctccttctatgtcccaacttatatgtaagtaaaatgaagtagaaatatatgctgatgaacaaatattctcaaaagggcaacccaagtgggatgtagggagaagtgcatctgggtaaggatttaaggagtgactgtatgcacgtgagtctccaggccaaactcccattttacacctttactagttgcctttttgtgtttgtgtttaccatgaaaggcaagaggcaaagactactttgctgtaactcactggaattcatgaacagttttggctaaactgtgtgcagcaggatgaactttttattatcataatagcttgcaggagaattcttcttaggaatttttgcttgggacaataataagccaaatgaatgaaattgagagaatcaaggtatagttagagtactctgtcatagaaataaataggagtttgtaggtgatggagaaggaggaaagaaaggggaaaggagagggtagtcaaggagatgatgtgaagctcgggcattatatggggtgaaatagctagcgaaaagtccttggtggagtagccaaaggacttgtaggaacaaggatgtcccatgttcaatttgttaagttggcatagtggggctgtaaggccctcttcttcaaacataaatatatcacttcattaaacagtagaactatccattggctgaatgaattcattcaaattatatacctgagccctaactcactggaatttatgtaaatcttacatggggcattgggtttctatggttgtgcagtagtaagtcaggaaatctcatggtgaccattggttatttttctttccaagaagctccctgtagacagattctccattataaagtcccggcaagatgaatacccatcaatgtttcaacttagagcagaagatgagacttgaaagataaaagacctgctttattaaccaggtaaaagaagtctgtgtcaagactaatgtaagaacaaggagctgggagatggaccatggggccaccagtaacaggaggtgaaggaagggaagcaaaaatgaggaacagaaccagaaaaacaggaatgggttaagtataaagtctgatttggaaggaaaaacacacataacatcccaaaatgatacctaaaaacaagtgagaaaaggaacgatggtggagcattagtttctggagagtttctggggagaaggtgttagtttagaaaatggggactgtgtaagggaaacagcaagtcaagtgcattgcaatgttattgtctgcaggaagcctcaggtgggccaagtgatgggctgaggggatgatgctatggaacaccttaggacaagctcctgctgagtggaagttagaagtaaaccactgtttttcttacacatttgtatctaaggacagttgcattctgattgagtcaactaatttgaggtatgtgaaatatgcatgcatgtttacatccctgcatctgtttttgtgttggaggctaaacctggatgaataagctcttacaaaacaatgcatataaagctttaggttttcaaatttgtccgtaatagagagagagaggaagagacaggagataaaggttttgttagcaggagcaccctatcttttatgtggcagtttttcctttctactctgtcactggggccttatccccagggaaatgttcctaggaatgaagacaagtagatatttttgcactagagtctgctgcttttagcgtgactgtctcaagagcgtgataggaaatgaaggtagtagttactgcaggtagaagacactgaataacaggcatgaatagaatgctaagcatgaacagtagtttgagtggcagggtatgctgtaattggagatccagggagagaaaggctgacagactctgaaacccagagatgaggtagggtttcccatgacaaggaagttctaaaatgctgtttcatggtgctctttatctcaggctctggaatcaggcagatctgatgggaatcatcacatattggcatgtaccttggggcaaatcattttaacctctttgcacctcagtttcctcagtcacaaaacttaaaaataacaatactaccacatagggttgttgtgatgattaaatgagttggcacatgtaaagcgcttggaaaaatgccaggtacatagtcagtgctatatagctatatgtgttgtttattattattactactattatcatttcttgtgtgccaagcacacaaggcagtgtttcgtatagaatatctaatttaattgtcataacaattcagtgagtaggtattattattcccattttacaaatggagaaattaagacttaggttaaataatttatccaacttataagtggtagaattggtttataaacctagacaggccacatctagagccccagttcttagcaatgtaaactgattaggtacctgacatttgctaatggcttggcaaataatagctactattataatcatttaaaatggaattggtatgtggtagaaggaaagagctgattcaaataattgagatagaaagatgtgggttggtattgtttaaattaaccagatatcagatgtagaaaggaaataccacaattaacctttggatttaggatacatagactgatggtgctgctgctgctatctcttgattatccaattgtatgatttacaatgaaagagtcaaataagcttgatctcttccacatgtcttagacatttttagtaagacatgcccaagaaaaagatgactgggttctgggggcccgtccttaacctttatagtgaaacctgccctctgttaacttagtcctcagaagcaaagtcagtatcagggtcgtgggccagaagtaccaggagtagcacgtgtgttaatttttgtattccaacattaaatgtcaagggtgaaggaattttctttcacaacctcaggggtctacttctgtttcttctctacttcttttatgtctttccctcattctatcttcagggtttagcccagggcctagaacaaagtaggtttgcaagacgtattggttgagagactgtgtgccctcagactgaatctgcttctgcctcccttggacaatataagtgaaggaagctatttcatgcctgtaagtttcatcctactcgttggtaaaatggtgataataatatttatcatcaaaggctgttgtgaggattaaattatgtaatgtgtataaaatcttctgtgtagtgtctggtgcacagaaagcactagtatcagtgccattctctgctctaccaatcagaatctgacagaagaaaaaaaacattttattcctgaatagttaaaaaaaaaaatgaccaatgataaagggccacttacagaggcataagtgggattaaggatataaaaaagaaggatgagataaacagtgctaatttcatcaggaagcctttcccatctttaggtctgaaaggatgaggggaagaaatagtggtgccagaggccagagagagccggggtcatggagctgaggaggcttggtgagagctgtcattatagtcgcctttatcacctcatagctgtggtcgtaagagtgacaccaaactaggagggaagaaactgggaagaattactcctacttctctctcctcctgccctttatctggaagccagccaacagggccctccagggatacagtgcaggacagaaaaggtagagtatagctatgagagtgaggtgggtggatggcaaataaatggagaaccaccagttcccataaccaaacagtaaacagaacgggaagaaaatgcaactcacttttatcatctagatgagtatcactttggccgggtgcggtgactcatgcctgtaatcccagcacttttgcaggccaaggtgggggggatcatctgaggtcaggagttcgagaccagcctgaccaatatagtgaaaccctgtctctgctaaaaatacaaaaattagctgtgtgcggtggcgtgtgactgtagtcccagccacttgggaggctgagacaggagaattgcttgaacccaggaggcagaggttgcagtgagccaagattgcaccactgcgctccagcgtgggtgacagagccagactccttctcaaaagaagagtaaagtatcacttctcacatcatggcactgagagattccgatgcattaggcttctaaaagtggtactgaagaaatttccttagaaccccttttagtgagagtgatagtagttccgtgggggatttaatagctgttatttgaaaaacagttctcatgcttaaattaatggggaaatgaggagctgaacaaaattaaacagatttatttgctgagagttttctcagagcctttgctagctaaggaacattttgaatctctctgtgggagatgtaatgtgccgcattccccaaatttgttttcttggagaattttacgaataaatacttctgggaatatactgaaggaattgtgtttaggggttatagcataggagaaatacacagctatcttagctctgcttcgaagacacaagctggggcccagatttcctgagccagaaccctctgctgtcataagtggctctgcatttagtggtaaatacctttgtatgagatataggctgggcatggtggctcccgcctgtaatcccagcattttgggaggccgaggtgggtggatcacctgaggtcaggagttcgagaccagcctgaccaatatggagaaaacccatccatctctactaaaaatacaaaattagccgggtgtggtggtgcatgcctgtaatcccagctactcaggaggctgaggcaggagaattgcttgaacccgggaggtggaggttgtggtgagctgagatggcaccattgcaccccagcctgggcaacaagagtgaaactccgtctcaaaaaaaaaaaaaaaaaaaaaaaaaaaaagaaaagaaaagatatctttttattttttagatatcttagaaaagtagttgctttggattagtttggcattagcagaggtaccctaatggaaagttaagctacgcaggcaatagtcttcaagttaaggcctctactgacaaggatttatccctcttgggcctccctggggcaggccagctatgttagcattcctagtaccgtttgacgagtatcttaagtgtgtgtgccacagaggaatacagaaagagcttgacagcatctctgttgtcaaagaacctgaaatactgttgtaaagggataaagatatgaacacataaaccattcagaaaaaataattccagatagctcttgatcaaatgccaaaacccattatagaaccaaggcatattcaatatttggttgtggttgtgcatatgaatgaagaaggcttctcagaaattgcacaacctcacctggccctgcagtgattttaatagatcatgagaggtcgccggggggagggtggatactgggagagactggtatttcagtcagaagaatgggaatagcagggttttatcaggaaaagcatgtgttccttcaggtgatagattcatggaaggaaaggacgagactgatggttttatttttgaagtcaagctgcctctgcttttggtggatatcacttaacagggtttatgagccttacttcaatcagttccttgagttgctgatgaacagcgtgggatcaacttctccctgtgggctattagtgtacttttcacccactgaaagttaattagaggaaacaacccccctgcacacctttcacactgattcatctgtaaggagccagtaaattggattggggaccagggagaattttacttgagatattttctttctgccgagaaattgccaaaatagaagaccttgagtttctgagttgtagcagaaaggttttctttttaaaatttgtatgcatgataggcccagtgataacataattcgttatattacattaccttaggggccacattgtggtcctggaacataaattctgcatatggaaaactaagggctcattgatactttgtttatctattgggttttgctagggttttttcttccctactctgtctctttctaacatcactcacagcctgcagaaaagagtatcagggaaaattataggttttttgttgcagttctggtctttaactttagttttatttatgaagggagaccgcaaaatataaccatattattgttaaaagcccaggctttgccatcccatggatgtgagtttgactctgctctgttgatggcctggctgctgaggagtcttaaatctatatcttagtattagatacatcccctctaactgtatcatgtaggtttataagtcctttattggatttcctaaaatctgaaggaatggtgtattagtctgggctcatgctgctaataaagacatacccaagactgggttatttataaaggaaagatgtttaattggctcacagttccatgtggctggggaggcctcacaatcatggtggaaggcaaaggaggagcaaagtcacattttacatggtagcaggcaagagagtgcttgtgaagggaaactcccatttatgaaaccatcagatgtcgtgagacttattcactaccatggaagagtatgggggaatcccctcccctgccccacatgattcatttatctccacctgaccccaccgttgacacatggggattattgtaattcaaggtgagatttggatggggacacagccaaaccatatcaaacagtcttcatttgttttttcatgtagtcaaacatttactgaatacgtgctgtataccaggtgctgtcactggcccaataggcgtaaataaatgggatgcacagaatttccgttctcatggagcttatattctaggtagtgaaaagagaaagtaaacaggttttcttgtttactgcacgtatggcaatttcaggtaggaataataaccataataatttaaaaagtaccagtgaatgacaaacactatgacggaaacaaaacagagtgaagctgtaaataactagggttagggagggaccatattagattagttgattagggaaggctctttgaaggcggtggcttttgagttgatatctggagaactggaaagaaacagccgtgcaaaaaccgaggaggagagtatttcaagcagagggaacaacaattgcaaaagtcctgtggcagtgggaatgagtttcactggagcatagtgaggcctaatggtggatgcttaggctacagagatgtcacaggagttccttgaactgaaaggaggaaagcttgtggtcagcacatgtgggtctgcacagtcaagatctggtcttgccttgctttcttctatctatggttgcacagttgtaaagcatccaccgtatattactcaaagtgctgctaagaaaagggcttcacagactggcaggggggcagaggggcttcaggctctgacctgttgactgtaatggattccttgtttgcttcagttttatggctttagctgtgcttggaggccaccatgcagagtgtcccttggccaagttctcattaatcctcttcaattgctaagagccataagaagggcatgagggactggtaatgtgaaggcagtgggggtgggtgagccctgactgttacttttgccgcactggttggttaatgccgttcatggcctgggcaataggacactgagataaaagtatgcctggaaagcagatggcattgttctcaatcttgtctgtacatttgaatcatctggggtgggcaattttttaattgctgagggacagcacactactctttcacccaaatattctaatttaatttgtctggagtgagacccagaattaggtattgtattagttcattctcacactgctataaagaactacctgatactgggtaatttatgaagaaaggaggtttaatcaactcacatttccacaggctgtacaggaagcatggtgggggagtcctcaggagacttataatcatggtggaagggcaaaggggaaataagcaccttcttcacatggtgaagctggagagagagagggcaaaggaggaagtgctacccacttttaaacaaccagatctcatgagaactcactcactatcatgaaatcagcaaggggaaatccacccctgtgatccagtcacctcccaaaaggccccttcttcaagactgaagatcataatttgatgtgagatttgggtagggacacagtgccaaaccatatcaggtatttttcccagagcacccaggttgaataccctgtggcctagctgtgtagctaggctctgtttcactggtctagaggaacatacattgctgcttcatttgttgtttgtttattttccctacatcatttctgcatgtctttggtttgaaaaccaggatcctttaccaaattacaaagacttacccttcataaagcagcatgaaggtggcatcccagggacttctgatcgcaacttacaaataggtgtgtgcatgtatgtatggagtgtgtgtggtatgaatgatgtgtgtatttgtgtgtgcatgctgcgtgttgatggtgcgcgtggtgacgtgtgtaaatttgaagtgtatcttgtggagtacttcagccattcatcctatgtaatgaccttggttaaattacttctcttctgtgagcctcagtttccacatctgaaatttggaatgccattagtgtttctgcctcatgtgtttgctttaaagattaaatgggataatgcatataaaatatcttagcacagttcctagcatagagtaagctctcaataaaagttattggttaaagatgaaatcttgatgaatttgcttaacctttctaagctgtgctttctgtatcagttgatttagaattaccattactattactaatgcacaatgttttggcaaaagtcaaatgaatagccccaagcattcactccatgttgaagtattacacaaagtaagatatgtctggaggtatcactttattgaaacatctatctccatccatttggcctgtctgatttctttgttccaaacagaggtcttttgcctcttcaaatcttgactgtaacactggctgacaatatagaggtaagtatggacactaatcctccctgaaggtgaagtactagatttaatagtcctggaatatcagagtgtttaggctactcctgaaggacatggacaaatcaacttctaatgtcctgctataccatgtcacagttcggtatgttttccagcaatggaatgcagggggtggaggggctgatggctttttgtttgtgcaaagcatttgttgtccaacaatggtagcatcagtgtgattgagtgtgaaaagtgtgtacttttaatctatttcctgatcccaattctctcctcgccaccttcatgtctgccaacctttcccagcgtagtattttgacaggtgatatgtttttgcttgacattgattaaagttccacctccattgcttaaaatgaggtgcatactaaatgttgaaccagcaaagacagcttcaattttgaccaaaagacatcatttcaagtatgtttttgaaaaattcagtctgcatttgttttcttgtcaaaaaggttttgcgggtattggggattgggcggaaggaaagggcaaagctgaggcctataataatgttgaccttgatgaatcctgataatacagcagactgttagatgtcaagttattagcattttcattttatcatactcagctcttgtctctgcaattgacaattgtagagatggtctttaaaatgagaattccctcatatgagtttctttttaattaaacaaaaatatacatatagaaaattatggattttttttctttctaagaatgaccatgaaaatgaaatatttcaggatggagatacttcatctttgtattcttttcttttgagctatttccagaggctttttcctaattatatcctgaatgatttcagaaatttgatctcaactgttttcctgtttttctgcatttacattgactttctcacagaagagtctgattttattctagatttgttttctataattttcatttacatcacctcttagcacctaagaataaccttttaaaattattcttctggaattcataagatgtttccttcctgtttatgcagatggcatatagctggttgggtctttttatgtccctcttaacgttcttagagtagatggattttagtctaggcatttaaaatgcaattgtgttttcatcaggcattttataaatcataaaattgctagtgtgttaaatagacatttttgatttaaccagatggaccattcattaagcctatctgaggtgggcagacaggctttcagaaatgagaagctcagtttggggccttgtgtctgagttagtggtgtgtatgtgcgtgcatgtgtgagtgtgtatttgtgtatgtgagatgacatcagtgtggctgggagtaaactaagatttcttttatgggggcgtgtagaacagagttgtaagaaaaatcatttatttcattaaataaattatttattaagcacttgctgtgtaacaggcactgtactaggcactggggatgcagcatgaataaagcagacacagaatgtttgccgtgatggagctcatcatcaagagggcgttggggaaatggaactaagggaaaggaagggcacttatagttcccagtactctgctaaataatttaatacattatatctctttatttatcacacttactatcactcttggccttttggctaagatcaagtgtatttatcacacttataagaagtcagtgaggtagatgttattctccttttaccagtgagggaaattgaagctcagaggttaatgtcagttaccaaagattatacactaataagaaggatatctaggattgtctgacttccaagtcatgccctttctaccacactgtgctagttatttctctttagaagtggagaacgtgttcttacccatgaggaatcctattcccaacccctggagacagccattgattaattgaggtttttaaaatccactaaaattaagaaccatacactgggcagcgttaaagagcccatgtgtggcaaaaactcatgttttatttctctcttcccatttaatggacaagatgaaaagagatgtgaaaatgggattagactacccaagaaacaggcctggtggctctgtggcttgtgctgaaaggtttgattgagctgagaccagttatggataaaatgttgatgttttgtgaagtttgtataatgaattgctacctctcttaatggtggcagtgggatagattattttcaagaccccatttatagatctactgaaatatatgatgatcaaaagtaaatacacacatctcagagaatattttcttaccctggaggatggtgatattaaatctgggctgaaaaatgattggtctgggacttgacatggcaggggaaatctatatatgcaactatctctgaaaagcaaaactgaactgtgaaatccaattccattcaatccattaaacatttattaattgattattatctgccagactttatgctaagttatgagactccagagatgaataaaccacagtctttttcccttaaggagcagaagtccaatgggtgatgtatacatgttaaattatagattctcttttaaggtgataaggacaaaaatataaaaatagacaagtttcttaaatagtcatgaaggaggagagattaatgtagaaaggaagaaggaacaaagcaagccttcctggaaggaggagatattaagctggattatgtaggatgacagcaaataaaccaggcaatcatgagatgggtatcccaagcagtgaaaatggaatttatcatgtgggcctttaaaaattaatttgggaaaaatatgtagaattctatgttgttagtacacaaaatgtgaaagaaggacgtgatgagcatagataatacgagttaacataggccatggcataaacaagcttgtattgtgtggtatacaatttataggactgggttgtaagcaagttggtctagggttttttgtgggtgaggttaggcgcagaaaactcacatgaaaggtgaatgcattacttctggtaagagacagtggtctgaagacagtgaagaaagagagggtagatttgatataaggtagaggatgcagttcctagagattgttggatttgggagcatatgtgtgaaaatcatcagaaaatcattttcaggctttgactcagggggctgggtggatgatggtattactaaccaagaggtttctaagcaaaggagaatctggtcatgggagtggtacaagtcatttgttcagtttggacagattgggtccaaactttagaaaccctaatggaaatgtctaaggattgggtaaatggatgtgtctgaaactctgaggcactgagtgtagagatgtatatttggatgttgtgaagataagagtgtcaattataaatttggaaatatatgaatttacctttgaagagaagagagaatagaactctaggtaaatcagtgtttaaggaaaagtatgtagccaaggaaactgagaagtagttaagaggtaggaaaaacaacagaaacattattttcttgaaatgaaggagacaagttttcagagacagggagagaacagaactgagagatcaagtaacagtgttgtaaaaccccccttggtttggtatttaggagtgcattgtgacccttgccaagaaaatgctggggagaggggacagaagtcagagggctttatattaaatggtgaatgagtgattaggaagtgaagatagcaagtgtaagtcaatttttcaaaatgcttgggtggaaggaaatgaggtaatagatggtagcaagggaaggatatggagttggggagagggaggagaggttgtgactgattggaaagggagagacttgagaatacctttaggtgaagacaagattttattaacagcgcagaggctgaagaccaaggaaagacttgaatagcatatagattacttagcccacatggcgagcacaggtcttgaataaaacaggactttttcaccctaggagtcataatgaagtaggagatgatgggtatcccaatgagatggaagtttgtagttgggacagggggcaggatgctgatggtgtttatgctactagccacttattaatgggtcccagtggaacctgagggcatctgttaaaaatgaaggaggatgaagatttaaagagagtgaacatgtgactgaagctgcagaaaacacagcatcctagaaggaaggaaatttttttttaaagattaatttgaagttttgaagatccagatggaattggaaatcatacgttttaagcaaaaccagtctgcctgaggaaatgattttgctccagcagggcacagttgcctctgccagagtagagaaggttaacaacagaactgggctttggctgggcaaagggaggtgtgtcggttagggagacaagagtttaagtgatggacagtggagctcatctaggctaaatagtcagaaacaaggaaaaaggagatgagagaggagtctgtagtttgaagagcaggtgtagtttgagtaagggaggtagacacctggaaggggagaaaattgtagtcagggaccagggtactggattgaagattcctgatgtggattacttcaaagagatggcagtacccagcaggtgattatgagaggatgacactgaagcagaaagaaggtgaagattgttatttttgtcgaggtcaaaactttgaaagtacattagtcagcaggtcattcatagggacattgaaatcgtttagtataatgctgagacttaagggtaaaatcattagagcagctattaatatataccaaattaggccagatgcggtggctcatgcctgtaaccccagcactttgagaggctgaggcaagtggatcacttgaggcaaggagtttgagactagcctggacaacatggtggaaccccgcctctactaaaaatacaaaaaaaaaaaaaattagccagatgtggtggcaggcacctgtaatctcagctacttgggaggctgaggcatgagaatcgctgtaacccaggaggcggaggctgcagtgagctgagattgtgccactgcaattttagcctgggcaacagagcgagagtctgactcaaaaatatgtgtatatatatacacgtacatatatatgaatgtgtatgtatatatatatatgtgtgtgtgtgtgtgtgtgtgtacatatatatatacacacaccaaattaaagaaatgaaacatccccatgtatttttaaatatttgccttagaatgatattatgcttgtccttgctgactcactcaatctgattatctctacagtatttcattttcttcctcacataaatagaacatgtagtattagatatatttatttgtaatggaaaattatacaagcatattacaacaagcattgtgtatgaaagcaagtattcaatatttgttgaatgaattaaaatgtgtaccatcagcttctatgcatttttgagaattacaccctgatgattgacatagtacacgcacttatctttataattcttggtatagcagttcttgctgagccatgagaaagcaaattgtctctgcctcaaatgaaaactgcagtcttaaattgattatatatgttagttgttcaattttgaattcctatttctggcatctcttcaataatattttttcttctttgagaagcaatatgacatagtagtttagaacataaactctggagtcaggctgccagggtatagatcttccatgcaacatcttgcctttggtgattagtttaacctctctatgcctcagttttcttatctgtaaaatgagtataacactagtctaaccatacagcatagttgtaaagattgcatatagcttatatgagttgtataatggttaatattaagtatcagcttcattggattgaaggatgcaaagtattgttcctgagtgtgtctgtgagggtgtttccaaaggaaattagcatttgagtcagtggactgggagatgcagacccatcttcagtctgggtgggcaccatctaatcatctgccagtgtggctaggataaaagcaggcagaggaacgtggaaggactagactcgctaagtcttctggcctccaactttctcccacactagatgcttccagcccttgaacatcagacttctagttcttcagccttggactcttggacttccactattgtttagccagggcctcttgggcctttggccagagactgaaggcttcacttccctacttttgagattttggggctcggactggcttccttgctcctcagcttgcagacggtctgttgtgggacttcgctttgtgatcatgtgagtcaatactcctcaataaactccctttcatatatacctctatcctattagtcctgtctctctagagaaccgtaatacaagttgtgaggcttaaatgagaggattaatttcgtacttaaaatggtaccttgctattgtatatgacagtgttatctattattgttttccaattttactttacataaatacataatcatttgaatgttagatgtgatctttccacttttacattctatatctttaccctttgattcttcatcttaccttgtgaagtcttagagtctccaacttgggaacacatcctactgtagcatagtttttgtctgtatttgggaaataatttttcagccttcatatcatatctacatttcattcaaaatttctctaagtatggacttcctttaagtaggactgagtgggcaagcagttttattttgttcagctgcctttattaaattcatatttggttatttattatagagtaataaaatcttacctttctgttattttttttctcttttcaagaagcttagttttttatatattatctcctttgttttctgaattcagacatattgtaggagtatttttgaggaattgagaggttgtttgacttgtctaaggtcacataatgattggcctgtttttctgctatttaatatagcatgcataatgctgccgatctgcttttgatctcgtgtttcagttctaatgactttcttattattgagaccaagatcctaactcaatcttagctctgttgggtccttgcttctctgccagagtgtccatatcgataacttatcaattattccatgttctctagaactgaactccagcctttttctaaccagtcaatcataggacttagatcttagacttggacctaggtcttggatccgtgagcttgttgaccagattctgtgaagctgcctacttggatctttaaatcatacatcctcctcagttctccagtggggttagcttaatatgcctgatcatgataaatttaagcagaaaatagaagtattggaggatattgatataggtatgataggaggtatgcaacaaggaaataaatgcacatctaagatcctgccttaggaatgatcttattaggatgctgctgctgcacttgaatacttgccactgtgcatctgattttgccaactctgggaaatcagcatctgtcaccaaagttgcaaatacaaatgtctattgcagcggataatgtctgattgaccaatgccttcataccacttcccaagagctaaagatcctggcagaaggcatctgattttgtgtgctgaagtcacatatccatgttctagctatctgggtgtagggagaggaaatatttgttctctttggaatctacactgcaaagtggggctatactgctaacaaatcttgagataaatgtcaaaaagtgagaatgtgtagtggctgaccggttgaaacacaaaagtcaaacacaccacccactatctgttctccccttgcttgtaatagggtccatatccctcttagctgagccacctactatgttcagttttaggattcagaccttcttcatctgttctatttagctgtgaccaactctcaggaccagatgtgtcccaagacctaacaaccagaatgtccgttcgtgattcttaaaggttttaacagtttccccaggcgcctcttgtcccaatagctaatctgcatgtaactcaaagagcaaccacatttcttttctgtttttagagaaaaccacatttggattttattaaggataagcacatttatctactcaaagaatacaaagagagcatatgtaggtctgcctctgtgcctttgtaaaattgaggacaagtgaaagcttcagggggtaatttaaagtatcaaaaactgcagcgttgtgccatgtgggaaacaccgaggtgtcctcctctgggaactattttctattcatcatttgaagacatttttcttagctaatatttttttttagaacctgtcaaaatgcctgggtattgtttgaaatgtctactatttgtaaagataccatccgacatggtgttctctaggttaattattcagaatagaaaggagtttttattttaaatccctgttcagtgtggggtatgttttaatttcattgtgtgcccttttgttcctgcataatagtaaaaaggagacaagattttcctagctatgttagactctggaatccattagcattttgtatttttctgatattctacaactggcgcttatatctgcatgtgtgtaatcataacatttgaaatttccttttgtttaaaggaaacaaatggagctttcataaaaaataatttatttttgaatattttagcaagttttgagcaatggatattctatttcaaggcaaaagaacctaggctaataatgtgtttcatggaaacaaaggaaacttatacattactatttccacagtattcgttacctaattcacattctgttttagctcagctacaaatggtaaggtcacctttttttactccctgcatgtaatactgcaatctctttaagatataggtctttttagtcctaacattctgattttaaataacttacttaatttaaacatgtagagttcttatggacttgttaccttaactatggttttaacctcttgctagcctttatacacacacacacacacacacacacacacacacacacacacacatttattagtattagtaacattttaaaaattcatttagaaatatttaagataaactaaaaagtatcaggaacaataccacgaagagctcatctcaaagcaccttccactctgctttctgaccctctgtgatcaaagaatctcttcccttgcatctgggctattatttatttcttttggtcatcatttctctgtcatttagaactgccatcatcagctgggcatggtggctcatgtccataataccagcaccttgggaggctgagacaggcagatcatttgaggccaggagttcaagactagcctggccaacatagcaaaacctgtctctactaaaaatacaaaacttagctgggtgtagtggcgcacgccggtaatcccagctactcgggaggctgagtcaggagaactgcttgagcctgggaggaggaggtttcagtgagccgagatcatgccactgcattccagcctgggtgacagaatgagattctgtctcaaaaaataaataaaaaaatagaactgctgccatctcttctttcctctgtcccatcaggttctgtaagacaggactgaccaaatataattatatgtgtgtgtataatttaaaaattttattaaccaaattttttaaagtaagaaaaggtaaaattaattttaatagtacattttatttaatctactatatcctaaatatcatttcaactttttattaatatagaattattgagatattatataattttttcaccaagtctgaaagctggtatgtattttatacttatagcacatcttaaatttggattaaccccatttcacatgactaatttcacatgtggctaatggctgccatattggatagtacagtaaaagttccctctccaatcttttctctgggaacataatcttttttttttttttttttttttttgagacagagtcttgctctgttgcccaggctggagtgcagtggtgcaatctcagctcacttcaccctccacctcccaggttcaagtgattttcctgcctcagcctcctgagtagctagaactataggcatgagccaccaggcccagctaagttttgtatgtttagtagagacgggatttcaccatgttgaccaggatggtctcaatcccctgacctcatgatctgccctccttggcctctcaaagtgctgggattacaggcgtgagccactgcgcccggcctgggaacataatctttatgttgacatttaactcagcatttttctttgttttgttgttgtttgactttactgtaatgtaagttgggtggagagaggatgcagctaagtggagcaaggattgggattgagtgcctctcagtataagtgggagaaacaagaggtcaggaaatctactgtattagttaactagattaacgtatttgaagatacatccctgcaaaatggattttactggtcagtttgtttgtcttagagtggtatagtgtatgtgttcatttatcttgttccagatatgaccaggttttaagattctgaatagttcctatgtcatagaagaaaaggatgaagctatgcccccaagaatgcatagggcttggaattagtttctaaatgaaattggtagagtgtgaccttcaagatcttcaacctgttagatattactcacagaattattggcggtgatggggctgggtggtgtctcatacagagaataaacagagccggagactgtttatgtatttgccaccttttgcatactatggacaacaatcactagtttatgaatttgttcggtatacactctttgtgtaattatatgttttaaataattcaatacaacaatttaattgaaacatgaaatgcagaaagacttaaatcacagctggtatatacccaagatgtttatagttaggaagggagacatgtaatactgtgaaagtataataataaaaattggtataattttaaatgattgcactgagaaaggagggattaaacctgtctatgagactgtgagactttactaagttaatgacaccgatgcctgagttttgaacaaagagcaggtgcttgagaaatttggaaacactggtcattcaaacacaagttcacatggggaatgttagggtaatttcaagtaaattggtgtcagaggagtatgagctgtcaaaagggagtggcaggaaatgaagatgggaagacaggcagactcaggtcataatggggtttaccactgtgctaggatctcatccttcagaatttagtttaaaacacaatgcttttacagtcttgttgagaatgggtggagcatggcgggaagatgatctagagacagattgttttaaaaagcttttagaatagtctggaggaaggatgatgatagtcagaagtaaatcaatggtagttaagatgggtttggcagctacgcttttggtggctatagtgggtggaattgtgttaccctaaagccatagtttgaatccctaatccccaatgtaactatatttggagatacagtatttagggaggtacttaaggttaaatgaagttgtattcatcatcttgggctgtcataataaaatactgtatactgggtgacttaacacaaatttatttctcatagttctgggggtcaggaagtccatgataaagctgccagcagatttggtttctgatgagggttctcttcttggcctgcctttttctgtgtcctcagatgttagaagttctggtgtctctttctcttcttataagggcattaatttcatcatgaaagtttcagcttctcgacctcatctaaacctagttgtctcccaaaggccctgctaccaaataccatcacattgggggttaaggcttcaatatatgaattttgaggggggtgggtaaagatgcagtctctaacattcataagggtgaggccctaatgcaataagattggtgtgtttataagaaaaggaagatacaccaggactgtatgcccatagagaaaaaagtcatataagaacagagagaaggcagcagtgtgcgagtcaaggagagaagcctcagaaaccaaacctgtgcgcaccttgatcttaaatgtctagcctccagaactgtgggaatataagtttctgttgtttaagtctgtggtgtttggtttggcagctctggcagactattacagtagctgatttcaaatagatgtaaactgtgcattgtttttatatatgggttttttcattgttttctctgcaccctcttgacttggtaggaagcttgagaaacaaagttctttaattaccttgtgaaatttaagaggataagatggctaagttagaagaagttagtggaataccaggacaactgtgtgagtctcaattctgtacaaacatttctattcaccctcaacaagctaatcttagactttaaatgtccacttaaggtacctagataactgtggggtgtttgttcctttattgacctaattagccaaagtgacatttattggctaagtcctgttttctcctgcctttagtgttatacacactagatactacatttttaatctattatggaaagagtttcacttgtcccacttctgaaagaaatcatagtgttataaaatgcattagttgttttggcttttaaaaatagagtaaggtcaaggaaagtacaattcttcttgagagcacccagagtcttctcctgtgttacattcttgtcaagaagattgaaggagaacaaaaatcctctgatttgtgcctcattttaaagactttgactctgtttcctttatgaagccacttcatgggagatgtagtaattaaatgtaaatacctacatttaattgcctgctttttctctagatgataacatttttaataaatattcttcaccagtatcttctttattttctttttatttcctttcaattcaattactttctcactgacattccttctcatagagacttgattatttattttaaatgatttaccatcaatttgttttgattgacagcattttgtagataaaacacgtctaattattcatgttgagttattgttattaatcttgaaaggttgaatccagaaagttttacagtatttcccagctcatgacctcatggtgccattcgcagaggaagctgacacttctctatagtgatcttcactttgactgcctatggtatgtcctatggttttctgttcttccttagaaactgctgaggtctatggcctggaatttgtccattccttggattaatagtagaaacgtctataccctagtcatctcaggtaggcccaaattttaaatactctacatgctgatgacttcagaatttttgtatctagtcttcaactcccccttaggatccaaccttctgaatctaagaggcaacttgacaattctgcctgaatatcaaatgagcattccggagttaccttttcaataaatgaactcttgacttgccctcaaatctctctgttctcagtttggaggttcctcaaaaaaactaaaaacagagttactatatgattctgcaatcccacccctaggtgtatacctgaaagaaaggaagtcgctgtattgaagcgatatcttcactctcatgtttattgctacactattcacaatagccaagatttggaagatacctaagtgtctgtcaacaaacaaatggataaagaaaatgtggaacaaatacactctggagtactctttagccataaaaaacaatgagatcttttttttttttttttttttttgagattgagtctcactctgtcacccaggctggaatgcaatggcatgatcttgggtcactgcaacctctgcctcctgggttcaagcaattctcctgcctcagcctcccgagtagctgggtgcccactacaacacccggctgatttttgtaattttagtagagacggggtttcaccatattggtcaggctagtgttgaattcctgacctcaagtaagccacctgccttgacctcccaaagtgctgggattacaggggtaagccaccgtgcctggcccaagatcttgttatttgcaacaacatggatggagctggaggtcattatgttaagtgaaataagtcaggcacagaaagacaaacatgacatattctcactaatttgtggaagctaaacattaaaacaagtgaacccatgaagatagggagtagaaggatggataccaggggctgggaagggtagttggaggagtgggggtgagaaaaggggatggttatattaatgggtacaaaaaagtagttggaaagaataaataagatgtagtatttgcttacacaacagagtgactacagtaaaaaataatttacatttacatttaaaaatcacttttaaaaattaatcacatttacaaattaatttaaaatgactaaattttaaaagttaaaaatgactaaaacagcgtaattggattgtttgaaacacaaagaataaatgcttgtcatgatggataccctatttaccctgatgtgattagtactcattgcttgtctatgccaaaattatctcatgtaacccataaatatatacacctacaatgtacccacaaaaataaaaaataaaataataaaaaagagacttagaagcgcacaaaaaatctgtcttttctctagtatttcctatttctataaatagtaccataatccatgtagaggctaaggccgaaacttttgatcaaatgaaagaaaatgaaaggaaaaaagagcatgtgacaatctaaaacaaataataaatgtacagatgaagaaacaaataaaatgctagttgaccactcactaaatgtaaaaacatggccttttgttattaaaagacaatgacatttagagtaattcaaaaaacaaaaatgccaatgagataacttcttcccaagcttaaaagtccttactagctttctttgttcgtaggataaagttgaaacaccctacactgtatatttattagggttctttatatactgagtaacaggaaagaactcaagttccttaaacaatggaggaaaaacattgactcaagcaactgaaaagtccagacataatatacatacataaggttcattttcagagcggattgacctagtgaatcaatattatcaggaccagcattatttttctacatgtattggctttcattatatagtgttgccccagtctcaagcataacctccatttgtggtctgagaatgtctgtgagaagccacatacttttcagttttaggtcctaagagacaagagagactcttctcctggaacaattcaaaccacagtgccaggattgtgttcttggcctatatagacctgacttgggtactgttttttttggcaataactttagacaatgggatggaacattgtggttggcttgagccctggttggcttaagcagttaaggctcactctgatggagattaggtcagttcttcccaaatatcaaggatgaaaaatttgagatatgttaagaaatagggaacttttcctgccttactttagatactgcagttctcttaatcctcctaatcatgaggatcagtcatgaggttggcaattgacgaataccttattatagttgcactcaagaataccaggtgtctcttcctgccaccgaccttctggagtatgagtctcctcccttgttcagtattctccagttatgttggtcttcttttcattccttggacacactgagctctttcttgattcaggccacatttgcacaagctattccctctgcttggaagtctctttccccattgtttcacatggctagctctttctttttctttagatcacagcttaaaatcaccattttaatgtgctcttcttttgaccacttacctacagaaaaccaaatatgcctccatgcaccctttttctcaccttaggtacttttcattgttctatttatttcctttagagtactcaccagaatctgtaatagtttgctcattgacttgcacatttatttattattttctcaaggattttaagctttatgaatggtggggggagatcatgtcaatcttattccatactcgattctcactatataagaaaatatctagaacacaattggtgtttaagtatttgtaaagtaataagtgaatggtctcctaaagccataaaaatcactgtgttggaaggaaattaaaaggtcatctctgataaatgggcatccaatttctgccttaacaacccaggtgacatggaatttactatctcctccaggcattccattccacctttgggtatccgtgactattagaatgctcttcctttttttttattgagttaaaaaatatcatctcactgtaattcagatatgctgatgctaggtgtattccttggaatccaatttatgtataatattctttcaagttgttgaagtcagctatcacatcctcctccctttctgtgtcacctcttctctttacctttccctaacttcttcatctattttttatctaacaagattttatctaatacttcctcaccatcctagtgactcatccattaacatggtccagtttgtctgttttcagttgtgttcagtgatacacacaatatcattcactgttcattgggcgagaccttccctgccttattttagagattgcaattttcttaatcctcctaaaatctctgagttactgattcagattaaacctatggccagttaaagctcataagttttttttcccccaggtgctgttgttaagctgcatggccatcaacttgtaaaattatgcatattttcaatgcctcatctttctctgttgtaacaggcacagaattgtttctctgaagaagattttgtgagatcaggtggccatttaggtatttgcattggttaaacttcttcagtcctacgagaggactttattgctaccttcttcctaattatttgtcagtgcatatgactcaattctgtattggtgatgcagtgtatctgctgtctgaaccctaaggagagataaaagcttgatgctactattgcataattcttatcagaaacccgggattgcctgaaggatattcagtctacccatcattccaaatactgtaaattataccttttaatcttgccagataactggagtaatgtttatagggatcatggtgaccaacacggagggatgtaagagggaacaaccaagtgaaatttgtttgtaggtatatgtttaaggatggatgttgtttagggttccacacagggtactctcctgttttattctaaagacctaagggagaagtatttcccatgtttcagtataaaataaagaaaagctggaacttgctagaaagaacagcatgttcttattttataatgttgtgtatctggtaaccatgtttctcattttcatttgactcttaggaagcttagatctatttttttgttcacatgtaatacctatgcagaactccagggtatacatttctgttgctgatgttactgttggcttgactattctcctacccatattttcctttcaacattaaaatataagatttgatttgtgattttctattctatgatgagctatgctaattggagctttattttgcatgcattctttcccatattctttctcttagtatgtttaggcaaaccccttccttactccatatgtacctaatgggactgtaaatcataattccttggtcatcttttggcacagaagtagtcatgtgaccagtctgactcctaggcattgaggtggcggtggagtccctcctgccgggcacccggagagtgggacagaatcagcctgctgagcccgatgcaagtgcttgcaccccagagtccccccaggaagagttgccatgtcacccagcactggcagatgtccccaggtcgtccaccgatgccttttatggcaggaggaagtgcggctggaccaagagccctctctttgtaggggacagggacagtgcaatgcgggctcctcaggcttttgagcactcagatgtggacagggttgtcatcagcacagaccacatccctgagcctgaacccagcctcttggagtccaagttctttgaacaaaaggatgtggaggcaaaaccacccttcaggtccactttgttccatgactccttcaatacatgactgggatgtgatctaagcaggtgaattagaataatcccaaaactcatctgtcgaacgtgttgggaaaatttcttgtcctcttggttcataactacaagggtatgggccttggactgcatattttctttcatgtagctctctcttatattgcttgtctatgaggctgtgatgagagaatttggctgatgtacaactagaagcagtggcaagtagagacaagacagagatacagggacacacacatcttgaagacataatttaaaatccaaccaggagtaaaggctgatccactttatgtatcccagttttataccacaatatattgctatttttcctccaaaaaaatttaagcatgttttctgtcacatttacctaatatataatattgccttttaaaaaactatatgcacttttgtaagcttccttacaaatactttgttgaatgagtgtcagtagctgtctatccatccatgtaaacatacaaatgtgtctttccagtatatatatatactgtattatatatatactgtagtttatatatatactgtattatatatatatatatctgtcactctatataaagtatatgtacaattgtttttataaaacaagtgaaaaaatttacatttatctatatatgactgcatttcatggcacttgactccattttcttggcttgctataatccttcttgatttatgttctattaacttaccctttttctttttactaacatgttatctatcatttgtagatctgatcattataaaataggtatcttcatataaattattgattctgtgataaacatggcaagctttgggcacataactgtttttagagaccatcctacatgcaggtacagcctattaatgaagatttaggttaggttgtttttcatcagtgaatacgtacatatccagcctttgccttacggctgtcctctagatgttttcctaatattctgaaacatcatgttttctacattttctcatctgctgacataatgatttcactaaactttgatatcagttcctgtagaactcctaacaaagggtacccattttagccccattgttttagatattttttcttatctcaaaaaatgagtttactgtggaacttgtgtactatatataattatacacacacacatacacacacaaagaagaagaagagagcaaaattcatctgtaatctcacgacaagaaataataattgttaacattttggtacatatacttttatccttgtctatgcacaaaataaacatgtctgtatattttttaacgaaactgtgatagacccttttgtaaattgctgtttcacttaacaaactgcgagtgtttctatgttattagcattttaataccatatggattttctctattttcggatatttatataagctgcttacaactctcagacaactagttttcttattctaacttttgtcttataatctaaagccactgaagcttgggctcctttgcatttctgaattaggatatagatgctgttgtactttgtcctcaagaaacctactttattactgtaagatatttcttagggtccagaatggaaattccctatattaaattcaatactacagtgctcttctggggctgcagggtgtgaatttgggtttctaatgcttctcccttagtctcttctcccatttttgaaccaaattaaatcagttgcccttaattctttgttattatttcatttgcactgatcttttcttagtaagatgtttttattgtaatgaaaataaagtattcttcttatgacttttgcaattgaaattacattttcatgtttctgaactttctttgaacctgatgaaatgtacttatgattatctggttttcaaaggcccaaacaattgtgtttcaaatttgtctctaacatttagctactgtgaaaatccaagaagggcgttttaaaaactgcaccgcaaagggtattttttggatctacctattgaacgccacagggtcattaacatctcatctggcctatatgtctcctcagctccttccaaatctaaaattctagtctccttctttagattctaactactagtaattctgcaggacaaaaccacatcagtagaccaaggaattgctacgttttagctcaagcttgttagcacagagtggttttctctatgatttctggcttcgtgtatcagcctgtgggttggttgggtttaaacccacatttaaccagccaggcccaaggtctagtgaaatgtgactttgcagggctgaatttccgttgatagcatgctccttctccgtgatcatgcagttgatcccagctttaaatcagtctctattcccctttgctgactttgagaaaatagccattattccaggtattatccccaaaatagttttgtttacatatctagtcctgagtgtataccactaccttctccgagggattaatcccatgggctatttttaattatttttttttctctagtctctgtattcaacaatgatacttctacaaataagaccatttatggagtatttaccgtatgccacacactatgccaaatactctatctgcattttcaggaatgagacattttgcacacattttcagatgtaactcttatataattcctttttaaatgcagtttagcttaacctagatattttgggtaaagaagtggaggaaaatgggtattttttaaatgtaggcctttcatggatcttgtaagacttcactctttggcaggtgtgtgtctgtctgtgtgtgtgtgtgtgtgtatgtgtgtgatgctactttgatttatagaactttatctctgaaaacctaggtttagaaacaataggaataaaagagtttgagttgctctattaatatattgaattcactttacaatagatctcactatgggatatccctaaatagctagctctccctatgcatttcaatttcaactggacttgcaaaaatttgatttacctacaacttctcagaaatatatgtacagaacaggtctttggtatgagacacacactgctccaggcatcctcatttaaaagagttacgtgacggtaggaggcaaagggggtaaatttcaagcttgactgtagaggccagtgagggaagaggcaaattatagactctggcacattttctggcaatatcaatctaactcctagttctctgctttgcttataattaggaatgcacagggctatcagatttaccaagcactttcacattctttttttctaatttaacagcttatgtactttgccacagggagaatgatactttttctttcctatcagaacactcttaaactttaatacccacctttttcatgaagactttcctcactactccagggaaaggcagtgatagccttctttcttgccttcagtttagttcaacagttatttgagagcaaactaggtactgaatgaaatgataggacacaatctctgtcttcaagaagaggcaagcacatgaacagatggggacagtgcttggcattgtgcctgacatatggtgggtggcatttcataagtatgaattgacttgattattgcttgatatgtagaggtatgtgtgtgtgtgtgtctgtgtgtctgtgtgtgtctgtgactgtctgtgtgttgctacaggaattcagtggaagacctgacctagtgtggaggtctttgtttgggttgaggacagatttcaggagttttcttagattagatgatacctaatctctgtcctaaatgataataataattatggcagtggctatatgctaggtacttttctaaatgctttatatgcattaatttatttaatccttacaaacaattccagtagcaactaaatgctattgttctccctgctttgcagacaaggaaactgaaggtttgagaggttaaggaacatgtccagggttatctggccaagaggaactggagccaatattttaatccaagagatgtaaccttcaccactgtgtagagtggtcatatatttttcatccaaactgagtcactgctgaaagtgagagatactgctattagataactaatatacaagtaactgattctgtcccaggcaaactgggatgtatggcaacattaccaaactctccctgcttactaaattctatatttcccacaaaatatatgtggtagcttacaaaaaactatgtcttctaacattttaagctttttcccccattctccatagcacctagtagcacttatagtggtgagtgtgtacatagtcaataactaaaaaggagctattgaccttgatatataaaattgaaataatcagatggtctagcccactatttttcatttcaaatgataaggtagttggttaaatatatcctctatcttgaacagtagaagtgagggacagacaatgaggatggtggaaaaaagaaaaactgctacagttatggaaggacatgtgggagtatgggacattgtgaaggagggaaggaggaggaagaagtgataattcatcctggtttgagactgctttagacccactattcttagtcatttttgtgtcataattcacatgatgcattaattccctgggaatgctcagattagctataatatggctgcagaagagataagaaaggcagcaggttttgtgtaattaattcctataatctaactccacttctgtcattccctctccataactgaaatatgagcaaatgagagggactttatgattgggataaccttgagttcattcttattgacattcaataagtaaagcactctaaatttctgtaccttaattatgagtagtcgtgaatcacatgttgctcatctcccatacaaacagggcaggccaggacaaacatgacctaaaacaatgttgaaaactggctccagtagaaataattctactccaggctaaaatatgagacttaaatttactgaattgctgtctaaaattagtagcagcgtaattctgaccttctttcatttccaaaagaaatatcctattttcttagctgtttcccgtcaattctgcattctgagtgggtttgtgagccagtaaccgcattaacaccaatagatgggatcttcttgtttgtttggtgtctgggcctttctgcatggctgaattttcaattctaaccattcttcaatttcatgtttgctctctctctttttttctaactcgagagtcaatgttagagcttgattttattgtgaatgcacatatgttatatcttgatactaagtaatatgagaagggatttctggcaaagcatacttaatcactgtaaatatttcctgttgttattcaaattcatgatgaattttaatcaggtagaaaatatccttaattggtccaatttagaacttaatagtaatccactggaataatgtgtgacagtgttgggtttaaatctatgaatttctcatctttaaggtacaaatgggttgctacataggtatcagtctttctgtttcacgactctacaaacagaatgattaaatgttaattggcagctccgatgctacagtatagaagaagcttcagatcatcatgacaatgcgactgtcactttttatcaaaacaacgatgttttgtctttgtgcacatttaaattttggagcctaattttaaaatacctcctatctgagatgagtgctgtcatagtcaatgaaaaagttgaggctttgtgccgtccaattttgccttacaatgtgggcatttaggatctttagttgaccaatccttcttgcttatctaacctagatgtctgtgttttccttcatggcaaacaatctttaccttgtctgccatgtttactccaggttcaggggcttttctgctaaaagtccttcttttcccctattagaataccctactatttccttcctgcaaactctgggcctaaatatttagagagtagactctggatttcttcatcttcttcatgcgttgctgtgaggattaaataagctaatgcatataaaacagtgcaatacctggtatgtagaaagtgcttcctaagtggagatgtcatgaatgtttctgtcgccatcaactttctgaaccatcctgctcaaaataccaagaacctcactttgttttgaattccaccttagtgaagtaaaatttgtctctccaatgaagagagctgaaattgttcccaaggtagtgagattgtaatgattgaggagacatttatttccagagccctcttgtcttactcgcatgggattattggaaagtgatggcagttatatttctacatcatgggcagggggagtacagaaagctgcctatgagcccagtctggcccacctgaggtttattgtgtgacagtttcctactaaggccatactggcaggcttgaaccaattagtgattgctattgaatagtcactatagcatttttaggccttaaaatttgattccattgaaattatctcacaaaattaagggaaaaactgaaggattctttacacaagagaaggaggtgagccaggtgtccttatgcactttgcctacgtttgcgtcacatccaatagatgtagagtgagcatgggtcctctcttctctatgttgtcatcaatcaaagtttaggtggtgacagaaatgtgaatttctgataatatgggttcttgatgaaacttcatatctattatttaagccattcagtctgtggtattttgtattttgttattgcaccccaaactgatgttaagggatgttaatgcactcctgatttaaggagtgataacatgttatttggtcaagtcgagttcttcagtttttttaatttttatttttaatttacaaaaaataattgtgtatatttgtggattacaatgatgtctcaatacatgtatacattatgggatgatcaaatcaggctaattaacatatctatcatctcgcatacgtatcccttctttgtggtgagaacaaaatggtagagaaaatctactattttgaggaatttagaaatacacattattatgaactatagtcgccatgctatgcaatagatgaccagaactgatttttttgtctaactgaagctttgtacattttgaccaatatctcccctttttctatctaccccctgccatctttcagcccctggtaaccaccgttttactccctacatctatgagtttgacttttttagattccacatagatgtgagatcatgcagtatttgcctttaggtgcctggcttatttcacttagcataatgtcatctagcttcatccatgttgtcacaaatgacaacatttcttacttgtttaaggccgaagagtattctattgtgtatatgtaccacattttctttatctagtcgtctgttgatgggcaccctggttgtttccatagcttggaaataataaacagtgaataatactgaaatgcacatgcaagtgtagacatgtctttgacataatgatttcaattcctttgggtatatgctcagtagtgagattgctgaatcacatggtaattttattcttagtttttggagggacctccatactgtctttttataatggctgtactaatttacattcctaccaacagtgtgcacccattcccttttcttcacatcctcaccaatacatgttacctttcattttttttataatcgttctaacaggtgtgaggtaatgtctcattgtgattttaatttgtatttctctggtgattcatgatgttgaacttttaaaaatgtatctcttggccatttgtgtgtcttttttgaaacacttctatgcaggtgctttgctcattttaaaaatcaggttatttgttttctttttatggagtactttgagtttcttatatactttgaatattactctcatatctgatgtacaatttgtacatatttttctccagatctgtcggttgtctcttcactctgttaattgttttctttgctttgcaaagttatttctttcttagacactaatatgaattacctaaaattagtgatctagtaaaagaagtactactagatttttatggccctgtttttctaatagggatttctttgctttttccacaatgtttctgttttcttggcctcacctgaggctgctaatcactaaatatttaatgagacttgatcctcatcttcaaggaatttgtaatctaattgaacagatgaaattaactgtagaatatcccagaacactcttcccttccccaaaaagtgcaggtagtgtgctggattatcttaaggacactttgctaggggtttatttaatagttttacaacagtcataatgagaaatttatttctttttcaattataaaattctttgggtgggaatcgtagctcacacctgtaatctcagcgctttgggaggctgatgctggaggactgcttgagcctaggagtttgagaccagcccaggcaatatagtgaaacctcatctctacaaaaattttaaaaattagctaggtatgacttctgcctggagccccagctactcaggaggcggagatgagaggatggcctgagcccaagagatcaaggttgcagtgagccgagaccacactactgcactccagccttggggacagagtgagaacttgtcttaaaaaaaaaaaaaagtttttctgttaggtgcatttagttaaataaaattttaaaaaagattcaacttaaaggatatttttgagtaaatgaaaatggaggtttttatgattagacaaaaactggaaggtaacccatgtggttctcagagatgggaaagaatggctttgatattatgcatggctgaggtttgtgaaagctgagaatctgtaatctgactgaacaggggataggaaaggggcatagtattactggcacttaaaaaactttttcgaatgacctcggttcttccaaactggcaactactgatttatagaacaattaatttattgtccatgggttctaaccttcaagaaatataggagttcagtaacagtcttgctcattatcagataaacagctgacagcttctccatggaaaagttgggctggagctagattctgaaaacataaaatattttgaatagaaagtagtgaagagagaatattttaggcaagtggtctagcagaaatttcgtgtagaggaaataatatatttggaaggttttgaaacacaatgagagagtggtttgattatgtactagttagttattgccacaatagtcatatgtaataaatcatctcaaaactcaatggcttaaaaaaactcatttattctcaaggatttgcaggttggcagaggtggctgtgcttcatgatgtgagttggctagtgtattctcatccaacttgtgatagcaggtgagcacaggcatgtttttagtatggcaaaggaaagtgcaagacaagcgccaaaatatataaaaacacattttaagtctttgcttatgtcaaatctattaacatctattggctaaatcaagtcacttggctaagaacaaaatcaaagagcaagaaaaatatactccatccaaatttctagacaccacgtgacaatactgagacttgacataaagagaatactcagtgaatagtcttttatttgcttcctggagctacattttgcacatagtttgagttaggagtggtcttacctgatttatgtttttaaccaaaatatagggaagtatttgtgcaaaggtttaggacagaaatcaacacactttttttttttttttttttttttttgtaaaggtctagcaagtaaatattttaggtttcataggtcatactgtctgggtagcaactactcaagtgtgttagcagcaggaaggcagccacagaatatatgtaaacaaatgggtctggctgtaattcaataaaactttacttacacaaagagctggctagaggactgaatttagttgggggcagggtgggcggggggctctggatttgccccccatgccatagtttgcagacaaattatttaggagacaacctagtataaatatacattaggcaatgtcattttgctgttcttatataattaaattaacctgtattacataatcttttatttatatcttatcgtctggaagaagaacaaactctgcggttgctttcaaagctgagattacagttgatgcttccttttggtgtgcaaatcagcgggtgttaattggaaaacaaattttttacatgactgaaatatgttctgatgtggaattactaatttgtgcctgattctgtttggcatgctgctgctcatgatttttatcagataatttacacagagattctcttttggcctgtgacatgaattctgaacaatcagaaaatgctttaagatcaagagtagacaatttttctttctgtgaaagagaaatgagttggcaaataaagtagaaataaatcatctatttctatttatttacagctggaagccatttagggttcaatttgaagggagatttttgttcttcctttagctgagcagcaaacacattggcctcgtactttctctacattttatcatagaagttccttagctatgtattctgtactgccttcttgtttctggtgagtttccctgttcctttactggggcaaggtttaggggctctctggcttggtcaggtcatgtagaagcagcccagcaaactttttgtctgaacatccaactcttttaaagaaatctttctccatggatttccttaatatcttgtttcaaaaaaaaaaatgttctctgcctagaaaactacgtttttctaggtgaatcctgaatcctatttctatttttccccatctcaccattgatatactaggcaaagtaaacaccatgtcaaagaattttttttctaaaaatgaggatgctcgaagtgcctatacttccccattaaagttcacatttctttggtgaactggatactcttgctctctccctgcaaggtaacatagcaggagctagaacaatttttagacctttgaaacctaatttatttgtcatcattgagattttgctggctttcatttggctgacatgtgaagatgagtaatacatttatattgtatttatgggggaaaagcagatgaaatattcaggtttaggttgatgcaaaagtaattgcagtttttgccactactcatggtgaaaaccgctactcatggtgaaaatcgctattacttttgcaccaacctataatacaaagtgatactaggcaagtggatttactcaggggatatttattgaaaggagaaaaaaaagctgctgtttattgaatgcctacttcataacagctatatggctttaaagagttagtaatttgccacagtctcagaggtggggcatggcagaaatgagattggaatcccatttcaactgcaaagctcctcttttccttacatcactatttcacattagcaatatgtactgatttaaggaaacagctgggaaattatgcctcttgtttgctgtctctgaactatacattcagtaagaagtttgaatttttatgatattagagatgggaaatgttcacacttaattttgttaacatttcttttctctctattatcgcaggctaaatttttccactttcttaaatggactgcagaaaaattgcagaaaccttaaatcttcatttaattaatagaaaatacaacaccttaattgtcattattattattttttctactagtgtactgaagaagacatgctggcttctgagtatatgtggttcactctgtgagaacagtagctgaatttttaatagtgtttctgtagatttggcattattctaagactttacatatattgacttatttaattctcacaactatctaatgaagtaaatactgttattatcccaatgtaatagataagaatacagagacacagagaggtgagctaacttcccttttaactttatcacagctaccagatggtggagctgagattcaaattctagcagacgccagccagagcctgtgctcttaagaaaatgagctccagctgggcacggtggctcctgcctgtaatcccagcactttgggaggccaaggcaggtggatcacttgaggtcatgagttcgagagcagcctggccaacatagcgaaaccccgtctctactaaaaatacaaaaattagccggatgtggtgtcaggtgtctgtaatctcagctactcagagaggctgaggcaggagaatcacttgatcctgggaggtggaggttgcagtgaaccgagatcacgccactgcactgcagcctgggtgacagagtgagactccgtctcaaaaagaaaaaaaaaaaaaaagaaagaaaatgggctccattgaactttgtaatcagtcatggttcagtcaggagacagtaaccacacaaattattttataagagagaatttaatataactacatattaaagaacttataatacgaaaagagcataaagttatcacagaagtagacttttcaggtatcacagaaatagccttttcaggaagcagctacctagggctagggaaacaggaggaagaggttggaattattaatatttagaggaaaagaggcttcccaggtgctagagtctctgagcatagaaaaatggtataataggatgggggctaccagaggaaggtaaagagaggctggccagctgatattgttatctgagggtgccataaacattgctcttcaaatgttgggaaaacggcaaatgggaaccaagtactgctactggaaagaaaattgttgctgttggactgaagaatcattgctaggatgatacttacaagaagaagctaaaagggaacaaacaagaaggatgaagtcctgtcttcattctgaagctttgcagttctcctctttcacccatatgggcagagcctgagagggaacggctggcaaaataaagatgtggtgtttacagttccagtcccagcaccacaaagctgggattgaccttaaaccaaatttccaaatagaaaagtatgttcaagatttatgaaaaaataatgtgctattggagaattttattacctcagtataatataatcttatacgttttttatgaacatgatctgtctctcccaacaaattatggactctctcaaaccagttctgacttaagcctttttcaagggccagcttagtgcaaggcacataggaggtgcataataaatgattgttgctgaagtgatattagaaacatttaaatgtagattttcttttaaaattacttttacaggtttcagaacatctattcatagggtcagctgaacaaataaagcttgcgaatgagaatattattcaggagaagggcttgctctatccctgtgaatgctcaagagagctccagtgtttgcagaaaagttttacaaagattaaaacaatatctactccccctcccctggtgagattatcattaattaaggaaatgcaggcatcgatctgtttgatagcattccatcagcagagctctggcctataaaacgcaggttgagattttcactcgtatttcaaggatgtttcccagttggatggcagcattttgatcccccgtgttacctgtcaaaggataatgaatataactagtgggaaccatgccgacccaacagatattactttattttaataatgtgattggaatcaggtgattggaatgtagtgttgagttgaacagggttagaaaatgagtcacatctctgaacaagtgagattgagggagggtaaagggaaatagcttcactagtctgaaacaaaaggaaaaaaatctgcgtttccgttactatgatcatttttgggggctcataggtggaaagaataaatttgcctgttttcttacatgttggcccatagtatgttttctaggtgtagtgaagggcaatgcgatatagaggcagtagcaccattcctaaaccaggaacgtgtgactgggaaccccaagttggctagcaactggtgtgtgagcttggagaagtcacttaacttcattggccttcagtttcctcttttgtaaaatgaagtgattggttataatcaatatcccacattccctcctaccccattctatgtcctcctcttttttcttagttcattggcatgcaaattgtttgtttattgtttgttttgttttgttttgtttttgagatggagtcttgctttttcacccaggctggagtgcagtggcaccatctcagctcactgcaacctccgcctcctgggttcaagcgattctcctccctcaacctcctgagtagctgagattacaggaaggtgcccaccatgaccggctaaattctgtatttttagtagagatggggtttcgcaatgttggccaggctggtctcaaacttctgaccccaagtgatccacctgccttggcctcccaaagtgctgggattacaggcatgagccatcacacccagccaggcatgctaaattgtgtttcaaatgtgtcagtcgaaaacagactcatttttcaagatgtaagtcaatgtctctgaagaaaagcccatactataaaagaatactagttttcctacaaaagcatttaatttatgatatgttttaccataataaaatgaatgtcctctgtttttaacgaggagttttgattgaagtgaaatcgtgttttctagaaaatgtagatttttgccttaagttctaattattgaaatggaaagtttgaagccatcaaatagtgaatcaacttgtgaatttcctcatccttctaaatataatattaaaaaaattgatatgcaatgtaaatatgtgttacattttcaaacggcaacttcagatacagtattttgttgttagcaccgataattactgatgctttaacagccaatcgcataagaattgcccttccttgagcttaaccaattgtctgtcatcttttagtgtgttttcctcccatctcttcacttgtccatcttcccatccatccatccatctatacttccatccttccattaacctatccatccatccttagggctgacaggataattcaaacatattgtaaaagaatgttttctctcttgatgtctgctactaatgttataaataaacagcccaaatcacatttgtttctattttgaattctttataatttgactaggaacatacttgtatttaattccagtatctttttttttttttttttttgaggtgaaatttcgctcttgttgcccaggctggagcatagtggtgcatctcagctcactgcaacctctgcctcccaggttgaagcgattctcctgcctcagcctctcgaatagctgggattacaggtgcccgccaccacacccggctaatttttgtatatttagtagagacggagttccaccatgttgaccaggctggtcttacacttctgacctcaggtgatccacccgcctcggcctcccaaagtgctgggattacaggcgtgagccactgcacctggccctatcgtttttttactacttaccatgggcaagctagttaaccttcctaagcctcggttttagttttcaaaattgagatcctgcttcccagctcacagggttgttgtgactaaatgtgataatgggtataaagctcttagtgcagtgtctgtcatacataaattctctctcctctagcttttaacctgcaccttgcttactaagttctagtaaaatggattgacttttagcaccttatctggcctttgatgagtatttcttatctattaggaaagaggcatctgcaaatgactctaatttaaacaaaaaggggcttattgcaaggctatcaggagctcacagaacttattggtaggatgatgaaacttgtgtagaaagggactgaaaccaaggaggctcctaagggccaggatgcagaaaggaaggaaagatctcatagaaggaatggttagctggatacatctaaccaccatatcctctggcttcttatttctctgtctctcaagagtcaaaattgaatgaaaggaaaagtctgattcactgagcttaggtcacatgatggctgatcttaggtcatgtgacttctccattattttactggacatgttaaaagaagggccccattcactgagaccctgtagtaggagggagtttctggattccaccacagtatatacaccagtgaagcatatgcagttccctgtaagggaccttgacacctgttagaagaggaaatggatgctggatggccaaaaaatggcaaatgtcagtgacagtgagtatatgtgtgttcatattctctctatctacttgtttttacccagactcagaatccattagttctcagtctttatattggtaaacttataggtcttgactgattttagtttgttcgtctaagacatctctttccatctcttaggatattttaattgctcatctctggaccctctccaaggcttgttaagcctttattgagctgtggtaaccagagctgcacagttttgtgtcttgacatagtgcagttggtttcaaggaaaggctaatatgtttggtcttatgtccaatattcttgatcaacattaatgttatttactggaggaaaatcagtctcatttttatatcactggaacatccagcaatgcaagccttgctggcactggggaggtctaaaattttctaaatagagggaaatgaataagtagtggattgtttgataccatgtaggagaaagggaaaaataaacaaaaagctgcatttctacaaaccctcaatctgttctgagtacagaaagtcatttgtttggaatttagatccaggttgatttggttgtcaattctagttttccaaatgtgtgactttggacaagtcactttaatattgctgactgtcatttctgtcattggtgaaatagaaataataatattccgcttgacaggattaagtgtgactcacgtgatttcacttattaaggctttggcggaatatttagcacatgacagaaatataatttaaaagtcttttttttgtccatttgcactaaagagataagagaagtttgaaataattaaaagtcactggatcctattggggttagtcaagggaagacttgacagaagcgagccagaagctggtctttgacagagaaaagtgacatgactttatggaaagaagacaggagaacatgaacagaagagagacaagatgtctgaaagtttgaagttagatagattaactagttttccttttggtaattagaatagctggctagaaaagggtggaagatggtgctaaggtaattgctaagaagatgagatttgatttgaggtttctgaactcaggaggcataaaatcaaagtaacacttaaaatgataaattcatccttaatgacatggccattctcaaagaccacattgactggtctattaagcaattaatacctccctttcaaatttttgcctatttatttttaaatttcatgcagtgtctctgggcaagggtgctgactctattacttgtctattattgtcactctatgatttgtctcaggctctcttctgacctcttctgtccaagttgtctatgtgaatagacatcctgtgtctgcccttacagggtcactttattcagagaatcatagaatgttcaagataggctattctaatctacccaattttcagattaaaaagctgaggacctgaaagaggacatgaattgacacagattatagacttttagagcagcatgtagttaacaaaaataaacaaataaggattttaggtagatatcatgcactttagtagatgtataaacttggaaatcttatctgacttttagaacctcaatttcttttctgtataataggcaggtaattgatgatacctgtttcaaagggtgtctatgaaactgaaacaaggaaatacctcttgaacatctgaaaggagagctcaatatgtgttagtttccttccctttacttttagaactgatttgggttctggactataaaaaaagaattgcatcatccctttggggaagatgaaggggaaaggtaaaaatcactgaagaaatctaatggtaaatgaatacattttttgcttctgttcttttcctacagtcagtatcatcttggggaagcaggtgaactagctttttctcctcagtcactgtgcctggggctgggacagttctcatgattctggttggaatttaggctgacatttgaggggtgagacagatggccatcatctccattaagaataactgcaccccagccctttatccacaactctgcaaatgtgtttggctcccatagcaggtttatgtgttggcaatatcagtgaaatgattccttccagcttggacatgtaaagactttcagggccctatggcttttttctctcacttttctttactcattctcacagtcttgaaatttacaacccttaagtccacaaggctgttatttagaagtgaaggaattgttgtactgacatttttctaattaaataaaaaaaatttatttaaaaagaaccaaaaatagaagcaatgcaaaatatacagtgaggcacagtggataaagaacagatgtgcaaattagagaaacttggttttagcatcagagtttccatttacctgctctgaagtgtctggctgtgtaacctaggacacttcattttgaatatttttagaattctttccagtataaatctttgtgacactataagcattttccttttaataatattcacaaacttacaaacatataggaaaatttaaagtataatgtgaccatattggacccatcattgaatcctatcaaatcttaacatgttgtcatatataccgtcttcctttctttgcatttgatacttatcattttcacgcatgttttatgctgctactctatgtccctatatttaaaaccaatttgtatagtattgtttgaaatgcttttaactttatacaattatatcataatgtatatattcaactgccacttgcatttgtcactcaatgtcattgagatttatccctgctcacatatgtagctcttcattttaattatgatacagtaatccattgtatgaatagttcacaatttacttatcctttttcctgatgactagtttttacaattacaaagaatgttggaattaatgtactggcataagtctccttctgttatgtgcatctttaatttgccttgatattgtcaaattgcttctaaagtttggaacattattgttcaaattgtttattcctaggtttatttattttataattacctagtagctctagaaactattaagactcctacatttacatatctttgttcatttaagacacattgcacacagtctttcacaatgcactgtactaaatataaaaatcaaaaagacatggcaacctgctctcaaggttacctatactttagacaaggcatgtgcatgtataattatttttatatattatagagagaatatctactcagtttgttgagcaagagtaatttacttgtatcacctttcttaagattagtgggtgccagttaccctgaaatattttagttgtctgttgtttcttccttttttttttttttttatttaatgtactctggtactataagaattaaatattacttgggatacagaaatattttagtttttataagtttgcctcagttaaggtctaagtcctttggttttattattgatctacaaaggatgttgtaactattgaaatgtaagaaaaaagatattttgttgctgagtttaatacagatgtttgcttatcacatttagcagtattgaaactggagccctaagaatggcttttctgtggattgtggaaagacattcagtcattggatgaacaagacaacaaacaggtcttggtttctagtttgttttgtcaattcaattcacaagacacaagtttcacccagagagtttatttagatttaagaaaagatgcaggcagggtgcggtggctcatgcctgtaatcccagcactttgggaggccgaggtgggtggatcacctgaggtcaggagtttgagaccagcctgaccaacatggcgaaatcctgtctcgtctaaaatacaaaaattagctgggcatgctggtggatgcctgtaatcccagctactctggaggctgaagcaggagaattgcttgaatccaggaggtggaggtaatagtgagcagagatcgcaccactgcactccagcctgggcgatagagtgagactctgtctccaaaacaaaaaacaaacaagcaaacagaaagaatgtaaaatgggaatactggaattcacaactaggagcatcataaggccttagtcatccagacactggtgtcccctcatagtctggtatttgttttagttccaagggataggaactgaccctagattgggtcacatcagcccaaggaagctgcagtgtctatgctccttcatcttaaaatccttgagaatttcctagcatgttgcaggagagtatgctcagttcccattcttaagtgtcgctgcaggcataagtgatcagatattctgacaactaaatacaggatgctcagggacagccctggaaatgtaatcagtatatgacaaccctaataagaccctcatttatctctaaagattatattttctcacttgatattgcaaaaagtgcaactgggtgtcaaattttcctcaagcattcccagaagctggagaaagagattatagcccaatcattaactcttatctattatgttgcctcagtttattcagccttgccaattcaagtagacaatgagagaggtcatagagttctgagatggtgctttctgcctccctagcagggaagattttgtatgtaatgttgggcatattgcaaggtggcagtgtaatagggtggtttgagagcatgggtgggctttggaatcagacaaggccatgttcaagtcttagctgtgctgctttctagctatgtgttactgtggtaggcaaaataattcctcctttccatatatgaatccctaaaacctgttaatatattaggttgaaaaggagaattaaagtttcagatggaattaaggttgctaatcagctgaccctgagatagttatattgtcctggatttctgggtgggatcaatttagtcacaggagtccttacaagtgaaagaggaaagcaagaaagagagaaccacgcatatagcagcatgagaaggacgtggctcaatgttgctggctttgaaaaggcagacattaagtcacaagccaaagaatgcaggcagcctctagaagctggagaagtcaaaaaacaaaacaaaagagatattccctagaagtccgccaaaagaaaacaacactgccagtacctttttagcccagtgagacccattttggacttcagacctccaaaagtggaagacaatgaattcatgttgctataaggcactatttttggtaatttgttacagcagcaataggaaactaaaatagcgatatttatgtcttgatgcttcagttttctcattttgtaaaataaggattataacagcactttcctcctatggagattgttttaagatatccatttttgtgcagagcatttggcctactcttggtaagactcaatctttggacgagacatttaggtatttgaacaagaagttaggaaacttggattatggtttcagacaaaatgaggacacgagtaacttcctgcctttcttataaagttgatgtgaaaagcaaatgaaattatgttttaacttttatattttaactaaagcattattcaaatataacttcttgttataatttagcttacacattccaaatggacttattagataatatgtgaaagatataaaaattcaacacttgagtcatcagctgattgtagaaaaatagtgttggggtaatagataatattaattccaatgactggtactgagtagtaagttctttcttttaagatattctatttttatagcacttatatttcctacttatgtggtaataattatggttctttatttcatatggcagggatgtgtgttatcttttaattgcagcctttgcttataatgtctgaatgtaagcacaataatatttatttaattgaactaaagataaagtggaagaatcacatatttggccaggatataattatcagagctcctctaaaacacattttgaatattttaaacggtgtattaatttttagtaagtgagatggcgaagttcttattgttctgtatgctaatgattaagcatttcaaatatttatcattaattttgattgattatgcatttaaataagtaaattcaggcagataaaattaagatttatttgtctcactgtttgaagtattcctttactgaggtcagtaagtgtatgtgtatgcaatgaaaagtgagcattaggctattactgtaattgcttatcactattttcattttcataaacatatggcaatatgcactgttatattaacagatatattgttttcatcatcttatttttcagttgactcttgggcacagtcaaagggcatgttttgtagtgacagatttttcaaattcatgcttcctatggaaattttaagaagtagaggtttgtttaaattctataccagggcatagaagaaacttaaacagaatgctaaaggaaggaatgtggccacttttttctgggcatacaattagtctagtcaatagaggtcacactggaccaagcatttgagatgtttcaactccccactggggcaaacttaccacaaaatgtgctcatccattttccagtgtcgagagaaagaggaaggcggacatcgtggagtctttaatgactggggtttttgtagagcttttaatgattgttttaaagccatttatcactaagaagtgaaaaccatttacaaaatgtagtggttaaaatgactgtgactctaatccataacttgacagtttactttttgttatttctcctattcttttaaacgtgaggtattgcaggataggtgaggggggaaatctggttatttgactactaatatgcgaaaatccaaaaatttagattgagtaggtaaatggggtaatttttaatgttgcaaatagttgatctgttttgcccaagaatgcggttcctgtcgaagaggttggaataggacagaaaactttacatttgtaatgttcagcagttttgatactcttaggtcaatcagaaataaagcacgcaagaacctcctgagatgatacagcaaatgtgtggaaactgggtaatttttcaagaactggagaaggactgtgtctgaatgcagaccatgcagagataacagcatatatataaggcattttgtcactggcatcttgaaaaataaaatcaataaatatttaaaatttatttgcattttagaaccagtcagcatcttcacatagccatcaggcaataaagaagctttgaaaaagaggataaaatgtatttatagaggaaaaaaataattttataagtacatttaaagtggaaatgcttagggaagtttgtgactaggagatgctgggaagttttgatttgtgattctgcaaagttaccaaacaccaaaaaatttcacagataagtcatttcatttgatgttcttgatttttccttttgagtgacagggataaaaagaaagttttagagattgtctgctggtttcattgttggcactgcaaagggagaagtcagtatctgatttttagattcctagggtttgtctcactttgatggagaaaatatttcacaatgtttacacttgaaattcttatctttgtagatttcagaggattcgatgctagttgcaatgggtttcatctttgaggagtctcacagatgtggatcatccttattccatcaaattttatttctgttgagccagataatgattataatgttagtgtccttcacattggaagattttccagctatgaaggaaatgacagtgatggaactcatattgacctttagtcgctgttaaaatatctctaaaggacagactcatggattctcataatatcagttaccagatggcatttctagggactctgtctctgccttctggaggcctaccctgtagcctccagactctctagcacccatgctgacatctacctcttcacctccgggttctaacacagccctaaagttggtgcttatccacaatgaatcaatcaaggcttggcttctgactggaatgggcttggttgttttttcccaattttatcttttggaacagctagaaaggaggaccgggttgctcagtggtcctcaaccttcatttctttctggaagagatttttaaaatgcatatgtctggacccccccatagagattctgatttagttgatctggtctggtctagggctgggcattggttcattttaaaaaattccccagatgatttaatatgtggccaagaagactggggtgctagtccacactctggattctcaaagtgtggctcctagatcagcaatatcagcatcacttgggaacttattagaaatccaaatcctcaggccctaagcaagacctaccgaatcagcaactttttaggggtaaggcccagaaatctgcattttaataagccttccatatgatgctcatgcatatgaaagtttgagaaccactgatttgatcaactttctaagatggggtaaactgttgaggatgcactccatggatacaactgtatcatatgcaaaaggtgcttagcacagacccgagtctagaactagggcatacaccaaccactggggagtaagcagattacaggggtccatgctagcaatgagcatcccagccaacaatttttgttatcaagaggtaatgcctgttcatagcaggttaggactagagtgtgagcgtcggggagatgttatgctgggtttaattcttggacttttctttattaatttaggaaactaatgtctctgagcttcatttttcactgggaaaaaaattattacctttcaaggttgttgtgaaaaataaaattgtctatgggaaaggtccagcaagaataaatgttcagcacatgcccagtaaaaaatacatgcttaagaaattattgctattattattattcccatatgagaataagcaatacattgtacgaaggctgtcatggttgcctctggtgtccaatgtcaaaccttataaattataatcataaaggagtctcttcagtgaacctgagtttggtctcaagtcctttctaatacagtaggctggggcaaccactatcagaaaatcggatctgactttcaagataaaccccattttccacctctaattaagattgcaaaaatcttagagatattcctattctttcattttcttccttcccacatttacttcacacctgctctgcagagtccaatagatacataatgcaagatacagatataattttctgttagccacattaagaaaagtaaaaaaaaaaaaaaaaaaaaagggcagttaaattttaaagtatttttaacctaatgtaatatatccaaatattatttcaatatgtagtcagtataaatattattaatgagatattttacattcttctttttggaactaagtctttgaaattcagtgtatatcttatacccatagcacatctcaatccatgcaagccatatttgaagggctcaatggccacatgaggctagtggctgccatactggacaatacagctctaggtcctggggccgagcaccgaagcaagggctggtaattgcctcaacaagctcacagtttattcagtggctcagccataggcaagtaatactatttttcagcatgaagtgttattacctcccaccttggattttcctgaagaacgaagtcatgtagtctgagtcaaagcagaatacttgacatttctttagggttatttggttttattgtttctacatcttgtgtgtatgatctgaattgtcagccctgcttgtagcctgcaagttgtacactctgaccttaacatttgctacataagtggaggttggacttagtgttgctggtgaagaatgtgtttctgctgtcctgttttggccctagtccataataatgtgacagcccagccacttgctgagcatgtgctgtgatatgccaggcacagtgctaagcaattcttacagaggttgacggaaagtccaccagtggcttcctaccgtacttagaatataatccagatggcttaaaaggacctacctgatttcacctatggccaccttggagataccatttcctaccttaatcccattttctcactccacttctgcttcccaggccttcttgctcttctttttcccaccttaagcctttgtcttggcattcctctggctagaatgctagagggttgctagaattatcctgggaacaccccaggataatcgtatggtttatttctgcatttcatctaagtcttcatttatgtgtcctcagaaaaccttccccaggcctctctatctattttagtaacctcatcactctccatcccctttctctgctttatttttccatattactgatcactacccttaattacatattacatgttactttacatatttatttattgtttgtctctcctgctagaatgtgagctgtattacagcaggagatttgtttcatttgttcaccattttgttttctggacttagaatagcacaggcacttaagaggtacatcacaaatatttgaataacttcaaatacccatggtgttatttaattctttttctttcttttcttttcttttttttttttttttctcactctgttgcccaagctggagtgtagtggtgccatcttggctcactgcaacatccacctcccaggttcaagcaattctcctgcctcagcctcccaagtagctgggactacaggcacctgccaccatgcccggctaatttttgtatttttattagagatggggtttcaccatacaccatattggctagggtggtctcaaactcctgaccttgtgatccgcctgcctcagcctcccaaagtgctgggattacaggcgtcagccacctcacccaaccggtcttatttaattcttaagccagtctttttttttttttaactaaaggagaaacagtatgacagataacacataaaaacatgagtaagttcacagtcattaagtagcagagctgagattttaactcaggattatatgtccagagctcagatttgtaatcactgtactttctctagggagaacaaaatcttgtttcctatgcttctgggttcctgtagattctccagaaagaaacaaacaaccaaaaaaaaaaaaaaaaaactgtagctttcttggtatgattttctacttcctctgttgttaataggctgttagacagcctcagccagaggaactggatgtagaatttggtgacagcttttgacagtgctatcaacagatgcattgaagttcccagggcaattactgagttgatgttgatgaaaatatattttgaatactgcaaaattgccccttcttgggatttattttagggtctatattaagtgataactgaagactactgagtaaaggcagtgtgaggcaactgataaatagtgaggcatcctttaatacacctcactttaacgatgggagactgtctcagaggaacaaacagagagtctttctaggtgctttaactttcatttcaacccagtttcacaagatctcactgaacttctgtttcatatcataccctgagcttggagctagggatatcatcctgattgtatcagttgcatctattgctatgtaatgactacctcaaacttattggtatcaaacaaccgccattttactgtgctcataaattctgtgggtcaataattcagatagagccccgcagggatggcttgtatctctttgatatccggacctcagtggggaaaacttcaagtgctgagggcacttttaaagctgggaaatggaatcaactgaaggtttctttccacatatgtcaggctcctgggttgatattcctccaaggctggactcagctggggctatcaactagagcactccatgtgcctctccacatgttcttggctttttacagtgtggaagctgggttctgagaagcagtggcccgagctgaagcatccagacaatgagtgttcagaagctgccagacttctcacctagccttagaagtaacacagccacattctgtcggttacaaacacatttctaaggccagtccagattcaaacggagggcaattagatttgaccccttgatgaaggagggcaaggttacactgaaaaacagcatagggactgggagatattatgatgtccatttttggaaaatctgccacagacacagtgaagaaaatgatatttgttactacctgtgaacatcacgagctcaatcactggtagagagagacaggtgcgtcagactgctgtcaggaagcttaattttcctttgaaaagcaacattggcccatagtgtacacattttgtttataaacggggttatttgctctgtcctgcatttccatcccatgtttcactggagcaatgttcatagatttatcaccttagtgcagtgactcactgtgtgagatctggtgttgctttggcatttggaaatcagcatttattttcaaagtctatcctctgcctcattttgcttggctaactcctatacaatcctttcatgaagggtcacttcctccagaaagtcccttctgacccttcacctggattatgttcttctgctttgaattattatggcaccatgcaccatgcctacctcttgtcctagcatttgttatctgggattagaatggcctatttttgtctctagattgtaggatctagcaaggcagggccagtgtctgtcttcaccattgtatttcttgtactagtacatggttaaagtcagttttgtatctattctttttacatctggtctgggaaaaaaataggcaaactcaagggcagagagagggccatacaattatcatgatatatttatcttgttcttcttactacccctcttcttattctttcttttattcttcctcttcatttatggaaggaatcaatcatggacatctcctagcacacttaccttaaatccattgggctcctagccaactctgtaggtagactctgttagcaacaaagaggaaaaagggcaacaacaacttttgggtagtcaaccaagacagagtaccctccaggacatgtggctgggaaaacctaataacttcctaagctccaggggctttatttttaatacacattcccaggaaaactcatcagatgtttgaggcagcaaaaacagattcttttaagactcttgcaatctcagtaagtacatagttttatatttccagggtggcattccctttggtagttggcttgtcatatcttttctagttttctatcttttgtagtttgagtctggctagttagaaaaaagctatcaattatgaagaatctgtgatatattggttactgtgcaaaacttgaaaaccatatttttcttttttttaattatacttcaagtgttggggtacatgtgcagaacgtgcaggtttgttacataggtatacatgtgccatggtggtttgctgcacccatcaacctgtcatctacattaggtatttctcctaatgctatccctccccagccccccaccccccaataggccctgttgtgtgatgttcccttccccgtgtccatgtgttctcattgttcaactcccgcttatgagtgagaacatgcggtgtttggttttctgttcttgtgttagtttgctgagaatgacggtttacagcttcatccatgtccctgcaaatgacgtgaacccatccgttttatggccgcatagtattccatggtgtatatgtgtcacattttctttatccagtctatcattgatgggcatttgggttggttccaagtctttgttattgtgaacagtgctgcaatgaacatacatgtgcatgtatctttatagtagaatgatttacagtcctttgggtatatacccagtaatgggattgctggatcaaatggtatttctagttctagatccttgaggaatcgccacactgtcttccacaatggttgaactaatttatactcccatcaacagtgtaaaagcattcctatttctccacatcctctccagcatctgttgtttcctgactttttaatgattgtcattctaactggaatgagatggtatctcattgtggttttgatttgcatttctctaatgacgagtgatgatgagctttttttcatgtttgttggccacataaatgtcttcttttgagaagtgtctgttcatatccttcgctcactttttgattttttttcttgtaaatttgttgaagttctttatagattctagatattagcccctcatcaaatgggtagattgcaaaaattttctcccattctgtaggttgcctgttcaccctgatgatagtttcttttgctgtgcagaagcaatttagtttaattagatcccatttgtcaactttggcttttgttgccattgcttttggtgttttagtcacgaagtctttgcccatgcctgtgtcttgaatggtattgcctaggttttcttctagggtttttatggttttaggtcttaagtttaagtctttaatccatcttgagttaatgtttgtataaggtgtaaggaagggggtccagttttagttttctacatacggctagccagtttacccaacaccatttattaaatagagtattctttccccattgcttttgtcaggtttatcaaagatcagatggttgtagatgtgtggcattatttctgaggcctctgttctgttccattggtctatatatctgttttggtaccagtaccatgctgttttggttactgtagccttgtagtatagtttgaggtcaggtagcgtgatgcttccagctttgttctttttgcttaggattgtcttgtccatgcgggctgttttttggttccatatgaaatttaaagtagttttttctaattctgtgaagaaagtcaatgatagcttgatggggatagcactgaatctataaattactatgggcagtgtggccattttcacaatattgagttttcccattcatgaccatgaaatgttttccattagtttatgtcctctcgtatttccttgagtagcggtttgtagttctccttgaagaggtccttcacatctcttgtaagttgtattcctaggtattttattctctttctagcaattgtgaatggtagttcactcatgatttggctctctgtctattattggcgtatagtaatgcttgtgatttttgcacattgattttatattctgagactttgcagaagttgtttatcagcttaaggaggttttgggcagagatgttggggttttctaaatatacagtcatgtcatctgtaaaccgagactatttgacttcctctcttcctatttgaataccttttatttctttctcttgcctgattgccctggccagaacttccaatactatgtcgaataggagtggtcagagagggcatccctgtcttgtgccagttttcaaagggaatgcttccagcttttgcccattcagtatgatgttggctgtaggtttgtcataaatagctcttattattttgagatacagtctgtcaatacctagtttattgagagtttttagcatgaaggggtattgaattttgtcgaaggccttttctgaatctattgagataatcacgtggtttttgtcattggttctctttatgtgatggattacgtttattgatttgtgtatgttgaaccagccttgtatcccaggggtgaagccgacttgatcgtcgtggataagctttttgatgtgctgccggattcggtttgccagtattttcttgaggcttttctcattgatgttcgtcagagatattggcctgaaattttctttttttgttgtatctctgccaggtttggtgtcaggaggacattggcctcataaaatgagttagagaggattccctctttttctgttgtttggaatagttccagaaggaatggtaccagctcctctttgtacctctggtagaatttggctgtgaatccgtctggtcctggactttttttggttggtaggctattaattactgcttcaatttcagaacttgttattggtttattcagggattaaacttcttcctgatttagacttaggaggtatatatgtccaggaatttatctatttcttctagattttctagtttatttgcatagaggtgtttatagtattctctgatggtagactgtatttctgtgggatcagtggtgatatcccctttatcatttcttattgcatctatttaattcttctctcatttcttctttattagtctggctagtggtatatctattttgttgatcttttcaaaaaaccacctcctggattcattgattttctgaagagtttttcctgtctctaactccttcagttctgctctgatcttagttatttctcatcttctgctagcttttggatttgtttgctcttgcttctctagttcatttaattgtgatgctagggtgtcattttagatctttcctgctttaccttgtgggcatttagtggtataaatttccctctaaacactgctttagctgtgtcccagagattctggtatgttgtgtctttgttcttattggtttcaaagaacttatttatttctgccttaatttcattatttacccagtagtcattcggtagcaggttgttcagtctccatgtagtcgtgcagttttgagtgagtttcttattcctgagttctagtttgattgcacagtggtctgagagactgttacgacttccgttcttttgcatttgctgaggagtgttttacttccagttatgtggtcaattttagaataaatgtgatgtggtgctgagaaaaatgtatattctgttgatctgaggtggagagttctgtagatgtcttttaggtccccttggtccagagctgagttcaagtcctgaatatccttgttaattttctgtctcattgatctgtctaatatggacagtgaggtgttaaagtctcccactattattgggtgggagtctaagtctctttgtaggtctcagagaacttgctttttgaatctgggtgctcctgtattgagtgcatatatatttaggaaagttagctcttcttgttgcattgatcccattaccattatgtaatgcccttctgtgtctcttttgatctttgttatccgtctagaattgcaacccttgctttttttttttttttttttggctttcaatttgcgtggtaaatattcctccatccttttattttgagcctatgtgtgtctttgcacatgtgatgggtctcctgaatacagcacactgatgggtcttgactttatccaatttgccagtctgtgtcttttaattggggcatttagcccatttacatttaaggataatactgttatgtgtgaatttgatcctgttgttatgatgctagatgggtatttttcctgttagatgatgtagtttcttcatagtgttgatggcctttacaatttgatatgtttttgcagtggctgctactggttccttttcatgtttagtgcttccttcaggaactcttgtaaggccggtctggtggtgacaaaatctgtcagcatttgcctgtctgtaaagtattttatttctcctttgcttatgaagcttagtttggctggagatgatcttctgggttgaaaatttgtttctctaagaatgttgaatattggcccccactctcttctagcttgtagggtttctttagagagatccacagttagtctgatgggcttccctttgtgggtaacccgaccttactctctggctgcccttaacattttttccttcatttcatccttggtgaatctgacaattatgtgtcttggggttgctcttctcgaagagtatttttgtggtggtctctgtatttcctgaatttgaatgttggtctgtcttgctaggttggggaagttctcctggataatatcctgcagagtgttttccaacttggttccattcccctgtcactttcaggtacaccaatcaaatgtagatttagttttttcacacagtcccgtatttcttggaggctttattcgttccttttcattcttttttctctaatcttgtcttcacgctttatttcattaagttgatcttcaatctctgatatcctttcttctgcttgatctattcagctattgataccaatgtatgcttcaggatgttctcatgctgtgtttttcagctccatcaggtcatttatgttcttctctaaattggttattctagttagcaattcctctaaccttttttcaagattcttagcttccttgcattggggtagaacatgctcctttagctcggaggagtttgttattatccaccttctgaagcctacttctctgaatttgtcaaactcattctctgtccagttttgttcccttgctggtgaggagttgtgatcctttggagaagaagaggagttctttttttctggaattttcagtctttttacgctggtttctcccccatctttgtgtatttatctacctttgttctttgatgttggagacctttggatggggtttctgagcgacgtcatttttgttgatttggtgctaatcctttctgtttgttaattttccttctaacaggcccctctgctgcaggtttgctagagtttgctggaggtccactccagaccctgtttgcctgggtatcaccagcagacgctgcagaacagcaaagattgctgcgtgttccttcctctggaagcttcgtcccagaggggtacccaacatatgccagccagagatctcctgtatgaggtgtctttcagcccctgctgggatgtgtctcccagtcaggagacatgggggtcagggacccacttgaggaggcagtctgacccttagcagagctcgaacgctgtgctgggagatttgctgctctcttcagcagccatcaggcaggcacattgaagtctgttgaagatgcgcccacagccaccccttctcccaggggctctgtcccagggagatgggggttttatctttaagcccacgactggggctgctgcctttttttcagagatgccctgcctagagaggaggaatctaaagaggcagtctggctacagtggctttgctgagctgcagagggctccacccagttggaacttccctgcggctttgtttacaccgtgagggtaaaacctaaaaccacctaccaaagcctcagtaatggcagacggcattccccccaccaagcttgagcatcccaggtggacttcagaccgccgtgctggcagcgagaatttcaacccagttgcccttagcttgctgggctctgtgagggtgggatccactgagcacttggctccctggcttcagccccctttctagtggagtcaacagttctgtcttgccggtgttccaggtgccactgggatatgaaaaaagaaactcctgcagcaagctcgctgtctgcccaaatagccgtccagtttatatttttcttaataccattcctcaacaaagtagatggttgtctctgtgctttaaatatggggaaatgggggctcagatgtgagaaatgtactgatattttactgctgtctcatgttggagctctgatttaaatgcagtgtgtctgtctctaaaacccttattcttccccttacctgccaaagatagttaaataatttcattatggacatatatgcccaggcctcttccctctatcttttagggtatcttttttagaaaacagtaaaggtcattaggacttgggccctcactgtcctctcggtactttatggtgtgaaaaattatacaaaaatttgattataatattttcctagggcttctataacaaattgtcatacactccatggcttaaaacaacagaatctttttctctgacaattttggagatcagaatcaaaaattaaggggtcaacaggtcatactctctccaaaggctctcagggagaatacttccttgcctcttccaccttctggtggctcctggtatgccttgacttgtggtagcatcggtccaatctctgcctatgtcctgacatggcctgatccactctgtgtatcacagtgtgccttctgctcttataaagacaccagtcattggatttagggcccatactaatcccatatgacctcattttaacaaattatatctggtgagactttattcacaaataatgtcacattcagaggttcttggtgtatacaaatttgggggtggtactgttcaaccaaatatgggtgggaatgaataattcaataggaatatgaagatacattgaaaagcaggataatagggatagcacattttcagagttctgtgtttctctttgattctacctacccctccccactgccttttctttggaatctcatagttgactgagcctcaaagcatctggacagggagccacaaccactgatgaagggggaggaaaagagatttttcccctttgtcagtctttctctcaagttccttttgctttttttgtccctcatcttatttcagaaagggaaagaacaacatgttcatactgagactccctgaaggagagggcaaacttctgtgataaagaaaaagattaacccagcattatttttcctaccatgtttcatctttagacacttgtcttcagaactcctctaggtatctgtgaaaccaaaagaatcacaagccactctcttcacagtagagagacaaagggcctcagcaaaaaggacactgtggggatgcctacgtgaccattacataaaacccaagttaaaacaaacagcttcacttctttcttttattctagttgtgggtattcctattggactaggtgacttaaaagaaaccttgaaacattggaccacagttaagctcttcattaattttgtagtttaataatgcatttctaaatgatctctctggaacaaaactaagattcactgaatctgtattacttgcctggtgtgctactggacacttttttgcgtagtctcttttgctaatcttcccagcagctctgtgtggtggatcttattgctcacattttcaggtgacaactcagaggctcagagacatcaagtatgctttctaaggtcacaaagtgagcaggtgacaaagctggatttgaactgaggttctttctctttgcaggatgccatgaactctatattcctaaggcacatagaggagagtaatgaatctaataaaatcttcctggaagttttagggaaggcttcattagaaacagacccacatcacactgtgatgatgttgatgatggtaatagtgtcagtgggatagtctctgccatttttggagttcctactactttatgtacaaataatgaaactagatgctctacaaagtttcttcctatgaacactcattatatcaatggtcttgagaatctcctctttagcagaatctgttcagatctgaggaacaaaagactaagccaactatgccaagtttttactctttagtcatggtatcattgtctgtattttactcacacacaccaactggaccacaaagagtttgccaaacctctcctaagtgacagtgctgggatttgtatctaggtctatctgctgccaaagctttgtcttttccattcagtcttagatacatctggaatccattttctttctttttttaaaaataaattttgttgtgtataagttatacaacatgatgttatgggatacacatagatcataaaaaggttacaatagtgaagcatttaacatgtccatcatctcatatacttacccattcttttttttgttttgtttttgtggcaagaagagctaaaatctatttatttagcaggaatctcaaatacagtacaattttatttgattacctatagtccccctcatgttgtacattagatctctagacttgttcatcttacatatttgttactttgtatcctctgacctacatctacccttttattttcttttttcttaaaacaaaacacaataaaaaccgtctattctttagtaataaaagatacgtattataaaacattcaaaagtgcaaaatgagtaaaatacatagtatgcataactcccgtttatcttctcttcaacactagtgtaaattactgtcaatattttaacatgcattttatagactttttctatttatgcacaattatatataaatgatggatatatattatatataatatgtcatatttaatacataatttatatatccaaatagaaaagcacttgattgaattactactttgtgttttatttattgctactgtagagttactagaaaggaggaagctatttcccctctacccctcctccccactttcctctctgcacctctatcctttcttcccatatccttatttagggttttgagtcaagagcagcttccagtcctggaaaatcaagccctctgttactggggcagagttaatacacactttccaagagactgaatcatctagagggagttaggattacagaggttgatgtctggggatgtaaaagtggtccaagctgaagtagttatagcccgaagaaagatttaagaatctataagctcttaaagtggtttacagccagagtgggggtagttccaccaagggtaatagaattttctgtatacccaaagactcagatctccaatactaaagtttctgcccttggcaaagatctcagcacctgagcttagcagagaatcagcagggcttttgacctccaataactttttgggctagatagtaaccattgtgaagaccagatagccctccccaaaacttttgtctaatacccccagaactgtagtgggatcctactgggcacaaaggagtccaataatgaatgagatttagttatcgattctggcacataacgggtttagatttatatttattttgacttagaaaaatgctgtttgaactcaagaactgtgttgtattataaataacatgtctttcagcctaaagcacagattttcagattttacattctaggaaccatcttgttcctagatatgtgttatacataattacttcttaaccccacattaactataaaataaatggtacatatgtatatattatatatatatatatataaaatacataattacttcttacccccatattactatcaaataaatggtttttttcaattaaggaaatatggcatatacctgggatttttatcaaaataactaccatttctaactcccattcttggaagaatattttgtctaagtataacttttgatgagtttttacatccccttcttaacatatggacagagaacaaatgtgttaacttatttcagaactttctccttaataatttttaacagtttgttaagatataatttacatagtataagttttaccccattaaagtatagaatttgattatcttaagtgtattttcagagttgcacagcaattatcataatctggttttagaacatttcttaactgtggtccaatgtttcaaggtttcttttaagtcacctagtccgataggaatatccacaactagaataaaaaaaagaagcgaagctatttgttttaactttggttttatgcaatggtcatgtagaatgtttctatcacctcaaagaaactgatactccttaataatcattacccattctgctgagcttaacccttgataactactaatttacattctgcttctatacatatgcttattctggacattttatataaataggattatataattatatcttttttgactggtttcttttgtttagcatagtgattttgaggttcgtctatgaaacctgttgaagcatctgtcagtattttgttttattggtgaatagtattcaattgcatggatatgctgcattttcttcatgcattgattagttcatggacatttaggttgttttaatcttttggatattatgaataatactgctatgagtatctgtgtacaggtctttgtgtggatttatgttttcacttctcttgagtgtatacctacaagtggaattgctggatgatgtggtaaccctgtgtttgtttgaggaactgccaaactaatttccatagagacagaaatattttacacttccacgagcaatatccaagggctccaattcctccatttcttgccaacttattgttatctatcctttttattttaggcattctagtgggtgtgaagtggtatctcattgtggctttgcattagatttccctaattgttaatgatgttgagaatcttttcatgtgcctcttagccatttctgtatcttctttggggaaaaagactgtttaaatacttttccccctttctaattgggttatattttaattattgcttgctaaaagttctttatatattctagattcaagtcccttttaagatacatgatttgcaaatgttttctcttactgtgtgtcttcaacaattttttgcaaaagaaatgccttgcttcaaagaaagcctctgaagcctcggtattattttctccacccacaaaatcactgtgataaataaatggggatatcaacatgtctttacctggttgtatttcatttttaagctcttctctttagagttccttccagatccccaattcagttacctttctggggggtcttagttcttcttgacctgtctacagcttctgataccaaagctttttatctctgtcctaccttcttttctgccttccatcatttcttccttctttcctttctttcttttataaaggggtatttgtattaggcacttactaaattttagaagcccagctatgggctggagataaagaaaagaaatatgtggtttctattaagagatttgtgctctagtgagaagaaagactttcataatacactaataaatgtaaattataaatgtgattagtcctatgaaggaaatatattggatattatataagaatgttacaggggaaattgcctcactcaaggaaattaaaagttctttctctgagaaggtgaagacatacttgagatctcaaggataagcggatattacgtaggatgaagagggaagagcatatgaaaatgcttatgatgagaggtaaaaaggaacttttgaggcaggagacaaagccattgtgcttgcagcttagcagacaagaaggggaatggagcaaaatcatgctgggcacgtaggtaaaggcaagagcatactgggctgagagtaatgttaataatgtttgtctgcattttaagaccaatgggaagtatctgaagagctttggccaggtgtggcaaaatgataagacttgaattcctaaaagattgctgtaagtgcagtatgaaaaataaattgcaggtgggcaatggggaatgtgaggagatgcattgggaagctatagcaatagcccaagtgagagatgttgataacttggataagcggaatggcaatggaagtggaaatgtgcaaatgagtttgagagatacttaggaagaaaaattagcaagacttggtgatggattgattacaagagattaagggagaaggaggtatcaagaatgaataataactgcacggttctgctgcttctattttttttgtttgtttggtttttttgtttttgagatggagtctctctctgtcgcctaggctggagtgtagtggtgtgatcccagctcactacaacctctgcctcctgggttcaaatgattctcgtgcctcagcttcctgagtagctgagattacaagagtatgccaccacacctggctaatttttgtatttttagtagagatggggtttcaccatgttggccaggctggtctcaaactcctgacctcaagttatccacccaccttggcctcccaaagtgttgggattacaggtgtgaaccatggttctgcttcttctgacatagtttgatagtggctaccctggtttgaatctaccatcatattaatataatattaggccatatacaacctccctgtccccatttattcatttagaaaatagggatgacaataatacttaattgatatggatgatataatgcacttcaacagtatctggctcatatagtatgagcataataaatgttactcatgaaaaattcaaattattattgctgtttagaaaagaagcaaaggagaaaagtgactaatttctgaaaaattaaatacactagagtcttttggttccaactcagttagagcagtcccagtccttctaggttcttcctcttacaactaaaaatcgcctggacataaccctactccaatcctgtggcaataaaaaactgcttagtagaagcagttggtgctgagattcctctactgaagtaaagtcactggagttcagcagggagctgagccaccacttccatgcagaaacatggagactcaataaggcagtgcaaggcagggctatttggccctcactttctcccaaatccattgttagtgcagcccatcagggaactggagctctacctccacccagcattgacaaggtggtataaggtggggctaacattatacttcgtggtgaaagactgaatgcttttctcctaaatttggcaacaaagcagtgatgtctgcacttaccactcttgggcaacatagcactggaagttttagccaaaacaataaggcagcaaaaagaaataagcttgcagattggaaaagaacaaatcaagctgtatctatttacagaaggcataattttctatgtagaaaatgtcaagaaattataaaaatgttgtagaactaataaatgagttcatcaaagtctcaagttacaagatcaatacagaaaattaattttattcctatatactagtaactgatgtgtagaaactagaattaagcacctactatcatatataattgctccaaagtaaaatgaaatgcctaagaaaatgaaatatctagttaaaagtctaacaaaacatttataggatctgtatgcttaacatttaaaaaaacactaatggaaggaataaaatattatataagtaaatggagaggcatactgtatccatggattagatgactcaatatagtaaagatgtcaattctccataagttgatctgtaaagtttaacataattcctaaaaaaattccaacaagcttaatctgaaatttgggtagaagtgcaaaagaactagaatagctaaaataattttgaattgaataattttgaattgaatattaaggatttttttatagatactgtaatcaattgaatcaattgaattgaatcgactgaatcaattgaattgaattgaattgaattgaatcaattgaatcaattgaattgaattttgaattgaaatttgaattgaataattttgaattgaatattaaggatttctttatagatactatattcaagacagcgtagtattggcaggggaatagacacaaagatcaatagaacagaatagagaccccagaaacagacaaatacaaatataacaaattggttttgacaaagttattaacacaattcaatggagaaacagccttttgaacacatggcactggagtcactgggtgtgcataggcaaaaaaattaatcccaacctaaaccttataccttatcaaaaattaactcaaatgtatcatgggtttaaatgtaaaaatataaaactattggaaaaattaggagaatatctttggaacctaaggttagagaagagttcttggacattacattaaaagcactatatataaactaagaaatgattaattcattgtcatgaaaattaaaacttttgcattgtgaaagactgtgatagaatgaaaatacaaactgcaggctgtgagaaaatattggcaaatcccatatccaataaaggccttatacagggtgagtatcttttatctgaaatttctggaccagaagagtttcagatttcagactttttcagaatttggaatattttcattatccttatctgttgaacatcctaaatccaaaaatttgaaatccgaaatgctccagggagcatactttgacaatcgtgtcagcactcaaaatgttttgaattttggagcaattcagattttcgatttccagatttaaaatgctcaacctatatgtaaatatgaagaattctcaaaacttaacagtaaaaaatcaatccagttataaaatgggcaaaagacatgaacaaatattttattaaagtgtagatacagatggcgagtgaagatatactcaacaccattggcagttagcacaatataaattaaaaacataatgcattatttctatacacccatcagaatagctaaaacaaaaaatagtgacaacatcaggtgtcagttagggtatggagaaacgatcattcagacattgctgatgagaatgtaaaattacagccattctagaaaatcatttggtagttttcttggaaactaaacatgttcttaccagatgaccctgcaatcacactttcggatatttatcctagaaatgtaaaaatgtatgttcacaaaatacttgtacattctttaaatgagaaactatagatatggagaacaggttagtggttgacagtattagggcgggtgggtgggaaaggttgagtgggtgcaaataaaaagagattgtgttggtggttttgtgaattttacatgagataatattgcatagaactatacacatacataatacatacatgcataaatgaatataaattaaaatggtataaactaaattatatttgtagactagttaacagtaacatgctaatgtcaatcttctgattttgatattgtactataggtatataggatgctgatatggtttggctgtgtccccacccaaatctcatcttgaattgtcattcccataatctccacatgtcgtgggagggacccagtgtaaggtaattgaatcatgagggtggttatctctatgctgttctcatgatagtgagtgcattctcatgagatctgatggttttataaagggctatttccccacccttttctctcacttctccttgtggccaccatgtaaagaaggacatgtttgcttcttcttctgccatgattataagtttcctgaggccttctcagccatactgaactgtgagtaaattaaacttctttcctttataaattacctagtcccagctagttctttattagcagtgtgagactgaactaatccagtaaattggtgtagagagtgaggtgctggtataaggatacccaaaaatgtggaagtgactttggaactgggtaacaggcagagattggaacagtttagagggcttagaagaagattggaaactatgggaaagtttggaacttcctagagacttgttgaatgactttgaccaaatgctgatagtgatatagaaaatgaagtccaggttgaggtggtctcagatggaaattaggaactggttggcagctggagtaaaggtgattcttgtaatgcttcagcaaagagactggcagcattttgcctctgccctagagatctttggaactttgaacttgagagagatgatttagggtgatttgtggaaggaatttctaagtagcaaagcattcaagagaaagcagagcatgaaagtttggataatttgcagcctgacaatgtaatagaaaagaaaactgactttctggggagaaattcaagcccactgcagaaatttgcataagtaataaggggctgagtgttaatcaccaaggcaatgggaaaaatgtctccagggcatgtcagagactttcattgcaacccctcctatcacagagccagaggcctaggagggaaaaatggtttcctgggccaggtccagggcctcccctctgtgtacagcctcaggactttgttcctgatgctccaactatggctaaaagaggccagggtacagcttttcccattacttctgagggtgcaagcccctaaatttgacagcttccatgtagtgttaagcctgtaggtgcacagaagtcaagaattgaggtttgggaacctccacctagatttcagaggatatatggaaatgcttggttgtccaggcagaagtctgctgcagaggcagaggcctcatggagaatctctgctagggaagtgcagaagggaaatgtggggttggagcccccacacggagtcctcactggggtactgcttagtggagctatgagaagtgggccaccatccttcagatcccagaatggtagatccactgacagcttgcactgtgtgcctggaaaagttgcagacacccaaaaccagctcatgaaagcagctgggagagggtgctgtaccttgcaaagccacagggctggagctgctcaacaccatggcagcccacctcttgcatcagcatgccctggatgtgagacatggagtcaagggacatcattttggaacttaaaggttttaatgactgccctattggattttggacttgcatggaaactgtggcccctttgttttggccaatttctttcatttggagcacgtatatttgcccaatgcctgtacccccattgtatctaagaaataaataacttgcttttgattttgcaggcttataggcagaagggacttgccttgtctcagatgataccttggactttgggttttgggttagtgctagaatgagttaggactttgggggactgttggcaaggcatgattgtattttgaaatgagaaggcatgagatttgggagaagtcaggagcagaatgatatggtttggctgttttcccacccaaatctcaccctgaattgtagttcccataatgcctatgtgttgtaggagggacccagtgggaagtaatttagtcatgagggtagttacctccatgctgctcttgtgatagtgagtgagttcccacgagatctgatggtttcataaggggctattcccccctccttcaccctgtacttcttacaaccaccatataaagaaggacatgtttgcttccccttctccatgactgtaagtttcctgaggcctcctgagccacgtttaactgtgagtcaataaaactactttactttatcaattatgcagtctgagatatgtctttatcagcagtgtgagaacgagataatacattggggaaaggtaggcaaagggtacattgggggaagctaggggaaaggtacattgtgggaagctgagtgaaaggtacattgggggaagctgggtgaagggtacataggagtcttctttcttcttttgcaacttcctgtgaatctgtaatttttttaagtaaaaaattacctacactgtggccaacattgtagcaattcttttggatgacatagtaaagtggacttttagaaagactgtaggagatggaatgaggagagggtagtttgagtttcagaagtacaacctattattgatatttatgtgcttataggaaaagtgccttacatgcttcaactcctaatttcttcatctataaaatgttactgatagataaaatctgcttgtcatgtcctagtccagtcattgttacaattttttaagatatgtaaaaggttactttgaacaaaataaagccacaagccagcagacccccaaacgtggggcatttgtagccacagtagaaatgtttgtcaggtagtcgtttgggtcctgattggtttactaaggacagcaatgtgtcaattgatcatggctactgacgccagagtcactgttacagggttggatttattagagccttcctgagactttccatggacaggaaatgagaaggaagaagaaaggaactatgtgataatgactgtttaattagtgcttgaatattagttaaagtattgttatgatcattattattataatcagtgaagaaatagcttggtgtgacaatcatcattttttgtcctgataagttggatatttcaaatatactatagccaaacttaggttatacatccatcctaaatgtgtatttttcacctttctaatccatagtcttatttcctggggactataattgattctaagcaaatatttctttggacctgcaaagaggcattctaatttaatttgcttcaaatgcctatctgttcacaaccattctgcctgaactattagctgtaaaagaaagagaaagatttctcgatcaatttttaaatttttttaaaaattgacatgtagtaagtgtacatatttataagatacagaatgacatttaaatacatgaatacaatgagtaatgatcaaatcagagtaattagcttacccatcacctcaaatatttatcatttctttgtgttaggaaaattcaaaattctattttccagtatttaaaaatatgcaataagttaccccaggggtaaccataattaccctacagtgttatagaacactacaacttattctttagctataattttctgtctcctaatcaacctctctgtatcctcctctatctactatcttttccagcttctcataaccacaagtctacactatacttttgtgaactcaaatttttaaagtcccaagtatgagtgagaatacatggtattcatctttctgtgcatgacttattttatgtaacataatgtcttcaaagctcatcgatgttgccactaatggcaggattttattctttttattactttgtagtattccattgtgtatacatgacacattttgaatccattcttgtattgatggacacttaggttgattccgtatgttggctattgtgaataatgctgcagtaaatatgggggtgcaaatatctcttcaatatatagatttttattcctttagataaacacagtagtgagattgctggatcacacagtggttctatttttagtttaagaaacacccatactgtttttgataagggttgtactaatttatattccaccaacattgtatgagttctcttttctctccgtccgcactggcatctgttagtgcctatcttttcgatataggccattttaactggggtgagataatatctcactgtacttttgattttcatttccttgatgattaatgatgttgagcattttaaaaatatctttgttgtccatattgctgcctgcttttaaaaagtgagtgttcagattatttgccaatttttattttgggttatttgcttttgtgctgttaaattatttgagttccttgtatattctggatattaatcccttgtcacatgatagcttgaaaacctattgccccatttcgtaggttgtctctatactctgttgtttctttccctgtgcagaagcactttagtttaatataattccactcacctatttttagttttgttgcctgtacttttgaagtcttaccctaaaatctctgcccatatcaatgtcctaaagcattttccctatgttttcttctagtagttttattaatttaggtctcacatttaaatatttaatctactttgagttgatttttgtatatagtgagaaataggggtctaatttcatttttctgcattatgaatatccagttttcccagcatcatttaaggaagaggttgtcctttctccaatgtaagttgctggcacttttgtcaaaaatcagttggctgttttattagtctgctctcacattgctattaagaactacctgagactggtaatttataaagaaaagaggtttcattgactctcagttctgcaggctgtacaggaagcatggcttcagaaaccttaggaaacttatggtcatagtggaaggtgaagagatggaggcacaacttgcaagacaggaacaggaggaagagagcaaagaggaggtgctacacacttttaaacaaccagatgtcatgagaactcactatcatgagaacagcaattgggaaatctgtccccatgattgagtcacctcccaccaggttctgcctccaacactgaggtttacaattcgacatgaggtttgggcagggacacaaatccaagccatatcagctgtaaatacatgaatttattattgggttctctattatgttcaatcggcctgggtatctgtttttatgccagtatcatgctgttttggttaccatagctttgtagtatattttgaagtcaggtagtgtgatgtcttcagctttatcatttttgctcagttctgctttttggctatttgggatcttttatggttcctcaagttttaggctttttttctatttctgtgaagaatttcattgatattgatatcaacatgtcattaatagctattgcattgaatctgtagatcactttgaagagtatggtttgtttaacaatattaattctttcaattcatgaacatggaatagttttacatttttgtgtgtcctctttagtttcttttatcaatgttttgtagtctttattatagagatctctcacctccttggttaaatttattcctaggtgttttttttgtagctattgtaaatgcatttgcattcttgatttctttttcagctagtttgttgctgatgtatagaaatgtacccatttttatgtgttaattttgtatcctgcaactttactgaatttgtttattagttctgagatttctttttggtggagcttttgggtttttcaatatataatattatatcgtctgcaaagagggcaatttgacttccttttttcctatgtggattccctttatttatttcccttgtctaattgctctggccagaactttgagtactatgttgactagcagtgctaaaagttgttatctttgtcttgttctagttcttagggaaaatatattttggctttttctgattcagtatgatgtcagctatgggcttgcctatatggtctttattgtgtctgggtatgctgattctatgcctaattcattgagagtttttatcatgaagtgatgttgaattttaccaaatgctttctctgcatctattgagatgataatatggtttttgtccattctgttgattggacaatgttgtgatttatgtctcacatttattgatttgagtatgttgaagcatccttgcatctccaaggtaattactacttgatcatggtgtataatctttgtgttgtactgttgtattcagtttgctagtatttggtcgaggatttttgcatctgtattaatcagggatattggcctttaatttgctttctttgtaatgtttttgtctgattttagtatcagggtaatactggacttgtacaataagttaggaagaattaccacctcttcagtttttgtaataatttagaagaattggtagttaattattttctaaaagtttgatagaattcatcagtgaaggcatccattcccagggttttctttgctgggagatttttttgttactgtttcaatctctttacttgttattggtctgtccagttttcctatttctttctgctttaaaattgataggttacctgtgtccagaaattcatctatttgctctaggttttccagtttgttggcatatagctatcataatagtgtctaatgatttttttgttgttgttcaggcaaggtctcactctgttgcccagggtggagtgaagtggcatgatcagggctcactgcagccttgacctcccaggctcaagaaatcctcccacctcagcctcccgagtagttggaactgctggtgtgggccaccatacctggataatttttgtagtttttatagaggtggtatttcaccatgtttctcaggctggtctctaactcctgggctcaagcaatctgcctgcctcagaactcccaaagtgctgggattacagacatcaaccactgtatccggcctagttgaatgattctttatatttctgtagtattagttgtaatgtctctcattttcagtttcttgattttatttacctaggtcttttcttatttttccttagtctagcgaaaggtttgttgattttgtttatcttttcaaaaaacaagctttttgtttctttgatcttttgtattttgtttgtttgttttgtttttgtttgttttttgagagagtcttgctctgtcgccgaggctggatggcagtggtgcgatcttggctcactgcaagctctgcctcccaggttcacaccattctcctgcctcagcctcccgagtagctgggactacaggcacctgccaccacacctggctaattttttgtatttttttgtattttttttttttagtagagacggggtttcaccatgttagccaggatggtctcgatctcctgacctcatgatctgcctgcctcggcctcccaaagtgctgggattacaggcgtgagccaccacacctggctgatcttttgtattgtttaagtctccattcagtttagttctgctctgatctttattatttctttccttctactaattttgggtttggttggctcttgcttttgaaatcacttgaggtgcatcattagattgcttatttgaaatctttctattatttttatgtcagcttttattgctataaacttgccttttaatactggttttactttgccccagaggttttggtatattgtgtttctgttttcctttgtttcaagaatttttatgatttccatcttaatttcttcattgacccagtggtcattcaggaaccactgggttcctgaaacttgtttatattccatgtttttatataattttcaaagttcctcttggtattgatttctagttttgttccattgtggtctgtgaagaaacttgatatgattttaatttttggaaatttgtttagactcttgtgatctaacatatgttctatcctagagaatgttctatgtgctgatgagaagaatgtatgctttgtcgttggatatattgttctggaaatgtcttttatgtctatttggcctaaagtccagttcaaatccaatctttttttgttgatgttctgtctagatgatctatctaatgctgagagtgggttgttcaagccccctatcattattgtattggaatctcttctctctctctctctctttctctttctctcttcagatgtagtaacatttgctttatgaatttgggtcctccagtgctggatgcatgtgtatttacaattgttatatatacttgctgaattgattcccttatcattatataatgagattctttgtctttcttttttcttttttttacttaatatctatttcttctgatataaacatagctacttctgctcacttttgatatctatttgtgtggaatatattttttatccctttacttttagatggtgtgtgtttttacaggcaatattagtttcttatgaacttcaggtagttgggtcttacaaaaaatccattcagcccgtccatatattttaactgggaaatcaaaaccattaatatttgaggtttatattgatagatgagtacttactcctcttattttgttaattgttttctggttgttttttataccctttgctcctttcttcttctcttattgtttatttttgtggtttggtggttttctgtaatagtaatgtgtgatcccattctctttgtatttgtttatctgctctaccagtgagttatacatgagtactactttcatgaaagtatatgactcaaaaaatatatattgccctacacttcctgatgtaggactttgttaagcttttctcgtagatcaggtctactggtgatgaatttcttcagtttttgcttgtctgagatagactttgtttctccatcatttctgaaggttagtttttctgtgtataggtttctttggtggcatttgttttttctttcatcactttaaatgtatcataccattctttcctggcctgcaggtttctgctggaaaatctgctgttagtctgatggcatatccttatatgtgatttgatgttttcctctcagtttttagcattccgtctttatctttgccttttgaaagtttgactataatgtgccttggcaaggaccttcttgggttacatttatttgggggcttttagctttctaaatctggatggtcatatctctcctaagtattgggaagtttttagctaatatttttattttattattattattttttgaggcaaggtctctgtctatcgcccaagctggagtgcagtggcatgaacatggttccctgcaaccttgacctcctgggctcaagtgatcctcctgtgaagttatgaccacagttgtatgccaccatacccagattttttttttttttggtagatatggcacatcaccatcttcctcactctggtctcaaactccaagctatcctcctgtctcagcctcccaaagtgctgggattataggtatgtgccaccatgcccagcctatggctattttttaaaaataggttttctatgccatttcccatcttttcttcttagaacttccaaaattcacatatttgtttacttaatggtggcccatatgtccttttaggcttaatttattcttttaaaatgtcttcttatttttgtctgactgagtttcttcaaaagagctgtcttcaagtttagaaattattctgcttgaactagcctattattgacattctcaattaaagttttatttcattcattgaattgttctctttcaagatttcttttgaagcaaggttttattttgcaatatctatctctttgttgaatttctcattcagatcaggcactgtttttctgattttgttgaaatgtctgtgttctcttgtttcttgctgaatctccttaagatcattattttgaattcattttcagtcatttcatagacttcatttgcttttgtgtgttggctccctctgtcctggggtaagcctctttgctgtgctgaattgcctgtcccatgggatatagggtgctacacaggctcagatgctatggtaatggtatcatttctgtgtccatctcatgtcacgatgctgcaaccttctgggtgtatgtggtgggatggcagcaggaccccaggaatatggacatgcagggactactggatcctatgaatggatacattctggtggcagctctgctcttaaaatggtattgtgcttcagcatcctggatccaggggagtgcaaaggactcagtgtgttttccctctcaggaaatatgaagttgcttggactccaaatgctccctatgctgggatcagggcctgtaagggctgtgaggctcttctgtacctagaattgttggtgtccatggtgagaatatggctgctggcaatctcccactttcttttttcccacaatgggagttcctcttggcttgaaacaaattgataccgggtgctttgcttttctctctgtaatgcctttttaagtttctgtaccctaaaaggtcttcataacttctctactgaatcccagtattcttccttaaatactctgtttgatttgtggttatctactggttgttgtggtcctttgtcagggaggtgagtgctggacacctctatttaatcatcttgataacatctgtctcaattcagttgtaaccaccatcctatgattaagtctgcccacaagtaattgtcgcagcaatattagtagaattagtagtagtagtagtaatagtagcagcagcagcaatgacaatcaaatacctaacacttgtggagcacttaccagctgtaacatgctgtcataaattttctacctatattaattaatttaattctcaaaacaatcccaagtgataggttctatcattgtccacattttacaatgaggaatctaagacagagaggttgggtaacttacttaagtagacataccttgcaattggcaaaccaggatcttctaaactaggccggtgactttggagttcatactcttaacctctatgccagtccgtctttcgcaatcacttgtcatatcttttgcagcatccttggcaactggaaaggaatgtgatatttatagaagaaaatggtattttctttggctgtctctattaaacacagttttgaaggtgctggtcattttgaaaacttgggcatgactaaagaaaatgaaatgtggaagttctatggcctttgttctttgggaataggtcatctattctcagtaagtatgtaggagatcccagtaggaattgggggcaaaaatacaggaagacagttcgttgttggcattatgatatcatttccacatttcatggtttagtttcagccacatccaaattaacttgcaactgctcagtagtgacatgtttgttcatctaatgtctacattcacaatctgagtttctctacttaccagttctatgatcttaggaaagttatataaagtactgttgtctaagtttcttcattgtaaaatgagcaaacttacttcatttaattgctgggagaattaaatggtataatatgcctaaaatattgacttcagtgcttggcattctctaggttcaataacattatggaagatattaatagataaagtgaaggttgtggaaaatatgctacaattcctctcctcaaagtcaattatggcattaatgacaaaatttgcaaatatcatcacaatatattatgatatcattgcctccaaagaggtaaagatattaaattttataaaagttctaagatagatgaaattcatggtctagagaaaaagtgtgtaagccttcatgaacatggtaagagtatgggtttgaagtggtgtctgaagccaggcaaaggcagataaaccaactacattgtgagagagtattgtgggtcaacgaaacaacatgaaaaactagagaggtagaaacaaactcgtacatttgtaggacagcaaagatgccacctcattagagaaaaagatttacttcaagaatattggaagataagacctggtagggaaggatagaccaggcttttggaatgctgcacagaaccatacctttctccatacttaagtctgcgtgagcaactctaattgagaaaccttgatcatttgtgaaagattatttaaaatattaccttttgcaagaggacttttctcttctctccattagaaggaatttcttccctccaatgaactctcagtctagcttatctttattcctcttatctagcatgaccacacatgctagtttgcctgggtcattctgagttatgcttgttatcccagtgtaattattagtagagcaccctttcattctaaaatatgttccttttgtatgataaaataaaaggtcaactacttataactcttatcacttatcttctgtgttccggttagttacccctattaaaacgttcaggctagcaaagaccattatctactcatctttgtattcccagtacagaacataataattatttattaaatgaatttaaagaaggaggctgaaaactcttggagtataagtctgaatccttagacttttttatgtttctaaccttgtctgctattgcacctgcaaatactaggtacttgataggtttgtaaattcgagtggacatgcacaagggtatactgtttctggagtgtgccggagatgacttaagcacagacttgaagtgtgtcctcagaaatcttatcttcttttctcaccgtttgctaacctgtgcacatttcttgctgacagtttgggttggtcttaaggcctaaataaaaattttatttggaaaattcaactattaaatcaacaatcagatgcatgtgtgtgccctacctctgttgtgtgtgtgtgatgaaaacagtcctattttgtaggatttaacctttctcattactgggtccccattaggaaatttaaaataaaaataaatgaagattgatggtttttcaaatgattggtacattggttgaataattcacttaacaaactatattgaattttttgttttgttccaattagtgttatttccttgaggtttctaactggaatttctattcttgttttataactatttatgatttgaatggccctactggatttttcttcttaaaatttgtgagaagttatgctagcagatgttaaaaaggaataaaggatataaactttgccatattgtttagttatagaggagtcatttgggtaactccgttaacttgctgagtgtgagaggaaattatagttatctatgaaaccttagtttctaacttggaatcttttcatctgttttctagggttagatcggtttccctccatgtcctgtgggtcaaggatgccacagctatctgaatatatataacccatatcactacatggcaggcagatacgcagaggttagattctgaaccctatgaaagtgggctatatggaaaattaaactgctgaaggcccttaaacagaggcctcagagtaaatccttttcctactctcagcacaatcctgtgctcgccagccttccctgtgaccagtggtactccttcaaaaatttttttgggaaattctcctttgctaggctatattcaccagcctttctctgcagttttatcctctttgttctaaagaagccatgcaatctctcatataggtttgtttcttttcccctctcccctcccctcccctctccttccctcccctcccacccctccttccctcccctccctcccctcccctgccctcccctcctttcctctcctcttttttgtaacctgaggggaaggtttccaattgtggatgtttttcagcattgtggacattttaggctggctagttctttgttgttttgagctcttctgcacattgtacaatgcttagcagcattcctggcctttattccctagatttcagtatcacttcctgttcccaatcatggcaaccaaaaacaccctctgacatatcaaatgtttgcaggatgaggcagtgcaaaattccccctactaagaaccattaccttggaatctctgtgaaaacctttttagaaggtggaagaaacaacggccttagtgcagcacttaccaattgtgtgacggacaggagttgtttgacttctctgatactgtttctttacctgcaaagtagggataataacatctttctttcagagtttagatttcaacaggaacttttaggcgcatagtaaggtactgacaagtggtagtcactgtcattcttatttggtgaattccagctacatttcccaataccagtaattccaacttaagaaaaagtatttctctttttctctcaccctggaaacagaacacgatgaatgtggcagcggccagcacaactgtgatgagaatgccatctgcaccaacactgtccagggacacagctgcacctgcaaaccgggctacgtggggaacgggaccatctgcagaggtaggcttgccgccttagtgttgagttgtgagcagccattctgcctgggctcttggcacttgtgcgtcggaccttcttggtaactcttggtggaacacagccagggttcctgctcctggtttatcaactggcaagggtactgtgcgtcagggaaaaagaaaaatgcttcaggtttagctttggagttgaaagaaaaaggtataggtatgggtcagggacacagttacataacttgatggctctgttcagctttgcctgttggcatgagtttgtgagggaagcttggattgcggatattggcttttctttcctgtgagattttccccaagggcaagtggacactgtttctgtccacacttgaggtatctgcttgggtaggaaacttacagttttagccttgctcagcgtctgggagcagtttatcaattcagaggccagcgccctggcttcccttagcatttagaataaaaataaaattcctccttctggcttatgagggcattcagcatctggtccctggctcctcacagctgacacctctctttcctctcaccctgaatccctttacctcagcctactgggtccctgttattccttcagcattgttgttgcctcagccacaatgctcatttctttcatgtctctactcaaatgtctcctcatcacagaaatgttctttgaccaccctatctaaaatagtacgcttagtacttcttagcccacaccaggcttgatttttttcttcacaaacaacctgacagaacatcacaggtttatgtgtttgcttatctctgtgttatctgcctccccactaggatgtaagctccatgacagtgaacacttggtcttgtccccccactgtccctggtgtttagatattatctgcctccccactagaatgtaagctccatgacagtgaacacttgatcttctccccccattgtccctggcatttagagtgtgacttgcacacggtaggtgcttgttcactatgtgttaattcaccaaatcaccaaagaggaaaggcacaatcataacgaaaaaataggcaacatgaacaagaaaacaaaagacatcctatgaggtaggtattattatccttattttagaagtgataagattgagacacagagaggttaaataacttgcccaaagatacatagtaaacacattgtcagtattcctctgcagggatgaaatgctggtaatgagtgaaaaataatttacaacgactaagtcactatatttatggattggattggggaagaattttaaaagatcaattttattctgtgttggttaaggtgaggtaagcagaaagcctaatacatgactatgagtgtaaattggtaaaactcatttttttttaacagcaatttgacaaaatttatcaacattcaaagtacgtattctactgattccatcaattttacctcttgaaatttattctaaaaaagcacaggttcatgaagagggggaaatgtgcatagaattttttttgcagcactgtttatattcactgaaaactggaaacaaccaaaatatccatcagtcttggaatgattaaatttatcttggcatatgaattttatagagcagaatgctatggtttaaaactctaaacatttgtatgtacacgcacgcacacacaaacacatacatacatgtacacatcacattgaaagataccctacatatttttgagaaaaaataaaataaattcaagttcagaacaatatagtatcatcaaatatctaagttaatatttataaatatctatatacatatttatgtaaatacataaagactggaaacatgcaaactagtcaccttattgcccatgtgtgtgtgaaaaaagaaaattcacttattgctatgaactccatgttatttgcacttcttccagtggtcttttatatgtgaatatttgtgcgtattttttctaaagtaccctgaagcaaataaactagtgctcagcttttttaaaaggctaaggaaatttccaaagcaaaacaaggaaacaaaaacgttaatgtaattccagggattatcaagcccactgctggtacctgcatgctagtgctataaatctgaggagcaacatagggattttaatgcactttttttcagaattatgttacctcataaaataatattaattgcccttgtccagtgagtttgtatttgccgagtcctctcttgccattgtgataagtggtggtttcaccttcgtagaattttgtaagtccagctgtgaaaaaatatgagtttaaataatgttcctgatgtccgcagactgtgaggggaaacatatcttcccttgaaagttatgaattagggaaaataattttcttaaagtgattgtcataatcaattgtgttgacctcagtaaggaaaagtcttgtgttttataaatgctgcatgggaaagcaatgtggtatagttgaacaattggataaagagcttgtactcttcacaccttctttcactactggttctttacactggctttcattactggtgaattgtaacttctatatttttacatattaaaatttggttaaggccaggcgcagtggatcacacctgatcccagcactttgggaggctgcggcgggtggatcacctgagggtcaggagttctagaccagcctggccaacatgacaaaactccatctctactaaaaaaaaataaaaaaaaaaaaatatatatatatatatataaattagctgggcgtggtggtgtccacctgtaatcccagctactcgggaggctgaggcaggcgaattgctcgaacctgggaggcagaggttgcagtgagccgagatcatgctactgcactccagcctgggggacagagcaacactccatctcaaaaaaaaaaaaaaaaattgattagtattactttccctatttatctaacagtattattgcatagaatcactaacggaatttatatttggtgttttaaactgtaaaatgctatacaaactaaagactagtattagccttataataaagaagaagaaagaggaggaggaggttggcagtttatggccttctgcctgaaataaccaaatttgtgtctcaatttcagggcatatattttatagttaactttgccaccttgtaactgaaacatttacagtgggagttggacaagaataaccagacaacttgaactaagtcttttttattttcactttttatttttttgagacagggtcttgctctgtcacccagactggagtgcagtggcttgatctcagctcattgtaacctctgcctcccggcttcaagcgattatcctgcctcagctactgagaagctggggttgcagatgtgccccaccatgcccagctaatttttgtatttttaatagagatggggtttcaccacgttggccaggctggtttccaactcctgacctcaagtgatttgcctgcttcagcctcccaaacggctgggattccaggcatgaggcactgctctcagcagaactaagtctttttaagtgttaaatatagaaaagcttttctaggcagacatggtattgttcatagacttgactaaatctggttagaagtaaatagttaacatgcctttttataagcattacataagacatcagtttctgaaacaatactaattggtgtgaattctctcagatgggtttccgtggtggtcgatgcccatgtaaggcgtcttttcttcttttggatggaaaatacttgttcagctacaaaaactctcattaagtatgtgcaagacaccttgatgtgtgtattcatatatatgttatctcatttagttcccaccataatcttgagaagttgatgccattattctatttcacaagtaaattttaagtaagacgtagttgaatctgatttaactcaactagtggaactgcttttagttttttccctccctttcctccttttctttgtcctcctccttttccttctctttttatttcctcctcctctcttggctgtttatcatttaactctctccctcacacattgtattctaactagaaactaaagagaaaatagaaagggaagagagcatacaatgataacctagaatttttttaaaaattgctcacatatttaataaatagactaaagtcattctgaaactatacaatatgttttgcttaatagtttggcatttgagtttaaatggacaaaatgcttgcaaacagtttcaagtcagatttgcattacctgacatgaaggttaggcttatcagcagcagagtgtttatctgctttcccagtcctgcattaatgccaaaacagaaagtgagctttcactaggcagttgtcaatatgcagctgatagactatgtcttctctcttatctgtcattagctctggataggatgtggtgatctttgaaagcattcttgtcttaatgactgataatattaacatttatttataaaacatacagtgagtgtgaattctgtgtctgggcaccaaaagagcaaaaataaataagacaagtccccagggatttcaccatttagtgttggggaaagattttaacaaattcttccaacccaacggaacatttacaaaatggtattatctcgcgtgaaagaggcttgaaaagaattacccaaaatacagagctatgtgtaaagcatatgcattagttaggattcctttggttgcaagtaatagaaatccactggcaaactggctatgtaacttgcagaacccagagaaaaatgcaagcatgggctcctagttcgaaaagcaggaaaaacttgcaaattaaagatactgaaatacaaagctttgaaattttcccatgatctctctcttctcctgtcgtggagttttgtagttgctatttaatgttgcttctttaggcttggggatatttttggggtgaatgttaaccctgtaggagcttcaggcccatcttgccacttggtatattcatgtggcccaccaactttggggtttctcactccctgaccagtgcaccatgattgggcgtgggacagggaagttgaatcaagtatctccccttctctcaagatatcttcaaaccaactttaacgttgactgcctttcaaagaaaatcactacagtaaaattcaggtcactgtagaaactccaggaacataggtgaaatctttattttaaggctctccagaatcctgtagtgctctgaaaccattcattatgagtatgtttgcattgagtgcatgtgcagacaagctgcttcctggaagtttctgtttgatgagttgctggataaactgtgtacaaggaaaacacagaaagccagaagcagaaggccagaggtttgatatagacagaaagagtaatgtgacagatcatgctaaagatgtaaacaatcctgaattaaataagtcaaatagacatctcacatgtacaaagttgtttttcagaggctcacaggcaatatgagagaaagggagagggagagggagaatagaaaggtaagttattatagtaaggtatcaccaaggataataaactttataaactactgggctgtgaatcggagaagatgaaatttggggagtttgaagaagcaagtggaataggaagcctttggcaaaagtacttacagcactctagacatagttttgaaacatggttaatgtaatgaggaagaattcaggaaggtgccaatctaaaagtctgcccttaggtgcctttatttagacaaaatattggaaagaatgatgaggggcaagactgtctgatatcaggggatggtttggctcaattagggccaggtccatctgtaaaaacacattcatattgaaaaacgggaggattgtaagcatatttctaagagtgctcctctggttatagagcaatttcataacagtttaagaaaggatttgagactgtaccccacataggattgatttataaagtcagaaaacaggtagattagaggtggcttagggtcggactcaatcaatcagaagaatctttgcagcaagtgtggactatgctcattataattagagccagttaaaatttcccacctatagagactgatggagcggggaggtatatctttggtagtgtttaagcttctcttaagggtcatattgaaataactggaccaggtgatgttactatataagaaatttgactttcgaatttctttagaactattagatgatttgaccataaatcataagcgtaaagacaagattgatgtgaacatggatgacaaaaatcccttttaattaagtttaaggagttatcacaaagtgctcttaacacagggatacaaatttttaacatacaatggtaagaattagtttgtcaagagtatgcagagccttaatgtcatgcttaaatggacatagactgaaggagtgggctacagaataatggaaaaacatacaattttttttctcttaatctattttcttttgaatgaagtctaaacttattagcaaggcactcaaggccctgtgacatgtagtcccatatgaatagtttgaacctcatctcttatgatatcatctttccccattaccttgccagtcacacctgagagttaactaatcattctcccaacagaccaggccagatggatgatttcatgggccctttccctctccttgggatcatttattatactggagtgcttaattctatcctctcttcttccaactgaaatcctattcatccctcacagtccagctcaaatcccatttttccttgatcttctgagtcagaataaattgtttgtcctctgaattttgcttgtagtattcaatgtattatgtcttgttaaacttagctgtttatatttcagcctttaccacacaaaaccttgtgcataatggatgctcagtaaatacatagatgcaaaatgagaattgaccagttgatttaatgcaaatcaacctgctcttgtagcttggtgtattaattactgcagaatctacaccattattctgaaaaatcaaagacaaattaaaattgtgaagcaaatttttatgtattacatattttaatgttttggaaaatcatcagtggacctgctatttaagttcaaagacattgtctgttgcatacagaaaatttattctattttatgtttaatgcctatagatgctgaaagtcctatagacactaaatatagttataccagaaatgataaaatcctttggcctaatttgagaggcaataattaggctaagtctagcttcctttttgcataatgtctgtttgaaaatcttctttattgaccctttttagactcattcagttattctgcaattataatatgagctaggtttagagctgggaggcactgaacatgctggacggtcaagacaacatgggggacatgacaagttactaaacacacgttaagaaataaaagaaggcctgccagccacctggaagaaacatacttttgcctatagtttgccatttgaagaaaggctaatgtaaacaaagttttactacatgacttagggactgcagattggccatttcacatccttcaaatctgtaaaacatctacaggctgatctttactgatatattggccaaatattttattatagctttttaccccttttcctgagatctgttatgatacagccttcagctattaatgtatttcttgtccatgggaacctggaattagttcccaggagggcaaggcacaggactatggctgagccaccccactcattctccagaacattcaaattgggcaactacctgtaccttgagactgtaggatctgcaataatgttatcaaggtagaaagaaacaacatacattttctgtaattcttcttgttacttagttctgtatagtaccccgggcatttaattttctgattaagtctctttgggatgatcaacattccaagatattcaaggctctttacaaaaggactctaaaacatggttctagatttattttcaagtatcccttttccacaaaactgaatgagtctttctttcttacatgtgcctcttctctttagttttataattcgatctttttttctcttgttagaatgcccacgtgtaatatcattaaatattttttacttgccggaatgaatttataaatcaaggcagtcatcatagaagttattgaacaaatattgattgtgtacttatgatgggccaggcactatgctaggctctggttatctaactggaaaaagacaaaggtagtccaatgatcagactatagtctgaatggaactaaacctctctgaagcatttaaaatcatcaatctttcctttgttctgtaaacattttatttcagagatccttatattctcctgggtttccttctgtctcaggtacctcctctgattatttgatggattcttctttatagtcagtaaatgctgtactggctcaacattttctctctctttttctttgcctaggtaattgtgtccaaatataacagctttaaataccatctatatgctaatgactactaaatttatatcttcagtcccaacctcttccctgatttctccagagttatgtaatcaatcacgtacttgaaatgtccacttggatcccttacaggtatctcaaacctagcacaaccaaacaggatccttgattccttcttcacatagtagacttctcatttctacttcttgcccatcttaaacaatgggattaccattgaccaggttgctcagataaaacaatcttaagtattttctttgatttctctctctcagatttgtcatcaacacatcaacaagtctatcatgtttcccttcagaatatcacaaatacaactatttcttttcatttccataactttgctttagtttaacccatgatcatctctccatggaatattgccctaaaaaaaagtagatgtagaattttggaggctgtggatttgatggtgcaaagatgagatattataatatgataacttctattttctcaataaaatattaaatgcagtcatatattgaagaatgatgttaggactgatgctgaaatcactgagaaggatgaccagagaagagacactttaataaatgagaggtcgtagtggagaggcacaggttgggggatgtggcaaaatgagcttcaaaggagaaaggggctttgctggaggaaagggaagtagtcttgaaatgaaaatgggaaacaaaaagtattcaccctctttttctgaggttcaaagaattataaagaaaaatatggcctctgctgagtgggtggcagaagacccaattcttaactaagatggaaaactgaagaggctgttgtaagagttgttgctgatagagaattctattataaccattaggtgcatgggctttggaggaagacacattgggttcaaattttgatatttctgtttactagctatgtgacttcagcaagtgactaaattgttgaaaaattcaattttcttcacctgtgaaaggtgattgtaaaagaacatacctcaacacataagcttatttctctaaaccttagtttctttatctttaaaggagaaccataagggtagttacttcacgtgactgtaaaaattaaatgagataatacacttatgatacttaggttagtgtttggaacacagtagttgctcagtagacattagcaattgtcaatattattattagcacgatgaaaaatccactgaaatttttctccttaccatcttccctgatatcattacatctctcttagaacctatggtgtttcttgctctgtggtacttcataaacattatgtatataatacacacctatttatgcatatgatagtcattttgtgtccttatttaatgcactcattgcctttttaacatatgttgtatacattactatatttcccatcatacctataacagggatggatcgtctcactatttgttggaaaaaataaaaatcaataattcaaactttatgatccaagatactgccatatacatctacccacccaagtgtggcatgtgctcttgagtagacattgtcttttcatatgtgtgctggcctagttgtgaccagtgggaaacattcgtgagactcagatcagtattctaatatgtagcctgaagcagcatggaatacatttctctgtaggccatttaagttttagccataaataaactcaggatcactttgttccagaaaaatggaatagtaccctaccactgcttgttggaggtatgaggtatcattacttttttctccacttctacacatttgactcagtaggggatagatatgggacagtgtgggaatcacagtcccacatctatctttgttctcttgaatcaagtgaaccaagatagatggttcttggctctctgggaccatcagaccccactgcagggctggcatcttctcacttctcagttgtaggagaaggtggaacaggtgatgcagagacctattgagatatttgctctgctgataatgtagaaatgggaagttttggggatcacatatgagtgtgggaggtccaagaaaaggaatggcttgtgccttgctggagccatggtctctggcaaacatgaaccaatcttcatcatgcttgccacatagacattcctcctcataagggcaaaagctattacttgggtacaaaagcaaagaaattcagagcaatcattcctctaccattccctcctgaagtctggagaagataaatgataaggactttctcccatcctcactattccacccccagaaatgctacgtattttagatgaactgttcatattgtttgtaaaagtagattggcagtactgttaacatgattattaactgcagtgttaggcaatgttaaaataacttcaaattgttttgcaaaatctctgtcataaaaatgcttaccaacaaatactgatactaaatttagatgtgggggtattagttataatcctgaagtgggagggggaacttcttaattccaatttagttctaagagaaggaagagtatttaggcccagagaaggttacgcttaaaggtctgatagtgttttctttgaaaaatatgtctcaaactagagaataaaactaattatctcatctaagttacctagagacatttatgctcatcagtttgataaaggactgcaagtagacacagaagctgtattttcagtcttgaacccagcaatagtacattaacaagattggggcaaggcaaagggacttttgtggcacaagatacaatatatggattgcgttcttttggcttaacaaggtgcaccttgacgtagtcttgtcctagcctttaatattcctttccttcaagtgcctttctagtggggggggggaggggggagtctattggatgcgcttaaaacactttccatcactttccaaagtcagcgcttaccttttaaagtttgcagcccagtagacagtaactacatccctagaggcttaagggaaacatgttaaatcagatcagcttgtatctcagagggagtggaaatctgacacttagacaagtgctgattcttttgagtgcatttccaggttgcactttgctgagttacatagatgtttgttaaccataattgtcacatctgaaatgacccataagattagcaaagccgtatacatatatcagtcagttttattttaaaacaggctaccaaacattgactttctctcaagcaatcagaataagattgttttcctttccttagtaacaattctcaatggaccaggagactttaggaaacattactgaaatatttcattgtcaatatgtaggctatctactggattatgatctgttttgggtagcagttatttgcaaaatattcacagtattcaacagctggtactattatagaatggcagccagctctagttgatatgtccacatcagctcaggttatgggcagagtatttgccttaaatagagccaaagaactgtctcacctggttgggtgccatattgtaaggcaaggttagcttaaatagatctgttaccttttaatggctgttatgttatgtaaactagcttaggcttacgccaagtactgttactgggtctgcttggtccagatgcttcaagaggcttctcttgactcaggtcttttttaaggcaacaaaggataaatttaaaaatatttacaaataatgtacaagtgtcagcataatttgggggtagtgctaactgtagtctttctgccatcagatattggtggaatgtttaactaggactgaccagtagaatgtgtgtggttctcacttgcctgttttcacatttctacttatttctaccccaaacagaattatgtgtttgtttttttcatttcagccctatgcatgccactctgtttgctttctgcaataaagttagatatgcttatagtagagttcattcagctgtgtttcatctttaaaacacagccatcttctggttcgactgaattcgatgtctgtttctatttttttttttttttttgcctaattgtgtcatttacagctagacgtttacttccaaggacatgtgtgttacaccttgtcctgtgagaataaaccagtcaaatgacctattgtttcacatttccttgtctgtgaatagatatgatggcattttcaaatttttttctcactctcagctcctaagtgagaaaatgtttacggtaaaatgatgaacacatgagaaactgcttgttaaagataagtaaatgatggtagatgctgtaacagataaactccaaaacttcagtgggtccaacacaatattatttatttctcattaacagctaatggtgagagtggttgtgtgtcacagtgattcaggaatacagtcactttctatcttgtgtctctaacctcttggttttcagaatccttaccactccgtcagaagatgggaaaagaataaaaggtcaaacacgagaggtttttagggaccattatgaaagcagcacctatcacttttgtcttgcattgaattggccagaactcagtccatggccacaccgaacaataaaacagaagctatgtgtgcccaggaagcaggggagaacacagatattgtttggttccagcagcctctgctacactgctgttgtaaataaaatgctacatgaataaaattagctgcattattgtttgtagaaaataaacctcatgtatttctgaaatggattctgcctgatacactgtaaagatctcttgtaggcctacacgtaaaaattactgtgaatatccagagtttaaataactctctgtttgagtaaactcatcccttccaaccgtgtcatcaccacttttctctggcttcaatcaaattaaagacagttgctttttatctaagcctctgatgctgccagttttaaggaaaattgagaaactgctttatgggtcacttgaagtagtacaaggaactcaatcattaaatatcttttgagtgaaacttctagtgacataatagaataacactccacctgagctctggacctttcataatcctattacttacataactgattcccacttgtccatatgacagttcccttcctgttgttagtgatcatttttcccccaacttgggaatttgtcctttttaaacttgcaacagagaatgatatgtgaattccctcaggctgtgtttttctatcaccctactcatttgaggatgatgccatttttaatgtggtatattctgaaagatactaggcagggatatggcaaaaaatcaagtattcatatctattaacagtttataatttattttagatttttattaggaataatgaacgaatctaaggtatacttcttgtaggtagaatattaaaattccataaaatgaatactttgcttaaataagtgcatgtgtagatgaggaatttttcatatctttctgaagcataggccgtttttgcacatgtaactagatgaggtagaaaatgattttgactcagcctcctagactgcttaaagctaggaaacaatctttggggtctagtgggcaaactctgttttacagataagaaaactgagtcttggtatcttcacttaagttacctctttgaagactgtatttgtagaaggaaagcaaattgtaatgaatttcttggaagaggactcgctgtatctttaccaaaacaaagcaaaatgcgcacatgcacataacacgtgaatgctatgagattagtagaagacgtaaaggctctagaacagtactgttcaactgaaagataatgtgaaccacatatgtgatttaaaattttttagaagctgccataagaaagatactagacacaggttagacacatctcagttcagactagcgacatttcaagtgctcagcagccacctgtggttagtggctaccatagccattgtaaaactttcagtgtaggtttaaattaattaaaaaaaaaggcacactctttaatctgcacccttaagcacacaaaggggtgatctctggagaggcagcagggcacccttaaaatgaaatggtactttccattattttttttgttatgttgagcagcccaagtctggcttttggtgggatgcaacattgtagcatttattaagcagacaggtagctggaatccatataccagaggttgagaatacctcattccttctacagcataacatttcctgtctctggatggaacttcaccataaagtcagatattgaatagaaatgagtaacattcattaaacttcaaattttactaagataagagagtaggagaaaaaagaacacaacaaatctatagcatttactttcgttgcattttaagatcaatttcatattaaaaacagttcatgagagagcagacataatgattttcataatgatctgctcactgtgctgatgcttattaactttaaatagtgacatgctctgcaggctctcttacagccattagacagagaagagcccatgcattcttgaggatagggaaacatggcaatttgtggataattttctgacatgcttaagcacagcacttagtgggatcatacttgaatgctgaatgtacagagaataaaatctcaatgtagaccaagataatttagaatttggaataattttatagaaattgaattagcagtacacatccccaaacattataaatttaaggacttttgaatatgacactcttggactcaaatcccaactctggcacatgtctgatctggggcaaagtctcctcacttctctgagtttgctctcttgcctgaagaatattgtcttcccatgttgcctgtctcttccaggatagatactctcaaattcatctagcacataggtggagccagagagattgtccgtgttctacctgcaagcaaggtgactgagtggtgaaggtcacggtttctggagctagactgcttggttggaagtttggctcttctacttagctagtgtgccatcttgggctagtcacttaacttctctgtgcctcacttttacaactggggataataattgtgtctatctccatggattgtttttaagattaaatggagtgtactgcttagggcacatcctggcatataaattgttgccattaggtatctatctatctaccttatgactccatgcttaagatcctgccatgcatccttcttacatgttacattgaggatggaattagcacttcttagtgggatacacaggccattcctaatttagttctcacctgcctctgtagcctcatttccttttcccccacacaaaacctgtattttagtcaaactaaaactactcatagttttccaagtcttcccttcttccctgctgtgaaatagctcagtggttaaatgcatgaggctttggagtcagttgcctgtattcaaagctgggctctagctcttggcaatttctgtggccttggaagttacacaagcttctgtgaacctgcttcctcaggttataagaatgagatgagaaataaataaagtgcttggcacagtgcttgtacacagtaaattcttagctgttgtgtcctcagttggaaggaaatatcttttctctcatttttatttggcttttccttgtcgttcaaaatgaagttcaggttttacctccttaaggcagtttgttttcacctctactctgtgtccagaatatcactctctgtcctggcatttattcacactgcactgtacttgttaatttgcttaatctgtttccctcactggcgtaggcaggcggacaatgtatccttgtcatctttgtgtcccaaagcttatcatgtatgggttatttagtaaatgttcattgaggaaaacatgcaataaaatagttgtgaggattaagtgaaattacctattttgactgcttggcacatagtaggaactcagtaattacaaaatacctttctcttagacttacctttaggtatttatgttatgaaggggaaggttttaagctgtactaagaaaattaagagtcaataaataaggatcctgctcaatgcacaggcactttagattcagtctctgtttggatgtgtctttgggcatcagaatagtgacagcaatcatctggtccaccagattcaaattattccatttaatacaaattgtttttttttgactcaaagaatgttgaaataatacagatatagtaaagtatgaccatatacctgcaagcccacccatatgacagtaataacagctaatatatattgagcgtctatatgtcaggcactgggctaagaactttacagcatgtatctcatttaaatcataccagttttctatgaagaaggcagaagtattgtctccatattatatgtgagcaaactgaggtgcagaaaggatgtctgaggcaatcagctatgtagtttaggctagagtggaggttagatgtcaagaaaaggtttatgtaacactgaaattgtcatgtgtgtagatatcagcattagcaagcttggagaatgccaaagctttccatggaatggaaagagctgtaaaggatacagacatttcgagcatggacatggatctaattatagtcatgtattacttaatgatggagatatgttctgagaaatgtgtccttaggcgattttgttgttatatgtatataatacagtgtacttacacaaacctagatggtatagcttactacatacctagactctacgatatggcctattttttctaggctacaagcctatatagcatgttactgtacttaatatttgaggcaattataacacaatggtaatatttgtctatctgaacatatttgtattagtctgttttcatgctgctgatagagacatacccgagactgggtaatttataaagaaaaagaggtttaatggactcacaattccacgtggctgaggaggcctcacaatcatggcaaaaggcaaaaggcacaccttacatggtggcaagccagagaggagaaatctcttataaaatcatcagctcttgcgagatttattcactatcacaagaacagtatgggggaaccgcccccatgattcaattatctcctactgggtccctcccacaacatgtgggaattatggtagctacaattcaaaatgagatttgggtggggacacagccaaaccatatcaatatctaaacacagtaaaaatgtggtataaaagataaagagtggtacacctatatagggcacttaccatgactggagcttgcaggactggaagttgccctgggtgagtcagtgagtgagtggttgagtgaatgtgaaggcctaggacattgctgtacactatggtaggctgtatatacactgtacactttggcaacgctacatttattaaaatatttttcttcaataataaattaactttagcttattataccttttttactttataaacctttatattttaaaatctttttgactggtttgcaataacacttagcttaaaaaacacattgtacatctctgtaaactaatttctttatagccttattctataagcttttgtctatttttaatttttttttaaccttttgaggttttttgtttaaaatgaagacaaaaacacacacatcacacagggtcagaatcatcagtatcactgtcttccacctccaacttttgtcccgttagagggtcttcaggggcaatagcacgcatggaggtgtcatctccaatggtaacagtgccttattctggaatatctcctgaaggacctacgtggggtattttgtggttaactttttaaaatatgtaagtgggactatacaacaatgattaaaaacaatagcacagtaaagacataaaccagtaacatagctgtttgtcactatcaactcttatgtactgtatataattgtatatgctataccgttatatgattggcagcacagtaggtttgtttacaccagcatcaccacaaacatgtgattgatgcactgggctacgacattatgaccaataggaatttttcagctccattataatttttcagcttccttataatcttatgggaccaccattttatatgcaatccatcatatggacggtggaggaagcattctctgaagagatggaggtatagagaaatttcattcccattggcagaaattttaaaagttatagccagtatctctggtacaaaaaagagcaggaggccgggtgcagtggctcacgcctgtaattccagccttttggcaggccagggctggtggatggcttgagctcaggagttcaagaccaacctgagcaacatgacaaaactccatctctaccaaaatacaaaaaattagctggatgtggtggcacgcaccttgtggtcccagctactcaggaggctgacatgggaggattgcttaagcccaggatgtcgaagctgcagtgatccgagatcatgccactgcactccagcctgagtgacagtgagagcctgtcaaaaaaaaaaaagaaaagaaaagaaaagaaacaacataacaagacaaaacaaagcaggagagaggaagtgcagtatctgattgtaagtttgaattgaggtggatatagggatggactgcattttgggtgatggcaagaaatcagaggtttgtggccactgtttagattagtctcagccttcaaatggtggttcctgaggtagagtctggggaatgatagctgtagaaactggattacagagaattgaggagaaagtaggtggtgaggaaacaaggacagctcaagtggagaataggacatctgttactttttgccacccagcgttcttttaccctgctgctaaatgtttctcgatttccttctgggacccacccgtgctcgctttcagtccatatggatttagcattggaactcataacttttctttaagaccattataacagtgcattttcctggccacaaggactggttcaggatttgtcctgttacacaagccaatcaaagtaggtttgtttttgttttttatcctggtaatattggacaatgagtctcatttttctactgtgggagggaatctggaagaacatgatgacagggaagaggctgtctgaggaggaagccaacagagagaactgaataaagggataaggttgaaccagatcctgatgatactgttgctggggggcctctatacccagccctgcctgaagtcaggaccaccccctagttttgcttaaccccatttaatcagtttctgtcattttttaacaaagcactaactgcttgtagggtaactcagcttctatgtgaagaaaagcagtaagaatccttcatatcctaatgggaaaatcattgtatttttatgagggtgagatatatttggtgtagagattatgcaaatctggtgatcaaggttcttattattaagccaaagggaagacagtgttttagatggaagaataattagtaggtttgactacaaaacctatgcatttttccctcaggcatgaccacattattatcaatttcaacagatatattcttgaaagaaggtttttttttcttattcactaaaacagttacttattttttttttcatatttgatagcagctttttttattggttacaaaacctaagcccatatacaaaattaggaacacatttagatgcctcttttgaaagaacattttgtctttttaaactgagtttaaaaaaaataaaaacaatgcaatttttaaacactattttgaaaacttaaaagtgcagcaatatacttagtttcctttatctacgaaatggtgcaattccaattcaaaactggtaaggtcacaaattgaatcaaggaaatgcatacaaatgtctgcattacttgatgctaatgttcacttgaatgttagtttgcactttaaaacatgagaggaaataggaatcatcacagtagaggcccaattttaatcataatgtgtgcaaattttaaaaggtaactgtcagttaagtaaggaaagtccagaagaaactaaactggaaggggtacagttcacaatatcaagaagatttggacaaaaaactgcaaaagtctaaaatacccattggtgatgttttttaaaaaatcttgctttcagctttcaggagttaatattctttgttttaacttgataattggatatggttgatttatattgggtttaaactgtggagctttcatgtttactgtaatttagtcttaaaatattttttacttagtaaccagtacttttgctaatgtggttggcaacaaaccagcaactatttaaaagtgtcataagggttcattctttgagtactgggaaagttaattcagatcctactcaaaaagcatcttcacatattaaaagattcagacagggatctgtgtagaggagtaatttgcagttatttaacataaacctgatttgcagtgatctctaagtaacagttacttattgtatgaatgcatatgtgggctttttaggtacttttctcctctccactccactcgggggcctttcagtttagggctatgacacagccaccactttgcatcatttacaccatcctgaaaacctgcagggctcttccttgctcctggctgttggaattgaaatatctttttcctcttcttcagaatggtgttttgatttcttatcagctgccagctggatttgaaggcctatagcctaatcacctagatagataaggaaagttgtcatattttgtctttggctgataggaatttagaacacaaacaaactcaaaagagtcaacctttgggtaagattaaaccagtgactctaattcagatcattccataaattgtattatcttgagcaaaacactctattccttgacattgcagattataaatgttgggaataaagagaaataagtgaatcccaaacctttttatattatgatacacatataaattataatgtttgataggtacatggaaataaatagatgaggcttctcactgctaaaggtggccaggctggtttgaggggatcagtagctcagcataccttaccctattcttgacactctggttgggaagctcttgaatttgtaaaccatatggactgggttttcgtcctggctcagtcactaagccccactacgttcttgtggcattctcttttccttttgagtcctcggttctgaatgcttaaatgaggaatctgaggtctagttcaaatgtaaatgccatttatcaggcatatataaaaaagcattatcagatataaaaatggaggtttttgagatatactgagactttaagcatgaaagcatctataagagtttaccacttagatctgtttaattactgctaaggacacttactttttaaaaaacagcatgcctacattatctagatacctgtatgacagtatgtgatggacagtgtcagggtctgacttaagcacccagagattagtcacagaatttctgaggtgagggcattcagatcctctattcccccaatataaaaggagactctttaaaaatcatcattgtatagttgcatagaacatcatgcaaatatgcaattgaagatccaagcatataaatccataatcttatacattattaactagcctaaccctccttagtcaaatataatcacatgaagttagagacaatttagttccagtaacatactacactctctcccagccccccacctccacccgccatcaacagcaagtgcagaccactttcatgggacagggcagcactagatccaccaggtaggaatatttagggacaaatgatcaggatgtaaggaagctgaagttaccaccaggcagtgctcattctggtgggcaaatccagggtccaagggaatcaataattaatgatcatagtccaggtaaactttggcaatgacatgaggaggttcaaggcgatggaatggatcaccatgaagaagactttggagttggaaatattcaatgaaccaagcagattttggcttcaagatggtctgtaagtgagtagttatgttacatacactaagatgaagttctggaacaacttcaatgatagagcttcagactaccggaaaatcaagggcaagaacaagattaatgttcatgaaagaacagggttgtgttcattgaatgcacacaggcacacacagaaattaatggacacatatggagtgtttacacgcaagactgtgtcacatgtttacacacactgctccatttaattcttgctaaatctccaaaggacattcattattctatttatagatgagacaacagagacttagtagctaccaatagtcacacagttagtaaatggcagaaacaagattcgaactcaggtctgacttcaaagttcattttcttttcactggtatgttacagaggctaggtaactaggatcttgagaatagggaccaaggaagaaacactgagtaaaatgggtagatccaattggttttcctattgtaacattggttttgggggcaggtatacctgtgccttaggtcaggtttgatccatggaatgggataaaaaatggagctagatcagggatccagaagcacagaccagagacttgacaccaagttgtgcctgacactcccgtttgaccatgcgtaagtttctttcaaatctcatgcagctaaaggaaggtattttcatctgaaaaattatggcatgttatactttttaggatagcagtttgaacctcaaaatgagctcagatatattttgatatcccttgctaaatttagtcaaaagctatcaagtccctctgtaatgaatttataattgggaattaatcagaaatggaactaaaatggaagcttctcatactctgatcaaacgtggagtttgaggttttgctttcatttatatgtttaatcttttagtagagctatccaaagaaggaaaacactcaggataagtaagaaggtcattaagaataacacaaaagtctcaaatattagattctaatctcttcgaaggcagctttctattacttaaacttaaacatggttttgcattctgtggcctctcagcacctacccctgattaataactttacaacttagtaattcatggtcttggagtgtacaactgctaatagttgaggtagcctagtctatactttactttgaagtatttatagttgagtaaatttataaaatttacattgttgtaagtaatcaaatgtctctgtggttaagggttatcaagaaatggtggaaaacacctcatttgtagacaaccaggcattttagagctagaatgacctttagggatcatctctcctatttaaaggtcaggatgccctgggggaaggacatacctataacctcttaatgaaagaatgaggctgagaacccaagttctttaattcttggaaatcttttctttattccatgatgtctttctagactattttgttagtttcatggctatttttatctgtctgtatatactgctgtatatactaatactgtagtgatagagtggtaattatgatttacatagcaatttgcctgttctcaaagtaatttccactgtgtcattttccaatgtttctaagaataaccctttaggtaaatactgtcttcaaccttgttttatagatgatgaaactgggattaaagaagggaagtaacttgctcaaggtcatactacaaagacatactagagctcagattcaaatgcagattctctgaatatggaatatattcttcttccaatgtattgctcataaaggcaaccatatatattaatccaacttgtgatacttttgggagtgagctattactggtttcattggcaaaacagccagttccatattagacaaattgggatagaacatgtgatcattctataattcactctataatagtcagtcagccaaggatatattagatgtctaaaggcagggatgtgacggttaaaacaaaacaaaaaaacacagcttctgccattgaagagattataattttgtgagggctataaacaagcaaatcaaggcaattaaacaatgtagtgtggatatactccaatggagaaaggaggaacctcaacctcttagtttaaatttgaaggactaggaaggtttgaagaagttatttttaagttgactactgaggggatgcagatatgagacagataaacaaagtcagaggtttgcagagggacatgtggtgaaaaagagaaagaaaatccatgtaaaggaacactgtggatcagttgcagggaagagcatagcatgtatatggagcttactccttctccatatgcctggtcattcaattatcaaaattgcctgaaaaatataggctactgatctacaccaagaatttcttttcatagcattaggcaatgaaaataataaatgtgtctctgtgaagtcagcatatgttaagtataagactaattgcaagactaaatagaacattcataatggtacctgaagaaaatatgatgatagaaaaaagccatttcctctctaccaaagaaattacattatggaaattgcaccatcagaatgaattaataggtggcttaaaaaattcaatgcccagcaaacaaaggcataaattaagtatcatgagaaaggttaatgttaaggtaacatttgctcaatttatacgaaaaaaagacttcatggagaaaaggggatgggtcagaaaggagatttgaaattggacagcaggagagttaacatacacatgcccgagggagctgagatctgtggaactgcctggaaattcgtgtttgtctaccagccattttcaaaaatctctggccaggcttgtgtttgttagtaagtccttggcggttcaggtggcagatacactggtgaacattgatgaaaagaccaagctgaactgatctagttggtgagctttctatttgctattaagtagagttttgctctctcttcttttcacagtacatttcacagccatttctgaaaaagcccagctgtgccgagatggccactgaggggatacagtgtggttgcatggagttcagagacatttgagagcagctgagcaagccccacagccttcaaacactcattgaattgccttccagaagcatattctttcacctttgtgtgacatgagagggagcagagggaatggtaatgatctgaaatgacagacatgctgggctaggatgagctaatttacagggtagaatgcactctccaaattaacaacaaagagactaggtgtcccatgccctgtcctgaggcctttaatggagccaagtgagaatatccttaaccctgggtggagtggtcttaaaagaactattcgggtgacaacatcttcccccccggaggttaagctgaggttgacatttatcttgtctgtccacagaagctgaacttctgaatctgacatctcagctttcttaagattgttgataacctgtgttctttaaatttctgtttcccaggaaagtaattgtgttgttcttttagtgatggaaaagcagagaaactctccttaagaaacccccaggatatattgtaaggcaaataggcttttctgcttgaatcatctactacagagctaaccactaaactcagaactttcttagaaaaatatcttgtgtgcactagctttggaggaagaattagaatgcaatttggcaagattgcattcaggcaaacatctgggggagaaaaaaacaacttcagtatagctcgaaagctggaaatgaagatgtactgctaaagaagttacatgtcatacatttctacagtaatcagcctgtgtctcctcttcctttccatttcctaacacaatttaattattgcatttcctgattgcagattatatttcttctatttttatatttgattatagaaatatgctagaaaaaataaagtttcagacatacccaattcattcaggtctcattagcttgtgcctacctatccagattcactttttactcttctcacttccacttctaatggggaacacctcttgctttgtctattttcatacttttgtacttgctggtatttctgcttggaattttctctgggtttcaactttttaagaaaatgtttctttttaaattcctttagcgctcaaacatgtttcttcctttctcctcccattgcagacaattcttaccttcattctaacactcggtatatatatcatattgtgtctttatgtagctgtctcccctcccaggctgtgattctcttaagaacagacctaatatctttcttaccttcattgcctagcataccatctggtccataaagagcattcagtgaatggatgtccaacacgaccattcatgtttgtgacatttatttttccaaggttctttcactttgtacctatatgatatgtaatttttacctctactgagcaatctttatataatgtatatttgctctctctgagaactaaagatagacataaagattggggcaacttgacttgagcacataaatgctacatttagtggatttatttctgcactgtgtagttaacagaactgaagagctactgatctgagtctgaagccaggtagaaaacaaatcaagtggcaacaattaagatctggaaggcagatctgctcttggatctactagcactggcatttttctttggcctcacgtcataagtagcttaaggtcatcattgtgctttgactgcttctttacctggaattatatagcaggtctcatcctgacttcttggggtcagctgtgttcatgttggcaaactgccagtgacctaaaaatgctcacttttgttaagatgtggaggctgttgccatcacagtaggtatgtgactactcacatagtgtctgtctttcaaagttcttgctctgggtgcaactgtggaggcaaggacaatgacaatgcagaagaatgattaagagtgtgagtgtctggctctcccagaagactgtgagaaaaggatttgagctcatagattgtatctgggaggtgagcaccggaagcacgggtatagggcaatgggcaagtgagacaggaaaggcaagacatccagtgttgggtacttcattcaagtgaagtgggttacagctgtgcacagcaggaacccaatcctggtaggaaattttgggaaaatgtgacccaaatttatctcactcaggcagtatgtcactgctacgtagctgctccacaggaaaattaatttcctagcactagttcctagagcttcccctcagtctcagagatgcagttgctggcagtgggaagtcaggcaggtgtgtgtcaaaatggtaagacccaaggagatgtaggggagggacgaacagtgtcaactgtaagaatatattagaatagaactcttcatgttccagtgtggccctgggatacaatttatgtgcagtttcaaagtgagatgccacaccactaagtgggcattctgaagtagatattttaaagctagtttcatgatgttgagctcctcatctatttcaaggatttggaaatttcaaggaaatgtagttaggattttatgataatactttatctagaggaatctgtcctgtgagcctcacattttcatctgcaagtggacttgcaccttccttttgatcaggcctgggagatcttcaatcagatcacttggagagcctcatctatgttgtatgaagtttggtgatacaataaactggaatctgagcccctcttgagacaacctagtatgtcagagagacacactgatgaactgatttggaggggaagtaaaggtgaactcctgaacattccaacaaactgttagaggagtcatagatgtttccccatggccagtatgctggactggacattcttgacaacattctttgtcaagaatgttgcttgaaagaagcaatagtacagtgagaatacaaatggattgaaagagaaccaggagttgtggctaaagtggccacctgaatgagagctgttgctcatgccagtttaatggtaggaggggattatccatgacagtgtccacaactgttcatctgccaccagagcatcctaccctaagtgacaaatgtaccaaccagcaagatacatccctttctcctagtctcttttcctcaatctgatcctggcagaagaaaacaaaaagcaacgtggggaagagggagacacattggtgggaagagagaaaggaccatgactctttgtctcactgtaagtgctcaactacaggagacgcccgaagtggagaagaagttaaaatcagatgttgaagcaagtttaaggtttggattcttatctggggctggacatttgtccacaggacttgctgttatctgagagtgagaaaaaaatgttatgtgacttgctgaaggccaagatttcatttgaggacaagggaaaatcttttcctccagtgtcagagccagaagaaaagctgtttcttgataacatcctatggatggtgtttgctgaagcatggactgtggaaacagacctcaattgaaattctagttctgtagctaattagcactgttgtcttggtaaagtattaattaggattctccagagaaacagaagtaatagaatgtatataaaatcaacatattttatggttaataattatgatattatgtatttattacataatataagaaattgtctcatgcaattatgaaggctggcaagtcctaaatttgcagagctgttgtactagtttgaagaaaggcaggcaggagaattttcttatttgtaggaaggttagctttttgcctattcagcccttcaactgattagatatggcccacctaggtaatggagggcaatctgctttattcagtctactgattcaaaatgttattctcatcaaaaaaacacgctcacagaaacactcagaataatgtttgaccaaatatccgggcatctcataacctagtcaagctgacacataaaattaaccatcatacttacactttatgaatccatttttataatctcatgagttgcttagagattaagtgagaaaatttgtgaagcataggcagagatagaggttcagaaaatggtagccataattattactaatggaattgtttagagaagcaagagttggatccaagcttaggaaatagagaaccaggaacagtatagtcacagggtcaaatgtaggccagtagtcagaccagcaaaaatagaacgtccctaagacaagaagactataaacctaaggtaaattttgtctttgacaaagaatgctttatattgttcctatagaagcgggaggggggcagtgcaaaaatggctgaggtaacacctaaaaacacttgttgggcatttattgtataagaaatactgtactagattttggagactcagcatgaatgagacaccatctccacccttgaggatgttataatctagatggagaaacgtttgataactgtacaattctattgtgctttaagggagccattattataaagcataatgggagtggtttgctataattagggggtcagggaaggctttagagaagtggccttatttccttgggaatttcaaaggacaagtgggactttgccaaatggatatgaggggtagacttttggggcagaggaatagcatgagtaaagttatggaaatacaatttttcagccttttggagaacaggatatcatgtgatggtgctgagttgcaatgtgagtggacagcagatgaaaagagttccaagaagagtgctgcaatagacagactggggtcggtagccaggaagccttgaatgccctactaagaattttggacctaaatccatctaaaacacaaaagtgacatgcttacactggtgttttacagagaaaaaaaagaagatgcaaaatactaagtcggagtttctctagaccactatagtccatagacctttttcttttttattctgtgttttcaaaaatgactttttttcaagaattagcttgcatagcttttgggaacccagtctttatgactgaagcaattcaccctgttaagcagatttgcatttaagttgaatttaaatagagttgttctaatcatgttttagagtagggtcatatgtgagcaataaatttgagatgtgatttatgtacactcaaaattaccaccaaatattttattaataaatcacctttaaagtacaactcagcatagttctcaattcattaagtgaacagatatttattgagtaccaaatactattctagatgtggtggatatagcaggaaaccaaacggaaaacctggcccattatatttgcatgttaaaatagtcttatcacataatattctttctgacattcagaccttggtgagcactataaaccatgtctctcaggcttttccccacaaatgacaccattattatgttcatttcatattggctcattgtggacatgttaacaaggtaataggtaagtgttagttttctgttcttctgctggtaattatatttgacaggcagtattgtggctgcctaaggatatagaaagattactgtccatgagactgcttttatatcaacagaatatcttcattaggtgtccctttgtataaccagagaagcccagtataatgtgactggcaaacatggctcttcagtggcttagagcatcctgatgtatttagtttttaacacagtcttgggcagtatggggcaaaagccatatggaacattcatcttcatttgaccatttaggtatgcacattcttatcctttgacgtctcataccaaactgtagttcagtgaagaagagtgtttgaagttgctggagaattgtctgttttctagcaggtgacccagcagactaataaatattcagcagatagagagtcttcatccacaggagagaaaatgacattatgtcttgagggttattgaggagcctctccttttttcttggcatactgaagaagaataaattttaacttatactcatattggctttacaaatattaaaaaattagccagagctcacaaaatatgaagacagctttttaaatatttttttttggtaaggagagaattatacatggaagttaattcatttttcctttagaagacatattaatactttctatcaatttctgaaattattaagtggagggaggttagaatattaagggctataaatattctttaagtggaggtaatattaaagaaccctctataccttattgaatagaaattcagtaagtgatcatagttagcaactgtattcagttatcaaagggttgcttaataaatcattgctacttagaatgttagtctgctggttcctcgacatttttaaatcataattttgggccagtatagataatttgggtgaaaataaaatgaaatggccttttttttttttacttttatttcaaggtcaggggtacaagtgcaggtttgttgcataggtaaacttgtgtcatggaggtttgttgtaagattatttcatcactcagatattaagcatagtacccattagttatttttcctgatcctctccctccttcccctttccatcctttgaaaggctccagtgtgttgttcccctctacatgtcctgttgctttagttttatttcttttattatttagatggacctaaaataccctcaaatattccatttgtacgactaattatgatcataaacttcatgttgagctaggcactgttcaaattgcatatatttagccctcacaaaactctgtgaggaagatactattacctacctgcatttacacaagaggaaacagaggcagagagcgattaaagaatttgcccaaggtcaagtagctattaatgaaagagccaggattaaacccaagcaatctgctaatttttaacctttatgcagtactgcctcaaaggaaaaatctgtttatgaacactgagaaattattttgtaatttcaagtctctacatacatgtagtttaaagaactaaacagttctagaaagttttatagggaagattaatcccttggaaacagttccctatttcctatccctagaggcaaccactttcaatgcttttaacagattcaattggtgttttcgttcagatctttaaatagcacatttctttgctactttgtgatatttttaagttttcatttttttacacacctctccacatatcttctcgttaggttagtatcgtttatgttattacgattgtgcgtgtgctattgataatctaatcatggaatatacttgattttctttcttgcatagctcttcgttcctcttgtcattaagaatcatctaatttattaatcttattatttagtttactatggtattatcataattaatcctcaaactccctctagttgtataaataccctctaagacattaactcttttatgttctggaataaatctcccccacagtttggttgatttccaggttcactgtgtagtgaatgtcctgggaatatatctgtaccatgactctggggtcctttttgcctctctgtcgggtgagagccccgttcctatgtactgtgcttacttttcttagttgaccgctctggcttggttctccattaattacctgagaaagactacatgggagatgaggttttgagaaatttctgctctgataactgtcttatgaagtgagttaatatttacaaattgctaagaaaactatctggcacatggcaaacaaaacatatacattttaaaaataattataccttcactcttgactggcaatttgaaaaggtattgtatttctgtttgtaaatcattgttccttcctcaggattctgaaagcattgttccattgtatcctaggttcctgtatggaatttgagaagcccaatgctattctgactttttatctttggttttgaaatccattgttttaaatttcatgatgatattggtatacattttcttcatcctgttggtcactcagtggactttttcaatctagatattcataacatttaagtctgtaaatgttctgacatgatatctttggtgacttctcctgtactcttactcctttttccttggtcttctctttctttttctagctttcctgttattttgatgctggactttctgatttttcaatttttatacttgtcttcttattttacatatatttgtcattttcttctaatatctggagacttcgttcactttatcttgtaacccttttcatttctgttgtcctcttttatgtttcaagactgctttttctcttcctgtgttttctcatagcatactctgtttcatgaacatggtgtcctttcactcttaggacattaatcatggtgagtaatcaagggatagtgataatgaagtgttctgttaatggagttctcacatccttcttcttgggtttgtctacaaatttgctgtggcttttgtcttttatgttagaagcctccctcaaatgtttaacccggctttccactcatacttaagagctctgcaataaaacactaatcgaaagctctgtgcaactggagatgtgattgttaatgattaaattcaatgtggggtaacggcgagccattcattctctcaggaaacacctgattgtcaatttaagtatttttagtttgtttgtttccttagaaaatattcttcaaaattcctgcccaggcaataaaagccatctttcagcattctgattgccatatacactttcactgatttcccggtattcaatatggaatctgcattcagttgtgtgtggtgttccatagtgcagaaaataaatctcccatctttttctaggctggtggagaggcagtcatctaactgggcagaatgggaagaggaaccaggtgtatacctagtttttaaggagactttcatcctatatttagctgccattgtcagaagtatctggtggtgttaattcctgagcctcttaaatcccatggtgcaaaacaaattgtttcttggcttttctcactgagtgtttgaattcagctttttcagatctgagaaagcagtcatcactccttcatctgcttctaagttttcaaaattttgttgagttacaattctcacagcctttataggtatataatccttaaaaaatggaaaaaaagctcttaaatatataactttaatgaaatttcaagaaggagcagatgaaattatgtgcatttagccaaccatgtttatttggaaacttgtttatagagaatttttttgttttgcctaattaccagcttctctgttagatgtctgaaagtctacaatggggtgtgtgtgtgtgtgtgtgtgtgtgtttgtgtgtctgtctgtctcatccttccctccttaggaataggggtgggagggggaatgtagcacctagagacatataaaagcacaggagaagaaaagcagcatgatatagggaaaaagagcacaggcttaggaggaagagaccgagattgaatcttctgctgactttgagttattaatctttttggcatctcactttccttatctatgaagtgattagaataacagctgtcttgtagttgcattttgcagatggagataaagtgtcatcctgcacaagccttgaatatggtgcccagtggaggccatgttgtatctggaatgaaggaagaacatttgccagcaggagatgggaaggctggagggaatctttttgagaatattttcagatatgtatagtttgtacaattatatctactttgtaatattgaccagggctaaactacttggctaaaatatctggcttctgaaagcccccactaatttctagatcttttagttattataataaccttactataggaattgggtcacagtggtttaacaaatgtggagtgtaccttatagcagactatgaatttggggctaattgaaatagagacttttggggaaaactcagtgtatggttgcctgagctggtgacaacagttgtggagtgtgtgtgtgtgtgcgtgcgtgtgttgaactaaaacagatacttttaccagagagcacttcattgactcatgtatcctttcattattagcacaaagagattctcttgctttatcctatttaaaaagaaagcctccaaaatagagagcagttgaagaaaaataataataaaacatatgaatagttcttggaaggacacaatcctcctagatagggagaaagataatttagagtggcatagtaaaggccttaggtaatagaaaagtatttaatagagttgttcatgtggctgtaatgtttagttagaagggaagataaaagataagctgtttccaatttctaatttacctgtaatcttgagtcttcacctgtcatcttttcaagaaaggctaacttttgctgcttaaacatcactttcgtgagtagactataaacacctctatttcagccaaaaaccaaaaaaattcagcatgaataatgtgaactattcaccccctccttaatactttctttgcaaaggaagatgtttttcttttactaaataaaaactatattcagaaggctcttcttagtgtaaaaataggggtatcacttcctcaaacaagggctacagtggatttggtattatataatgtgtattctcttttggaaaacagcaaggacatttctagaatcctttaaatctggctctccacagttttctgccatctgtcagctcttctgtggttattaaatagtgatggcatgacaggtgagaaattgcattaattgtgcaatagagaaaatggaacaaattaagtatctctgtattgattctttttagaaaaaaaagtaaataaaacaatgtttataatcattggttctctaggacaacatccaataagtctcaagagctttcttgaagagtatgtgtgtctgtgtgcatgttttaaagtttctgtttgcattaaggcaaatctttggtataaaatagtcttgggttcttaaaactttactgtctctctctcttttctgaagttcatattttcctttttaaggtagtatctttctgagccttgtatttttatttcagaaattctttaatgtctgtgtaccacgctaagggtattctacaaattcttagtttttcattcaaggccctctaccctctgaccccaatttactttccctattttttggtcaatatttttctacataaatccttcctttcagccaaacaggaatgcttagtgtaccccacagacctttcagttttgcctctgtgtcaaaaatcctctcccttcctctgcacttacctgctactagcccctccttaagattggatgattccctaaccctcctagtccagatacgcagtcagttcatctatgcacttccacaacccagtgaggtcactctggaaccatttagcatgaactggcagttcgcattccatttaggtattttttttttaactcggcttagaatgtaacctctgtgaaggcagtaggttttatatttgtttcatagtatttttttccctgacattaaaatgttcacttgtgtgttgcttgtctgtccatcaatcatctatctacctatttttactctctgctatttgttcccacttgaatataagctccaaaagatatcaggaaccttgcacaggctacagaggttgcacatggcagacatttggctctgcagctcatgcttttaaccagtaatctacgtgggcccatgaagcttatcaatgactccatcattgccatttctaactttacttacctttcaacaggattttgacacgttgaccctttatcctttgaatgttgcacttctcttggcttctgtgacacccttctctctctctttttctacattccagctaattatcttgtcatcttcttttgacagtttaaatattggtggtccccggttttgtcatcatcatttttctgtgctttctctacagtcctcttcctagcctagtcctcttgatcttagtggcatgacacattacaggatcacgatcagttatagcacgtgtcaaaactactcactcataagaattgttataaggatttgtgaaaattttaaatttttaattaattagactcacctcaaatttaccattataagaatgtcacacttatgcatttatttttcaatagtgtgtacctacttgtgtgtgaaaacatggaattagagttagctgtaagtgaatttctcataattcttagcctattttatatttgctgaaaacatccatgaactatgattattgatgtgtcattaagagttataacaattttgaaatattatagtctataaactgtggatttataggtatgtttcttttcttgatttatccatgggcacatttttaataacaaagagagatgaagaaaatgtatatgcatctacatcctcatggtatagaaatgagaatgaggctgtccttacaatctccaaatcaaagacaaagtgatcattcaaatagtgtgtgcaataatgttacttataataatatcatgaataaatagaaatactactcactatactttttaatgataaaatgataatttaaaaattactagtaatacatttttatttccttgtattacctgtgggggtttgaatttagtcttcaaaatatagttcaaaatagtttttatgttagattaaccatatatgcatttttttctctccaagaaatgatgttttaagataattaaatatgtgattttactgatcctttggtagtaaaatgcttttgcgagtatgatctataaaaacagtttgggagttctttgctttatttggccaactacttttgtttgtaagtgtgtgtgtttggttttcattacagtctgagtatgttcctgggagtgtgtctcatatgaatgtcattcacatctgtcatagcagaagaaaagttgaaaacctctgctctaggctattttatatactcttttgtatttaactcttgtccatatgttgatgactcttgaatcgatatcatcacccacaataacttatccagggctgcagtcatttattaagccacctactgggcatctttatgtggatgtcctaccagtttctgacttaaagtttattttatctgatataaatgtagctcctcctgctctgttttggttttcatttgcatgaaatgattttctccattccttcactttcagtaaatgtgtgtcattataggtgaagtgagtttctcatagacagcatatagttaggtcttgtttttaatctatttagccatcctttgtcttttagttagaaaatttagtgaagttaggtcacagggaaaactgctgccccccaaactggaaagacagacaggcagaaacaaagaacttaaggaagaaaaactccaaactgaaacttatgtgggaaccaggaccagggtagggaaacctgaaatataactgattaattgctttaggcttatagactaatgtgagtgtttaaaactccatagggtcggaggatggcgatagagaggccctcacacttttgtgagctttacatccaggagcttgaccagcttctaagaatgaaaaattcccctatgcttctggcaggaggagaagagaagaaaccatgtggacatatgccagagcattctgttcttaacaaaacctgcctttaagaggaactattttatttagcacagcctgaactgtaggggtttttatcagagcctacccaatctaggggaaaggaaatacccaactccagccacctcctagccttccacatgggggaagaaaaattcacagctccagcccactctaaccaacctgtcccacctgagtcttgtggggtggagatggagaagcacttgtgaaattcatagttcagaggcacagtcttaatgaaagaatgagacctaatcatatagaatgctaacccctcaacaacttcccaccacattacaaaaggtctgtttattacagtcccttttacataatacatcatgtcatgtctggttatcaagaaaaaatggcaagggatactaaaaggagaaagcacagttttaaaacatagagcaagtataaaaaccagactcagatgtggcaggaatattgggagtagacctggaatttaaaacaggtatggttaacatgaaaaggattctaatggataaagtagacagaatgtaagaacagatggtcaatgtaatcagagagatggaaattctaagaaaggattgaaaagaaatgctacagaagaaaaaatctgtagcagacatgaaaaatgccttttttgtgctaattagtaaactttacatggctgaggaaaaaaaatctctgagcttgaagatatattaatggaaacttctaaaatggaaaaacaaagaaaaagaaaactgagaaaaaaacaaaacaaaacaaaaagccaaagaactgtgggaccaccatagaatgtgtaaatgcatatagtgggaatatcagaagaagaaaacaaaaagaaacaataggaatatgggaaacaataatgactgagaattttctaacattaatgtcagacaacaaaccatgtattcaggaagctcagagaaaaccaagcaggataaatgccaaattgccaaatccctctctctctctctctctctctctctcacacacacacacacagaggcatatcctattcgaactgcagaaaaccaaagataaaaattcttgaagaaattcaggagaaaaaaaaattcttacctagaagaccaaagagaattaccactgatttcttagaaatcatgcaaacaagaagagaaaggtatgaaatatgtaagtgttgagggaaaaaaagcaacttagaatgctgcacccagtgaaattatccttcaaaagtagaggagacataaagccattttcagacaacaaaaattgagggttttgtgccaagcagacctaccttacaagaaatgttgaaggtcttcatagaagaggaaaatcatatagttcaaatcatggatctacataaagaaagaaagagcatcagcgaaagaattagcaaaattaaaattaaaacttttcccttatcattaattgatctaacagataacagtttgttcaaaatcatagcaacaatgtattcgattatatactcttatataaaagtgaaatgaatgacagcaatgatacagtgatgggagagagaattaggcttcttttgttatcataaggttcttgtactctctatgaagtagtatagtattatctaagggtatgctgggattaattataaatgtatattgaaaactctgtggcaatcgctttttgtttaaaaaaaagtatattgctatgctaagaaaaaagaaaaatagaatatcataaaatgattaatgaaaacctcaaaaagaagacaaagattggaagactaaaatagaagcaaggacacaggtagtgaaaagaaagcagtaataaatatagtagtgtcacttgtgtcaacaatcagtggtctaaatataccaattaaaagatacagaatatcagagtggatcaaaagacaagacccaactacgtgctgtctacaaaatactcactttattaaaaaatatacagattaaaagcaaatggaagaagaaatatatatcatgctaatactaaaatgaaatcagaatagctatattaatttctgacacaacagacttcaaagcaagaaaaattatcagggataaatgggcattacataattttaaaagggttaattctccaaaaagatatacacaatctttttgtgtatgtgcctaacatgagaacctcaaaatacatgagtaaaaactgaccaaactagaaagagaaacagatgaattcactaatatagtttgacaattagacactcctctttctgaaataaacagagtctgctggcagaaaattcttaaggacatagcaataataccacattaatcaactggatataattgacatctatgaactacatcattcagtgacagcacaacacacattcttctcaagctcacatggaacattcatcaaaataaaccatgttctgggtcataaagcagaccttagcacatttaaaagaacagaaattatcatacaatatctgcattcatgccacaatagaattaaaatggaaatcaataacagctggagaactccaaaattattggggattaaacaacacacttttaagtaacctatgggtcaaaacagaaatctcaaaagaaattaaaaatattttaaactaaataaaaataagataaaatttttcaaaatttgcagggaaggctgtgcttagcattgaatgcacatattagaacaaaagaaagattggagagtaatgatccaagcttccaccttaggaaactagaaaaaaattagatccaaaataagcaggagaaaacatataataaaaattagtgccaaaatcaatgaaattgaaaacaggaaatcaatagagaaaattaacaaaaataaaacctagttctttgaaaagatcaacaaaattgatgaacctccagtcaggctaagacaaaaaagaaggaagacaaatcactaatatcagtaatgaaaaagaggatatcactgtagtctcatggacattaaaaggttatacagcaatattatgaacaactctctatgcccaaaatttgataacctatgtaaaatgaaccaatttcttgaaagataattctcacagaagaagacatagattatctgaataggcctatatctattacagaaattgaaccaataattaataacagtttcaaacagaagcaccaggcccagatgggttcactggtgaattctaccaaacatttatgaaagaaattatacaaattctccacaatctcttccagaatacagaagcattgggaatacttccaaattctttgtgaggccaacattactctaatactaaaaccagacaaaaacatcacaagaaaagaaaactatagcctggtatttctcatgaacatagatgcaaaaattctcaacaaaatattagtgaattgactccgacagttatttaaaaaaatacaccataaccaggcggtgtatattatcccaggtaaggcaagactggttcaacatttgaaaatcatttgaattgatgtgttcagcacatcaaaaggctaaagaagaaaaatcacatgatcataacaatagatgcagaaaaagcatttgacagtgtggagccaagatggctgaataggaacagctccagtccacagttcccagcatgagcgatgcagaagatgggtgatttctgcatttccaactgaggtactgggttcatctcactggggagtgtcggaaagtgggtgcaggacagtgggtgcagtgcaccgagcatgagccgaagcagggcaaggcatcgcctcacccaggaagcgcaaggggtcagggaattccctttcctagtcaaagaaaggggtgacagacagcacctggaaaatcaggtcactcccaccctaatactgcacttttccaacagtcttagcaaatggcacaccaggagattatatcccacccctggctcggagggccctacgcccatggagtctcactcattgctagcacagcagtctgagatcaaactgcaaggcagcagtgaggccgggggagggggcgcctgccattgccaaggcttgagtagataaacaaagcagctgggaagctcgaactgggtggagcccaccgcagctcaaggaggcctgcctgcctctgtagactctacctctaggggcaaggcacagccaaagaaaagtcagcagaatcctctgcagacttaaatgtccctgtctgacagccttgaagagagtagtggttctcccagcacgcagctggacatctgagaatggacagactgcctcctcaagtgggtctctgacacccgagtagcctaactgggaggcacccccaagtaggggcagactgacacctcacacggcctggtactcctctcacacaaaacttccagaggaacgatcaggcagcaacatctgctgttcaccaatatctgctgttctgcagcctccactgctgatactcaggcaaagagggcctggaggggacctccagcaaactccaacagacctgcagctgaggttcctgactgttagaaggaaaactaacaaacagaaaggacatccacaccaaaaacccatctgtacgtcaccatcatcaaagaccaaaggtagataaaaccacaaagatggggaaaaaacagagcagaaaaactggaaactctaaaaagtagagcacctcttctcctccaaaggaatgcagctcctcaccagcaatggaacaaagctggacggagaatgactttgacgagttgagagaagaaggcttcagacgatcaaactactccgagctacaggaggaagttcaaacccatggcaaagaagttaaaaatcttgaaaaaaaattagacgaatggctaactagaataaccaatacagagaagtccttaaaggacctgatggagctgaaaaccaaggcatgcgaactacgtgatgaatgcacaagcctcagtagctgattcagtcaactgcaagaaagggtatcagtgatggaagatgagataaatgaaatgaagcgagaagagaagtttaaagaaaaaagaataaaaagaaacgaacaaagcctccaagaaatatgggactatgtgaaaagaccaaatctacgtctgattggtgtatctgaaagtgacagggagaaaggaaccaagttggaaaacactttgcagggtattatccaggagaacttccccaatctagcaaggcaggccaacattcaaattcaggaaagacagagaacaccacaaagatgctcctcgagaagagcaactccaagacacacaattgtcagattcaccaaagttgaaatgaaggaaaaaatgttaagggcagccagagagaaaggtcgggttacccacaaagggaaacccatcagactaacagctgatctctcggcagaaactctacaagccagaggagagtggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctgaaagagctcctgaaggaagcactaaacatagaaaggaacaaccagtaccagccactgcaaaaacatgccaaattgtaaagactatcgaggctaggaagaaactgcatcaactaacgagcaaaataaccagctaacatcataatgacaggatcaaattcacacataacgatattaaccttaaatgtaaatggactaaatgctccaattaaaagactcagactggcaaattggataaagagtccagacccatcagtgtgctgtattcaggaaacccatctcacgtgcagagacacacataggctcaaaataaaaggatggaggaagatctaccaatcaaatggaaaacaaaaaaaagcaggggttgcaatcctagtctctgataaaacagactttaaaccaagaaagatcaaaagagacaagtccattacataatggtaaaaggatcaattcaacaagaagagctaactatcctaaatatatatgcacccaatacaggagcacccagattcacaaagcaagtccttagagacctacaaagagacttagactcccacacaataacaatgggagactttaacaccccactgtcaacattagacagatcaacaagacagaaaattaacaacgatatccacgaattgaactcagctctgcaccaagcggacctaatagacatctacagaactttccaccccaaatcaacagaatatacattcgtctcaacaccacattgcacttattccaaaattgaccacttagttggaagtaaagcactcctcagcgaatgtaaaagaacaaaaattataacaaactgtctctcaggccacagtgcaatcaaactagaactcaggattaagaaactcactcaaaaccgctcaactacatggaaactgaacaacctgttcctgaatgactactgggtacgtaacgaaatgaaggcagaaataaagatgttcttggaaaccagtgagaacaaagacacaacataccagaatctctgggacacattcaaagcagtttggagagggaaatttatagcactaaatgcccacaagagaaagcaagaaagatctaaaattgataccctaacatcacaattaaaagaactagggaagcaagagcgaacacattcaaaagctagcagaaggcaagaaataactaagatcagagcagaactgaaggagatggacacacaaaaaaacccttcaaaaaatcaatgaatccaggagctggttttttgaaaagatcaacaaaattcatagactgctagcagactaataaagaagaaaggagagaagaatcaaatagacgcaataaaaaatgataaaggggatatcaccaccgaacccacagaaatacaaactaccatcagagaatgctataaacacctctacgcaaataaactagaaaatctagaagaaatggataaattcctagacacatacaccctcctgagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactgttccaatcaatagaaaaagagggaatcctccctagctcattttatgaggccagcatcatcctgataccaaagcctggcagagacacaacaaaaaaagagaattttagaccaatatgcctgatgaacatcaatgcaaaaatcctcaataaaatactggcaaaccaaatccagcagcacatcaagaagcttattcaatatgatcaagtgggcttcatctctgggatgcaaggctggttcaacatacgcaaatcaataaatgtaatccagcatataaacagaaccaatgacaaaaaccatatgattatctcagtagatgcagaaaaggcctttgacaaaattcaacaacgcttcatcctagaaactctcaataaattatgtattgattggacatatctcaaaataataagagctatctatgacaaatccacagccaatatcatactgaataggcaaaaactggaagcattccctttgaaaactggcacaagacagggatgccgtctctcaccactcctattcaacatagtattggaagttctggccagggcaatcaggcaggagaaggaaataaagggtattcaattaggaaaagaggaagtcaaattgtccctgtttgcagatgacatgattgtatatttagaaaaccccatcgtctcaacccaaaatctccttaagctgataggcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttgcaagggacgtgaaggaccttttccaggagaactacaaaccactgctcaatgaaataaaagaggatacagagaaatggaagaacattccatgctcattggtaggaagaatcaatatcgtgaaaatggccatactgcccaaggtaatttatagattcagtgccatcaccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtgccaaaacagagatatagaccaatggaacagaacggagccctcagaaataatgccacatatctacaaccatctgatctttgacaaacctgacaaaaacaagcaatggggaaaggattccctgtttaatcaatggcgctggggaaactggctagccatacgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatctacaagaaaaaaacaaacagccccatcaaaaagtgggtgaaggatatgaacagacacttctcaaaagaagacatttatgcagccaaaagacacatgaaaaaatgctcatcatcactggccatcagagaaatgcaaatcaaaactacaatgagataccatctcacaccagctagaatggcaatcattaaaaagtcaggaaacaacaggtgctggagaggatgtggagaaataggaacacttttaccctgttggtgggactgtaaactagttcaaccattgtggaagtcagtgtggcgattcctcagggatctagaactagaaataccatttgacccagccatcccattactgggtatatacccaaaggattataaatcttgctgctataaagacacatgcacatgtatgtttattgcggcactattcataatagcaaaaacttggaaccaagccaaatacccatcagtgatagactggattaagaaaatgtggcacgtatataccatggaatactatgcatccataaaaaaggatgagttcttgtcctttttagggacgtggatgaagctggaaaccatcatcctcagcaaactgttgcaaggacaaaaaaccaaacactgcgtgttctcagtcataggtgggaattgaacaatgagaacacacggacacaggaataggaacatcacacaccggggcctgttgtggggtgagggaagggggagggatagcattaggagatatacctaatgttaaatgacgagttgctgggtgcagcacaccaacatggcacatgtatgcatatgtaactaacctgcacgttgtgcacatgtaccctaaaacttgaagtataataaaaaaaaaagaaagaaaaagcatttgacaaaatccaacacctatcattgataaaaaccctcagtaaacaaggaataatagaagcgaacttcctcaacttgataaagaacatatacaaaaaccctacagcaatgtcacacaataatgagaaactacaagatttgctgccaaattaggaagaaggcaagtatatcccctcttaccactgtttttttcttagcatagtattctaaatcatagctaatgtattaagaaaataaaataaaaggtgtagttactggaaagaaagaaataaaactgcatttgcttttacataccatgattatctaagtagaaattttttaaaaaatcaattaaaaaatcccttctgaaactagtaagtgactatagcatagtggcagaatataaggttaatgtacaaaagtcgatagttttttctgtatactggcaatgaacaagtgaaatttaaaattaaaaacaatgccggttatattagcaaccccaaaatgatatacttagatttaaatctaacaaaacatggacgagatctataagaggaaaactataaaactcagtttaaaaaaaatcaaagaactaaatagagagataatccatgtttatggataggaagactcaatattgttaggatgtcagttctaccaaatttgattcaagattttatgcaatcccaataaaaatcgtagggagttactttgtggatattgataaactgattccaaagtttatatggacagacaaagactcagaataaccaacagagtactaaaggagaacaaaggtgaagaattgacactaccagatgtgaagacttactatgaagctacagtaatcaaaacagtgtagtactgatgaagaatagacaaacaagtcaatgcaagagactagagagccagaaatagatctatagtaatatagtcaactgatcttagacaaaggagcaaacacaatatcatgaaggaaaattgtcatctcagcaaatggtgctagaaaaactacatccacatgccaaaataaattgataaatgtagacacagatcttaaaactctagtaaaaataaatcaaaatggatcataaatggtaatgaaaatgaaaaactcgaactcctagaagataacaggagaaattctaggtgacctatagtatggcaattattttttagatacagtcaagggaacagttcatgaaagaataataatatgaaattcattaaatttgtaacgtttgttctagaaaagacactgtcaagaaagtgagaaggcaagtcattgagtgggagaaaatagttgcaaaagacacatctgataaaggactgttgtccgaaatatacaaagaactctttaaactgacaaaaagcaaatgaacaacctgattaaaaaatgggcaaagacctaacagacacctcactaggtagctaataaacatatgagaagatgctcaacattttatgttattaaggaactacaaactaaaacaacagtgacatacactacacacctattggaatggccaaaatctgacacactaacagcaccaaatcctcaaaaggttatgaagcaccaggaactctaccatcactttggaaaaaagcagtttctcacaaagctaagcatgttcttaccatgcgatacagcaattgtgcttcttggtatttttccaaatgagttgtaaactctgtcctcaccaaaacctgcaaacagattgtttagagcagctttattcataaccacccaaacttggaagcaataaaaatgtcttccaggagttgaaaggataaactttgttacatctagacaatggaatattgttctatgccaaaaagaaatgaactatcaagccatgaaaagaaacggaggaaacgtaaatgcacaatactaggtgacagaagccgatctgcaaatgtcacatgtgatttcacttatatgacatgatgaaaaaggcaaaactatgaagacagtaaaatcttcaggggattccagaggttgggggaagggagagataaaaggtgctcaaatagaggatttttaaggcagtgaaactactctgtaatgatactacaatggtggatacctatcattatacattggtccaaacctgtacaatgtaaaataccaagagtgaaacctaatgtaaactatggactttggttgatactgatgcatcagtgttggttcattggttataaaaaatggagaatggcagagcaagacggccaaatagaaggctgtaccaatcgttccacctacatggtcaacaatttaacaattatctgtgcaaaaacacactttcataagaaccaaaaatcaggtgagcattcacagtacctgattttaacttcataccactgaaagaggtattgaagagggtaggaaagacagtgttgaatcactgatgccaccttttccccatcactcagcaggagccatgtgacatgaagagagaatctgtgcatttgtgggagggggagagcatagtgattctgagatattgcattgaactcaattctgccttgtcacagcagaagacaaaactgggctgaactttagtaacaccagcccacggagggagtatttaaaccagccctagccagaggagaatcaccatcccaacagtcagaacttgagttactgcaagcctcagcaaagcgggctaaaatgctatggggcgttaaataatgtttatttaagtttaataaacttaaataacaatttaagttccaattaagtaacaattttaagtttaataaataacaatttaagttaataataaacattatttaaggttccaaagcctaggctctaaacagtctaggccacagggattacaactcctaggcatgtcctagtcctgaactggactcagagccagtggacctggagaacaggcaacctattgagacaccagccaggccagctaagggagtgcttgcaccgtccctcctccaaccccaggctgcacagcttacagttcccaaggagacccctttcttctgcttgaggagagggaagagtggggaggactttgtcttccatcttggataccagctcagtcacagtaggataggcaccagtcacagtcagagtcataaggcccccttgccatgccccagctcctgaacatcatttctggacaccccccgagccagaagggaacctgctgccatgaaggtaaggacccagtcttagaaagacccttcacctgctgactaaagaggcttatggtaatagtggctgtgaggtgaggctcctctgcctgtggaaacgggagggaagggttggagggactgtgtcttatgatttgagtgccagttcaattgcaatacaatagaataccaggtagacttctaaggtttctgactccagtccctggctcctggatggcacctctgtacccaaccagggcctggaggaacttgcttccctgaagagaaggatgcaagcctggctggcttcactatccacagattgtagacccagggccttgagtgaacttagggggtagccagttagtggttacagcagaccttggacaaggcccagtgctttgatggcttaaggactgacccagcatagttccagtggtggtagccacaggggtacttgtgtcactccacccccagatccagagagagagagagactccatttgtttgggagaaagtaaggaaagagaagaagagtctctgcatggtaatccagataattcttccggatctcatctaagaccattaaggtgctacatctaggagatgcctatctctcgtcatatacaaaaataaataaaaatggattagacttaaatctaagacctcaaactatgaaactactacacaaaaacatcagaggaagtctcctggatatttgcctgggcaaaaattcttcttgtgtaataatttacacgcatagacaacaaaagcaaaagtgggcaaatgggatcacattaagttaaaaagcttcttcacagcaaaggaaatagtccacaaagtgaaagacaacctacagatgggagaaaatattttgccaactatctatctgacaagagattaataaccagaatatataaggatctcaaacaactctataggaaaaaaaaatctaacaatctaattaaaaatgagcaaaagatctgaatagacgtttctcaaaagaagacatacaaatggcaaacaagcatatgaaaaggtgttcatcactgatcatcagagaaatgcaaatcaaaactacaataagatataatctcaggccagttaaaatgacttatataccaccacacctggctaatttttgtggttttaatagaaacagcgtttaggctgaggcacgggaatcgcttgagcttgagaggtggaggttgtagtgagctgacatcataccatgcactccagcaggggcaacacagtgagactctgtctcaaaaaaaaaaaaaaaaaaaaggcttatatgcaaaagatcagcaataagatgccggcaagggtgtagagaaaagggaacacccaacactgttggtgggaatgtaaattaatctgaccactatggagaacagtttggaagttcctcagaaaactgaaaatagagccaccatagcatctagcaatcccactgctaggtatatacctgaaagaaaggaaatcagtgcatagaaaatatatgtgtactctcatgtttgtctcagcactagtcacaatagccaagatattgaagcaatgtaagtgtccataaagaaatgaatagacaaagaaaatgaggtacttatacacaatggagtactattcagccataaaaaagaatgagatcctatcatttgcaacaacatgaatagaactggaggtcattatgttaagtgaaataagccaggcacagaatgacaaattgtgtatgttcttacttatttgtgggagctaaaaattcaaataattggactcatggagatagaaagtaaaggatagtgaaagaagctgggaaggatagtgggggagtgtgggggaggtggggatggttaatgggtacaaaaactagaaagaatgaataagacctagtattcactagcacaacagagtgactgtagtcaataataatttgtgtacatttttaaataactaaatgagtgtagttggattatatataaaagataaatgtttgaggtgatggatatcccatttaccctcatgtgattattatgcattgcatgcctgtatcgaaatgtctcatagcaatctataaatacatacacacactattgtacccacaaaaattaaaaataaatattttttaaaaaattaaaaaataagatagaacaaattgagcactctcgtgtgggattttggtagtggaagaggttgtgcttattttggaccaagagaaaacaggacatgtttgtaccctccactcaatttcgctgtgaccctaacactgctctaaaaataaagtctgtgtttttaaaagcatgtgatacagagtttcacacactgaatttgtctagtgaattattatctagatccaaaatagttgtattttctactatataacacattacatcatctgtctagctatctctctcacaaagtagaatgtctgtgaaatagaacacaaggaaggagagagaattatgacccaagcaagaatcatgggtccagaattccacccaaggaagctagttcaaagccagagaaagagcacagcttttcacacaattgaatagatctcaacttcatgattttggtattgaagatgctgacagtagccagtggctctgtgaaggcaattttccaacctaccattcttggctactcctgggatattttacttggctgtgagatccccctgagaagcttctctttttctcacacaattcctccatcagcgaagtgtggtgggcagcacacagtgactatgattcctggagatggcactgggactgaacttatgctgcctgtcaagattatgttcagacatgtgtgtgtgcctgtggactttgagggaatgtcagtgacctccacctctgcctcacatgaagaggaaattcataatgccatcatggcagttcattgaaaccgtgtggctttgaagagtagcgttaaaactgacgacaccctgccaccatcatacaaatccttcaacaacatgttgcataccaccctagatctctatgccagtgtcattcatttaaaaaatttgccaaacgtggagacctggcacaaagatgtagacatcctagttgtttgggaaaacacagagggtgagtatagcaatctggagcatgagagtgtgaaaggagtgacagagagcctaaagatcatgactaaggccaagtctttgtgcattgctgaatatgccttccagctggcccagaagatgggatgcaaaaaagtgatggctgtgcacaaggtcaacatcacgaaactgggagatggtctcttcctccagtgctgtgggggaggtggcatcccgctatcctcagctcaccttagaagacatgattgtggagaatgccacaatgcagtgagtatcccagccccaacagtttgatgtcatggtaatgctcagtctttatggcaatgttatcaacagtgtctgcacaggtttgattggtggggcaggccttgtgcctggagccaactatgtctatatgtatgcagtgtttgagacagcttcaaggcaatgtgacaatttagtcaatacaaatctggcaaaccctaccgccatgctgctggcaatttgtatcatgctggattacctcaaactccactcctatgccacccacattaatactgcagtcttggcatccttggacaacaaaagtgtccacactgcagaccttggaggccagggtaccacattggacatcattcaaaacatcatagaccacatttgaaatgtcaattaattgttctgtgccttggaggctaagctatccctcaaagtctgtcctgtcctacttgttacctccactctttctgctttaaaaaccctagccagcttagctactgcagactccacaagaaaccagcttatcctttaattcacaagcagggcagggtgggggcctgtgtgaaccaaaactgatttttttcccattaaattgaaatgccataaaaattttttgtttaaattgaggacaattttatctaaatgaattgaggacattcttatctattttagtccacaattctcccttctctacgatattatatactgaataaatcagagctgtttgtggagtcctggggctttcccagagcttggcacactgattttctctttatcttggtcattaacattcagcaaaccagcctgcagagaagcctggcttctctctagaggtcgttaatgagttaattagtgcaataaactttgcctaaaaaatatacattgtaacttttctaataaataggacaacatacagcagagctgacatagaatgcttccactccttcctagatagcccatctttcctatggtcttatttatgacctttacgttaggaattttctccagtgttctgtttcacacatgaacatttttaggcactgcagctcttctggaaaggggattcttgaattcttccagctggactcaagagtgtagaggtcaaaaccccagttaacaggcactagacccacaacattttgcgaaacagagaactatcgattgtaaactctttggtcagtgtttcacagtcttttacggtttactttcaatctttcaaagaaagaatgtgtgtataaaacaaaacaaaagaaaacaaaaagcactgagctaaatgtttactgtcactttatcctattttatttgtagtattttttaaagttatagttgggagacaaactaaaataactttattggtgcttggaaattgttacttaattaggaaattaaaaacacaatgactgtaaaaacttacagtagttttatcagtaggaaaggcctgtagatagaaatgagacagagaaaaataatgaattctacattgtggaaatgtgtgtctcgcctattacctttggatctctgcctggttaataggtcacaagttaaagacacttagaccatagaaagtttcttacagtttccaccaggctctgccttaatcatattaccttggtctaacctttcctaattgggcataaagtcagggccaggatttggacaactgaaagctagtttgagaggatttagtctgaaaagaaagtgactacctgaaaccctatctagaagtctttcttgaagaataaggcaaacaggaaagagtctatgtataaaatgaccctgatagtcactttactggccattagacatgtcactgtccagggctgccactagcccaaatggtgcccacctctgggctgatctagacgtgcaccaaaggcatgttcttttcaagtggagcaaggggcggattttagccagatggccccctgcacctccaatgccacgctaactgatcttactttaacccatactatccactcgtaccactcttttttatgatgacaaggatttatttatggcacaatcagcttaacaaaagacagtggcccagttgttggcttctatttagcaatgggggtttatgatacacttcagttaaaatttctctatctgttaaagatggtcattttcagaatcccattgcaattcttggaccagactgctgcagtgacacctagtacaccatagtaaaatttttcatttccactgttagatgctctcacttagatatgaacatctctagggtaagctccacgtgttttctttccttgtcctttgtagtctgtaacataatggctggtacataatgcatggaatacatgtttgttgaatcaaccaaaatatgagtgttatggttgataccgctacacttttttatctgtaaagtgtgataactgtacctgccttatagggttgttggaaagacggagaaaattcacgtaaaacctgtgttgttgtgcctataagtgcttagtgtattttagaaattattatattccttattacacagaatataccattctaaaagataattctgaatagaactgagtgaattttattaattcattatagatttttggtttgcggccaacttttaaatagaaaagcaaatcatatctgctgattcatcaagtctccttattctagctcctttttatttcttgaatctggcaacccctcttttttttcaccaacaccttcttcctcattagcttttcttatcattggtaacttcctaatttctcttactgcaagtatagcttcctaactgatgtcttgcctgtagtttagccctgttcaatctattttcacaatgcatccagcatgatctttctgacaggcaaagagatcatgtccctttcttacttaaaacctttattcaaaggcttcattttttctgtaaaagaaaggcagtggagcatagcatgaaaaccatctaatgttctggcctcattttcccttcctcaggttcaccatgtctgtccccccaccctcattccaatatcaatgcaatgtggcattccaacaagactataacagaatttattgttaaaggaccatctattctctctagatcaggcctttgtatacagtcttggttcctttcttcttcattagatgaatttctcctcatgcttcaggactcaacttaatcatcaccttttttggggagtcttatctttttacccctcttcccattttttgctgagattgagggggtaactctcagtgtcccctgccacagctctctatatacactatctagtatttatttctctgattgtgattacatgttttatccccaccatccctcgttaactttactgtacaatgcatcccttggcaataggagtgaagtcattcatcactatagcatcagaacctaggatagggacaggctcttagttcatactcactctaaagaaaagaagagaatagaaggaaggaagaaaagaaataagggaaggaaagaaggaaggaaagaaagaaaaaataagggaaggaaggaaagaaggaaataaggaagggagaaggaaaaaagagggaaggaaagaggaaggaaggaagggaaggaatgaaaggaaggaaggaagggaaggaaagaaaggaaggaagggcttactcctaatggcttaggagtagggaactggaagagctaatctattgcaaaatgctcttgtctgacttcagtctatgaaactatcttacaaaattactcctctctaaagaagactaaagccctcaagtcagtaaaacagttggttggcaggctgcctctgtttcctgagaaaatgtctgtactgcatttgttggataatttcatcttagcctttatcagtttactgtgctttgtttacaattctggtgttataaaaaatggcatcaacaagttgtctgatttttctctaaattactccttctctttacagatttgttttggttactggtcttacaaattactcagtcattcagatttaatagctgactgacattcatcccaactctgccacacaggagcagtgtgacattggataagttgcttaacctctctgatttctagttgcttatctgtgcaataaaggtaaatgtgtaccttcatgggattgttgtcaaaattaagtaagattgttttggttgtctattgctgtaaaacaaactatccaaacattagtgagttcgaatgaccagcaattatttgtcatgattatgtagattagtcggggggttcttcttatcagcagtaggatggctaagagctccagaatcacctcattcacatggctggcagttgctactaatgattgtcagtcagggggcctccatttttctccacctggttgtcgtatgtggtatgtggtattttgatctcctcacagcaatggcacctgggttctaagaaggagtgttctaagaagtgaagaccaaggctgtagacctcttaaggctcagacatgaaagttgcttaatgccctttctactatattctgttgatcaaattaggcaataatagggtagaccagatataagaatgggggaacaaattctgactcttgatgagagaatgacagggtcacattacaaaggggcacataggtgaggagcactattgatgtgaccatttttggaaacatgctctaccaccatgaaaatgtatttaaaactcttgggcaagatggcccaataaaaacagctccagtgtgtggctcccagcaagatcaatgcagaaggcgggtgatttctgcatttccaactaaaatacctggctcatctcattgggactgattagacagtgggtgcagcccacggagggtgagccaaagcagggtggggcggttcctcacctgggaagtgcaaggggtcagggaactccctcccctagccaagggaagccatgagggactgtgccgtgaggaacagtgcattctgacccagatactatgcttttcccatggtcttcgcaacttgcagaccaggagattcccttgggtgcctgtatcaccaggccctgggtttcaagcacaaaactgggtggcagtttgggcagacagggagctaactgaaggagttttttttcatactccagtggcacctggaatgccagcaagacagaaccattcactctcctggaaaaggctgaagccagggagccaggtggtctagctcattggattccacccctacggagcccaagaagctaagatccactgccagcacagcagtctgaagtcaacctggaatgcttgagcttggtggagggaggggcatccgccattactgaggcttgagtaggcaattttcccctcacagtgtaaacaaagctgccaggaagttcaaactgggtggagcctaccacagctccgaaaagccacttagccagactgcctctctagattcctcctctctgggagtagcatctctaaaagaaaggaagcagccccagtcaggggtttatagataaaattcccatctccctcggacatagcacctgggggaaggggcatctgtgggtgcagcttaagcagatttaaatattccgggctggacgcggtggctcacgcctgtaatcccagcactttgggaggccgaggtgggcggatcacgaggtcaggagatcgagaccatcctgtctaacacggtgaaaccccgtctctactaaaaatacaaaaaattagctgggcgtggtggtgggtgcctgtagtcccagctacttgggaggctgaggcaggagaatggcgtgaacccgggaggtggagcttgcagtgagccaagattgcgccaccgcactccagcctgggtgacagagcaagacgccatctcaaaaaataaataaataaataaaataaatagataaataaataaataaataaataaataaataaatattccttcctgctggctctgaagagagcagtggttctcccagcacagttctcaacctctgctaagggacagactgcctcctcaagtgggtccctgacccctgtgcctccagactgggagacacatcccaggaggggttgagagacacctcatacaggaaagctctggctggcatatggcaggtgcccctctggggcaaagcttccagaggaaggaacaggcaacagtctttgctgttctgcagcctctgctggtgatacccagggaaacagggtctggagtggaccttcagcaaactccagcagacctgctgcagaggggcctgactgttacaaggaaaactaacagaaaggaatagcatcaacatcaacaaaaaggacatccacacagaaaccccatccgaagatcaccaacataaaaaaccaaaggtagataaatccatgaagatgaggaaaaaccagtgcaaaaaggctgaaaattccaaaaacaagaatgcctcttctcccccaaagcatcacagctcctctccagtaagggaacgaaactggacagagaatgagtttcatgaattgacagaagtattcttcagaaggtgggtaacagcaaactctctgagctaaaggagcatgttctaacccaaagcaaggaagctaagaacattgaaaaatggctagaggaattgctaaccagaataaccagttcagagaagaacataaatgacctgatggagctgaagaacatagcaggagaactttgtgaagcacacacaagtatcaatagccgaattgatcaagtggaagacaggatatcattattaacgatataatgaaattaaggcagaaacaagttttttgaaaccaatgagagcaaagacacaacgtaccagaatctctgggacacagctaaagcagtgtttagagggaaatttatagcactaaatgcccatggaagaaagcagaatagatcaataataagttctgaaattgagatgataattaatagactaccagccagaaaaagcccaagactagatagattcacagcccagttctaccatagggacaaagaggagttagtaccattccttctgaaacttttccaaacaatagaaaaataggaactcctccctaactcattttatggggccagcatcatcctgataccaaaacctggcagagatacaacaacaaaaaaagaatatttcatgccagtattccctgatgaacatcagtgcagaaatcctcagtaaaatactggcaaaccaaatccagcagcacatcaaaaagtttatccaccaagatcaagtcagcttcatccctgggatgcaagcctggttcaacatacacaaatcaaaaaacgtaacccatcagataaacagaactgatgataaaaaccacatgattatctcaatagatgcagaaaaggcctttgacaaaactcaacaccccttcatgctaaaaactctcaataaactaggtattgatggaacgtgtctcaaaataataagagctatttatgacaaacccacagccaatatcataccgaatgggtaaaagccggaagcattccctttgaaaaccacacaggacaaggatgccctctctcaacattcctattcaacacagtattggaagttctggccagggcaatgaggcaagagaaagaaataaagtgtattcaaatagaaagagaggaagtcaaattgtctctgtttgcagatgacatgattgtatatttagaacaccctatcctgtcagcccaaaatctccttaacctacctgataatcagcttcagcaaagtctcaggatagaaaatcaatgtgcaaaaatcacaagcattactatacaccagtaatagacaaacagtgcaaaatcatgagtcaactcctattcacaattgctaccaagagaataaaatacctaggaatacaacttatgagggatgtgaaggacctcttccaggagaactacaaactactgctcaaagaaataagagaggacacaaacaaatgcaaaaacattccatgctcatggataggaagaatcagtatcgtgaaaatggccatactgcctaaagtaatttatagattcaatgctctccccataaagctaccattgactttcttcacagagttagaaaaaaacaaatttaaattttatatggaaccaaaaaggagcctgcatagacaagacaatcctaagcaaaaagaacaaagctggaggcatcatggtacctgacttcaaactatactgcaagcctacagtaaccaaaacatcatggtactgataccaaaacagatatatagaccaatggaacagaacagaggcctcagaaatgctcataatgctacacatctacaaccatctgatttttgacaaacctgacataagccatggggaaaggattccctatttaataaatgctattgggaaaactggctagccatatgcagaaaactgaaactggaccccttccttacaccttatacaaaaattaagatggattaaaggcttaaatataagacctaaaaccataaaaaccctagaagaaaacctaggcaataccattcaggacataggcatgggcaaagtcttcatgactcaaacaccaaaaacaatggcaacaaaagcccaaatagacaaatgggatctaaataaactgaagagcttctgcacagcataagaaactatcatcggagtgaacaggcaacctacagaatgggagaaaatttttgcaatctatccatctgacaaagggctaatatccagaatctacaaggaacttaaacaaatttacaagaaaaaaaacaaacaacaaaaaaccccatcaaaaagtgggtgaaggatatcaacagacacttctcaaaagaagacatgcagctaacaaacatatgaaaaaaactcatcatcactggtcattagagaaatacaaatcaagatcacagtgagatactatctcatgccagttacaatgacgatcattaaaaagtcaggagacaacagatgctggagaggatgtggagaaataggaatgcttttacactgttggtgggagtgtaaactagttcaaccattgtggaagacagtgtggtgattcctcaaggatctagaaccagaaataccatttgacccagcaatgccattactgggtatatacttaaaggtttgtaagtcattctactataaagacacatgcacatgtgtgtttattgcagcactgtccacaatagcaaagacttggagccaacccaactgtgcatcagtgatagactggataaagaaaatgtggcacatacacaccatggaatactatgcagccatgaaaaagatgggttcatgtcctttgccaggacatgcataaagctggaaaccataattctcagcaaactaacacaagaacagaaaaccaaacaccacatgatctcactcataattggaagttgaacaatgaaaacacatggaaacagggagggcaacattacacactgaagcttcttggagagtgggggactaggggagggatagcaataggagaaataactaatgtagatgagttgatgagtgcagcaaaccactattccacgtgtatacttatgtaacaaactggtatgttctgcacatgtatcctagcacttaaagtataatttaaaaaagtaataaaatgaagtatataaaaatggcaaaaaactgttaacacagtgccagtcacatgggcattgcttaatcagaggcaactgttatcagccttgactgtttccctcctacatctttagcttcactacctgccacttctgtccccatagtgtaccctttgttggttcccttcattcatctagtttattctgtgcttataccatctcaaggactatttaaaaagttgtcgaactagtctcaaatttgaacttctttatttcacattttgtcttgtattaattggacatctacttgagtttagccttaatgaatcatatgtaccttgagagtaggaaacatattcaatcaacattctggaccttgtattacccagcacagtgccttacatatggttggtgcaatctggtaattaattgcatggcaaattggattgaagataatagtgattatagttattatgcattattgagtttatgatgtcatatgttgttctacatgatttgtatttatttattttcgtatcgacctaatctgatgattattattgtaatcctgattttatggttgagaaaactgagggacaaaggtgttaagaaatttacctgaggtcacacaactaacaggagttgaggccacctttaaaagtcaaagggtttggctctaaaacccaaggatttaaatggtcatgagtgtttgtacattgtgaattttcacacatttatgtgaaagtggactaggtttcagcgacagatcaatatctgcttttgaaaaaaatactatagactcacagaatttaagaaatgtaaagaaagctcagttttgcaaaagctgaagcccaagaaggcaaagtcagttgcctcaatctcacaactactacatagctgagacagaatgagaatccacatcttctgatttcagatgaagttttcgttctgttattccacagctatctcctgatgtgacctgtaggaaatgccatttctgacttttaaaaatacttaccatatgtcaggtatggttgtaattggtttacaaatattaataaatttaattctcacattcacccattatgttgataaagaacctgaagcacagaccagctcactgacttgctcaaggtcaattacagatagtaagtagggaaccaggattaaaacccagcccagggcactggagtataaccatactactaaagctatctctcaaaatgttggattaactagatatttgtgaacgaaaaaggaagactatccagacaaacgagatcatttggtaccagaaccaagcatcaaatattgaagacagatgacatttcaagaatggtaaatcaaatagtcaacttatttccttagagtaatgacagacaaaaagagagaacacttaaaacaggaatgatgtgctattgaaacaaaagaattgctaaaataatgatatggagtagacacaaagaattttgcaagtaagaagaggatttgtaagaaatgtagccagttctgggtcattacagcagttgcgaaaaggtgacatcactaaaggctcagttgggaatacgcataatttctgcaggaagctgattaaggagctagacattttttgaagggaggcacttggtccttggagtttccctgacaacttgcataacattggaactcagtgtggtaaattgttcttcacatcaaaatgaatttgcttacactgatatgggaagctactgtgattgctccaggaaatgcaaggaaaagagaaaagagacatatttgaagtggaaaaaaatgacttaacttcacaaaggcagttaaaaaattggaatgtcttgttaccaattttgcaaatacttaaaaaccaattcagcctgagtaaaaacagtctactgatgaagactctcatatgggctctgatcagtttaagcatctggtttgctacagttaatgccaaatttagtgcatacacaatagatgtaaatgaataaatgttgccacaaaagagagagaaaatattgtatatgtctaaacacaaggttactacttttttcctttctatccctcataaaaaggaaatgccttaaattcaaatccttataaatgttctcataataccgggtattatcccagttctgttattttgaacacaagaaactattttggggagaaaaaatgacattatctatgccagcttatgattttaattgaaattatctggagaataaattttaaaaaaagaccaaaaaaccccctctcaacaaataattagttattattcctgggagcgtagtctcacaattgcaaatattgaatgtcattgtttaattagcttgattgtgatgacaattctgcattatatgtatatatatatatctctaatcatcaagttgtatactttaaatatatggaatttaaaattatcaattatacttcagtaaatcttgaaaaaatacaaatgtaaatactgataaccatacaaaacacttaataacacagttcagtgtttggttacattgtaaagatcacaaatacagacctattagacaaatggggaaggaagaagcgctgatactatgcagttggattcgtgtgactttgctggaaaaggcatcaaatacagattcaaaaagtgctttatctcaaacaacttagacagatggaatggtgatgaatttggaaaatctgagagaacttgaaaagtggctctgggttggggaaatcctttaggtcaagattcatgggaagaaattaaataaaattatttaatatttttatagtaaagaaaagataatatttctatactaatatataatatagtccatgaaatgatatacttaatatagctatgcctaataactgaacccataaatcaaatattatacagatatttatttaatatattccttaaagttattcaagttggtctagaattttttttcattctttagatgttgtcattaatttaaaaaaataattattttaattatatttggaatttatttctatgtaggcatttacattttctcctatctgcagcattctgtgggaaaagggatcaaaggagattttgaagttattgcaaagaaatctataatagcaaaggaagaagccagggtttctggacatatcgatagtattatggaaagaaatgcaaaggaatttaagacaagataggctacattcagggtgatatggtcatagacaaggaatttcaaatgaagttatgtttaactacttaaggctggtactagagcacacctatggtacttcatctagttttgatattttaaatttataaaacatgtaatttctgttgaaggtgtacagtgtcactttatgataagcttcagaaaaagatgttgaaaaacctcatgattaaatgaactgttttctccaaggtaagaaaagcctctggattcatccttttccagtgtgcaggttgtgatagaattaagttattttgatctgttttatttttaccagcagcaagatctgtgtatactcagtaacctcatccattcattctttgactcctttacttgtctctcaatgttctttgtcttccattgaatacttgctttgagccataaactgtgcaagcactgagactgcagctctgaaaattgttgtgctttctctcaaggagcccacagggctgagagaatcaacaataatcaggcaattataatggagcataataagtattgtaatggaggtataagcaggatctatgagaggacagaggcggggaagggaaatcatagtaacctctccagagtaactcctgtctcagatgagccttgacaaagtttaggatgagggacagaaggagggagggagtagagaaagagaaagagagaggagagaagaggagagcaaaatagggctgagagggctgccatcacctgcccattgcttgacatgcaaaccttttactttttcctccatcattttttattttgtaccctataattattgttgaactcattttaccccaaaaagtctgccctgattatgtttttaatctatatggaaagattttcaagatttaaggtgaacagctgatttttctatgaaatgtttttgtttcaatgatactctttacattggttaattaacctgattcaaaatctcactgtggttggttctaattcttgtgattaggatttattattttccttaagctagttcccagcaccatcagtagctctgcaaaccttttctattctttgtcatgattctatctcaatgtcagtttctctgagctcatgttttatcaatttgttattttcagttcacttcttatttatttcttctcttctcagatgtctccttagtagtgaaatggatctcatcttcccttctttggtgctcagctccagagtgagctcacctctctgacaccgttttgatctcttactctttctggaagtagtaggtctgagaattgatgtgctttctttcaaggagcctgcaggagtttctgctgaaatcttatccatcaccctccttagtcagccttcctagagcaggtggcataatctactcttgccaagagctctgagaagccaccaataggccagtttctgcccagggtctatggtaattcccattaccacttttctgcagtagtagcaggatgtataccatctggaccattcggtgccatcaggaaatggtcaaaatatttgcatgcccctcaggttcaagtaaataaacagcagcagcagcagcaacaacaacatttccagtgaaaatgaccctgtcactcttctacctgatactttcctcatcttttcccaagaaatcacctttcccccgaaaaaagattatctgctctccatcttctctctcctgtgaggctattttgtatttgtctagagcactccagaagtgggcaactgaagttactagcattacttgaccatggttatagtttttatacagattggcagatgctttttacagtctgtggctggatttcattggaaaaagcttaaaattcacaggaggaggaaagtacttctctcccaggatccccactgagttgataacagtctatgggaagtcatctatttaaacagaaataaacatgccttgggatgccaggagactattttcagttttattaagctattttcagctttattaagaaatctgtgtttaatttttgcagcattttcagtcctgttcatttagcttttctctgtgtgtggatcaattagatcacttgatgagaatgcagacatcgcattctgctccttccattgcattctgctccttccaggatcacagtacatttggaggagagtaaagaacctggaacaccttcaatcacccagccagaaacttgtgcttaattgacttttcatgggaaaaagtagtcctgattagatattgcctgtgtctgggtcctgggaaatttcaacattttattgtcttatatgtgtgtgtgtgtgtgtgtgtgtgtgtgtgtgtgtgtgtgtgtgtgtgtgtgtttattttttggacccatataaattggtagattggtcacctgtaataagttagacactgttttaggtcagggtgagcaatctgtgcatatgtaaagggtcagatagtaaacattttaggcactgtagactttatggtcttcatcgcaactatttaactttgacatctgaaagcaataggagccatagataatatgtagactaataagtggctgtcctctaagaagactttatttatggacattgtaatttatattttgaatacttttatataacatgtaatattttctttaatttgtttttcaactatacaaaaatatgagccatcatttgctcccatgccatactaaataagcctgcaggccataattggtgaacctctgctataggcaaagcagcttaagtaataaacaggacagaaaccccgacctcttgtgactttcgtagagaaattagacaatgatcacgtaaacacacaaataatgaatattatttcaaattctaagtgctaggaagaaaggaaaacaaaacaaaacaaaacagctgttgtgactgaaaacccctggtggtaagaggactgagggcatgggctgcattagctgcttagagaagacttctctaagatagcatctgaggtgttctctgaatgatgccagggagacatgtgaatgttgaaggaacagcaaaggcaaagctgtgagtcagggatgagctcaggatgtttaaagaagcaagaatacttttctggcttgagagaatattacagaggagaaggaggaaggtaatgaaatgaaaaaggaaggtagggacaagtgaggtaggacctggaggccagaaaaagggctttaggtttattcacatttctgggctaggacatgggttttttaataagctgaagagtgatgagaagtggtttatacctttagacagatcactttggctgctgtgtggatgagggaccatcattggaaaatgagagtagaggttaggaggagggtactcaggaggctatagtgggctctagcagtccaaaatagaggcttttccattttctcttcttctaacacttttctcatgtgtgagtctggtagaagcttgggggaaggtgagaaataatgacacaatgcagttcaggttggactactgaatgagattcgcaccaataacattttcaaattaactccatattatttctttttttaattattatactttaagctctagggtacacgggcacaacgtgcaggttggttacatatgtatacatgtcccatgttggcatgctgtacccattaacttgtctttacattaggtatatctcctaatgctatccctctccccaccccacaacaggccccaatgtgtgatgttccccatcctgtgtccaagtgttctcattgttcaattcccacctatgagtgagaacatgcagtgtttggttttctgtccttgcgatagtttgctgagaatgatggtttccagcttcatccacgtccccacaaagaacatgaactcatcttttttatgactgcatattattccatggtgtatatgtgccacattttcttaatccagtctgtcattgatggacatttgagttggttccaagtctttgctattgtgaatagtgccacaataaacatacgtgtgcatgtgtctttatagcagcatgatttataatcctttgggtatatacccagtaatgggatggctgggtcaaatggtatttctagttttagatccttgaggaatcgccacactgtcttccacaatggttgaactagtttacagtcccaccaacagtgtaaaagcattcctatttctccacatcctctccagcacctattgtttcaggactttttaatgatcgccattctaactggcatgcaatggtatctcattgtggttttcattttcatttctctgatgaccagtgatgatgagcattttttcatgtgtcttttggctgcacaaatgtcttcttttgagaagtgtctgttcatatcctttgcccactttttgatggggttatttgattttttcttgtaaatttgcttaagttcttggtagtttctggatattatccctttgtcagatgggtagattgtaaaaattttctcccattctgtaggttaaccattcactctgatggtagtttcttttgctgtgcagaagctctttagtttaattagatcccatttgtcaaattttgcttttgtacaaaagccaacagaaggcaacaaaactccatattatttctaatgctcacaatgatagctaaggatttgggggatatttaataatgtagcattatttcttttaatcctcacagcaattctgtaaggcaggtgtcattatttactccatcaatgaagaaattgaggtactaatatgttctgcaataggtgaagatatctcaaaactggcaagtggcagaggcagtataggttccatgcttggctcttaagcccatgatctgttcacttgctcatcttctcctctgttttagttatctactgctacatataaaaccaacccaaagtgttgtggctttaaacaacaaaaatttatgatttctcatgattcgtgggttgaccaggctcagctgggtggttcttctgttccatatgttgttgactggaattatatgtgaggttgcagtcagatagaagcccatcacagcctgaggcctcccagatgccttcactgtcatggctagtagttggtactacttggctgaggtgtctcttgttttcctccatgtgacttctaaaccaccattatgttagacagaatttcttactgaatgatagatggattctgacaaggaagcttccagaaaaccatgttctaatgtgcaaatggttatcaagctcagcatgaattacatttgatgatgttattacctcagagtaattcatatggccagttatgaaattaaacttaaaaaagaatctacatgaaaggtgggctcatttatggaaccaacccatacctataatattattattttggcttctgcctttagatagaaatgtaggggaatggtttcctcttttgtagaatatcagggccctcttctcagtaattaaagatagactaaggcaccagatatttattaactcatgtgctgattagacatttgttggtttttttcctgtgagtgaaacactgctctaggttctgtgggagaaaacaaaaaggagaatgggggctaggcacagtgattcatgcctggaatttcagcattttggaaggcctaggtgggaggatcacttgatgtgaggagtttgagatcagcctgggcagtatagtgagaccctatctctacaaaaaaattaaaaaaaaaaatagcttggcatggcagcacatgcctgtggtcctaggaactcaagagactgaagcgggaggatcactggggccctggtatttgagaatagagcaagccatgatcatgctgcttcatgccaacctgggcacaagagcaagaccccatatctctcttttgctctatatctatatctatatctatatctatatctatatctatatctatcttctgtctatctatacacatacatacatatatagatagataaatagaaacaaataaataacagtgtaagacatgggccgttccctcaaggtgcttagtgtctaggagaaaatatgctaccagctggttatctaaaacatatgaatgcatgtttgtagataaaatgtatactttaagatatattgcaaattgtttttttagaaggctgatgtttttcaaaagaagacatacaaattgctaacaggtatgtgaaaaaatggtcaccactaatcatcagagaaatgcaaattataaccacaatgagatattatcttaccctagtcagaattgctattattaaaaagtcaaaaagcctaatgggtttccatctgactgtagccttatgtatgattccctctccatgaggatgtggagaaaatataactcttatgcactgttagtgggaatgtaaattagtacaacctctatagaaaacagcgtggagatttctcaaagatctaaaactagaactaccattctattcagcaatctcacttctgcgtagttactcaaaggaaaagaaatcaatataccaaaaagatacatgcacttgtatgtttatcacagcactattcacgatagcaaagttgtggaatcaacctaagcgtccatcactcaggttgaaactataagaaaacagaaacatgtttcttacagtttaggaggctgggaaacccaggatcaaggtgctggagaaagcttgatctctgcctccaaggtggtgcctcattgctgagtccactggaggggataatcactgcgtcctcacatggtggaaggcaaaagggcaaaagagtcctctctttaaccttgagcccttttataagtgtgctaatcctattcatggggcagaattaatcacctcccagtggccactcctcttaatactcttgcactggggattaatttgcaacatgaatttcggggaaaccatcattcaaaccattttgaatggtcacatgctcatttaattttaatttctaagcagaacttactgatcatggttataatacaagtgtcgggtattctaatgagatacaaagccaaagaaaaaccaccatgccatttaacatgtacttagactattccacacactgtctaaatgcgtcctatgtattatttccttttatctctgtagatgcctttgtatatgtactgtaattatcttcattacctagataacaaagtcttaggaattgttactttctcaggagtcagagacagggcttgaaccctggtccctttgactccgaagtctattgtctctaccactgtgtgacacagaagtgatgcagtggggaaaggattgcagtgggaaaaggattggaatagtgttcaggacacttgagttccagtccttagggctgaaccaactaatatgttatcctgtacaaatcagcttcttttgtctgtttttttttttctctctctctcctttaaagcataggagtctacagcctacatttctatggtaatttagagcttatattttcctgacagcttacattgtaaatcttctgcactcctattttgtcttgccctgttgtatttttttaaagagtatatatcacctaatattctgtatcatcgacttaattattctatattgtttcttccatttcccctgcagtagggtgcaaataccagtgccaccaaaatttccaggcacatgggagactcctaataaataatatgatgcacactttttaaaggaagatgggagtgggaggagaagataggaagtaaggatagaaaatatgatgtaacaagaaacaagaagacattggtgtactggtattagaatgatttttatttctgtggggaaacaataaaagaagatgggactgtaggcaggatgcacaattaagagggtcttccatgttatatgaaagagtccagattttgttaggtgatagaaagctagttttatctccaggacttgttagtggaccaaaattctaggagtgcaatggttgattctaagaaacaacccttgaggcttaattgtatttgaaagtgtcatttaactttatgctcaaatgtatggtcaatctttcttgggaaatgacaagagccatcaaagaaataagaagtgatattgtactctgagctcagtgagaaaaatgtgcagatgcagatgtgttcgtccttatttatggtaattgaattttaaatttaatttagcagtaaaagtctgctatttagaggattgttacactgtaaaagacttgagaagcacatagattctaagggtacttagagtatcgtttgatgcctgatgggtgacaagcataaatgcatccaaattaatcataattgccattctagcaagtgaaatgcagcagtgtgtttttcaaaagtgtgcttccaaaacataaaaagaatatgataaatagcaagtcaaaagactgatgctacaaggcgatgttgtgaatgaacagaggctaccaaactacatatctagtagtgtatactacatatctagacagtatagattctatatatatgtacactacatatctagacagtatagattctatatatatgtacactacatatctagacagtatagattctatatatatattacatttgttacaagcatttcataatccttttaaaatagctgcatattattctattttgaacaattacaaaactatataaaagctttatacacttttggacatttaagatttcaaattttcataatcataattaccactacaatcaatatctttctgcactgtttgttttttctctgtattaaggatcgttctccagagagcccatactcgcagtgaaattactggatcaaaggatataaattatttttgcatcaattctgtatgccaatttggttaaaattggcacttgttagtgtttttatagattagtattactgaggttgagattatatttattagccagttgtttgctcttctctgaaatgcctgctcatgccattggatattttatcttttggagcctggtgtttttcatttggatatcacactcagaattctacgtacacaaaaagccaagtctcagtcaagccaaattgtcaatatactgaaacaattaatcaatttattggaacagttggtcaatctactgacatgacgggtcatttcatctataagagtggatcaattaaatggaacatctggtagagtaaaggtgctcccaataaatcatgttagaaagtagagctgaaaataaaagaataaactgcataagctagttcacgacttgctcatgagtgcacaagcacctcttttctgattcttactgaagtataataataatgatgatggaaagttcaagaaacatctgttttccacatatactaggaacctctgcactaattgcagtatgtcgatgtttttattttctttctcattgggtgttctgagagcaattatccctttaaaattaacagcctcagttctctcttttcagtgacctttactcagatgaaactctcatcaacttcacctaataaatgagaaagctcattccctcatttatcataggttctactctgcagttggattcatgccagatcaaggtacacggaaactatccaaaattatgagcacaaggttattacactgtacgtgaaagagaagaatatttttttccacctgagtttgtgaaagtttttcattagcagggatgctgtctcccaactttgccatcatgagcatagaatgtaataacatttaagatgcaataggagctaaggtcagcaggcataaaaggggtctgaattctttcagtcttacctcatgccattaattggaattagattcttgaattatatgtttgttttatgaagaattagggtattgagtcaatagcgtgcctttttccatgatttcctattcatttaagtaatttatttatgtctggatatttgctctaaaaatagacactgttaattttgtcctgcattattgctgtgctgtaatgagccttggtgaccctgcatcaggggacaccgttttcctcttgcaggtgtcatggctgtcaacatcgacagctctttgactaattaaaatttaacagatggtagtattcatgcagctgtaataagattatatctgatttactgtagatgaaatagtccaataatttaatccatttgcagctaaccctggatgtgtgtgtgtttgtgtgtgtgtgtgtatgtttttgtacatgtgtattgataagataaaagtaaatttatgtaacagaaaaaaaagaaaaaaagggcaatttcttctttctttattctacacttattcccaaacacacacctacatatttaccggtacactcacacacaggaaaatacctctccaaagagcaatggctcataataaatgtattatcatttttaaactcagccaagcatggtttctttctggattttgttctgaatatccaggatgttaaggatattctggatattctgcccaatggagtagagatctaaccagatccttaaaaatggacccaggacacaaactggttccatggtctttaccttgacaaaatatagtagtgacacatctccctagctttattctaagataacaggcaaaatttatttatactctttcaaaagagaggcctatatgaacccttactttaagcaagcagattgagccacagttcaatatgaacccaaggtcaaattttaattagcaagtaaaaaaacaagtaaccttgtactcagagttaattttttaaaaattattgagtaaagttctttgtttttattgcacctcagaaagatttagggccatttgtcatgaataggagccaaactaaattggtcatatggaacaaaatgctaagtatgattacttacatacaggaaaaagcctgactcatgtggaatcacatagctctaggttggaacgccggctttgccacttatcactgggtaacctttagcaaattactcaactgctctgactctcagtgtctttatcaataaggatagtaataggaaatacctcgtggggttgctgtgaaccttaagagagataatgtatgcgaaggaggctatagtgtatcatagtagaaagctattaaagataaccatgttgctaaatgtagaaactgttaaagaaaactcactagatttgaaaatctggtttctgagctaagacatcaaggaagcaagctgctgagaacaagagcatatttagcctctccactccctctgagaaggctgggtaataggtcataagaggggactcctctggactgtaagactctgcatttctttctcaatttaaagaaatatgtttaaggagtatataggaatgaaaatgtgatgaaagcagcataatctataaggaataatcaataagtgtcttattcttttatcatggagcttatggtttaatttccaagattactgtctgttctagggagaaagatgtttttgaagggatgatcaggatctcaatttttaaatttcattcctccaaaattctactttcatcttctctccctcctcccccaattcactatcaattcttcaactttactttgaagtttatctagctgtgggaaaccatttccttattacattatcttgtgataggatcataagccactgacattatttctaattatacacatagtaaagtgcttaatttcctccttgaaccactcacatacagtatgtcaaacatgttccttttgatcatcccatggggttgctattacattataggaattttatcaaaaggaaaagagtttaggagcaagaaggctctaaaatgccttgaaaaaaaagcaaagttcctgggtggtgttaactttcagctaaacccaagtagttatcatttttgggaaacacttatttgagccagacatcattttagacatttagcatatgctttcatttaagttttacatttattttgtatagtaagggtattgtccctattttattaaagaatcagctggacagagaaagttaatgttattaaggtcacataacaagcagtttgattcaggtcaaactccaaagctggttttattactctatgtatgcctcttaaagcctattaaaaaaacccactctaaatatatatatgtatatatatatatatatatgtatatatatatatatatatgtatatatatataatatatatatatatttcctgaatatgaataaactttctatcatttcttagaatgatttttaaaatgcttgactttcctgctttttattattcaaactctacttccacaataagaaatgatgtgaaaacaaatattccttaaaatgagtttaccttaccccttccaaattgaatgagtggatgggaacttttagaaattgtaagttatttttaatctttcactttacaaatactaacttattcttcattccagtcggtattctaatgttgcttattgtattagtccattttcatgctactgataaagacatacctgagactgggaaggaaaagaggcttaatggagttacagttccacatggctggggaggcctcacaatcacggcagaaggcaaggaggagtaagtcacgtcttatatggatggcgtcaggcaaagagagagcttgtacagggaaagtcccagttttgaaaccatcagatcttgtgagactcattcactatcatgagaacagtgcaggaaagacgcaccccattaattcagtcacctccccctgggttcctcccatgatgtgggaattgtgggagttacaattcaaggtgagattttggtggggacacagctaaaccataagacttatgatcttaatgatgtagtttattttagataggataggcatggcagatacaacttcttagtcttcacataaaggcatttctacttaatagaatatgtagggagttctgataagtacattagatgaattattttttaacctcaaaagaactatatgagaaaacagctatttaatttaaaataatagataagaagaatgaggttcaaaataactatttacttgttaagcctatgtagaactagtatgtggcagaactcagatttgaaaccagatctacctggccctgaaacatgtgtgctttcttttacatcaatcctaataaataatactaacattgactatcactgtgattaatatccagacatgctgataattacggtattaccttgacatttagtgctatgcaaggagtaatataaatttcactcagcaaatattcactgagtggctgctatgtgtcaagcatcatggttggcaatgtaaagcaaaaacaaacatggtttcggtcctcctaatattggtaatctagtcagaagatgtatcatttcacataataggacaattgtggtacatactgtgaagtaatattgagtgtatgattataaacttgacctagctcctgggtcaaggaaggccatcatgaggaaatcacaggttgaactaagaaggtatcaaaatttgctgacattccttttgatcatctgtgaggttgatgttgcattatagaaatctaacacaggatgcgatttggaaagatggtgtccaagcagaaaatgttgttataggctatgtatagaatggaatcagcttgttgatgctatgcaggttcagagatgggaggaactttccatgttggagtggaaggggagaagtctcagaaggtaatgtgggctagatcctgcagagacctgagtgcatgttagatatattcatctgtatctgatgggtgctgagaattcattgaaaggttttaatttgaatataatctgtcattcaagttgactgagctttcttttcaagcttcggtatatgggcagcagacaccaagcaagtaacccatgtactggctttatgagctgaaaattaatctgtgcgtttcagtaacaaaatctgtagctttactggcttctcatagtgtttaatgactctgaagcagcttattgatgctgtcaggaaactgatacatttgtaaaaagaaatgcattacccatgctataaaattaaatgttgcattgcaaagcaatatactaaatatctctttagtcaatttttgtaaactaaatgttataaaattatattagaacagaaagacagcataaatctgtgtggaatatatgtctttaaggcgattattttgttactctgtactgataggtaggtttaattacctttttactaaagtgtgtatttcacatgcctgggaaaataagtgcattattttgcccaatttgtccttcttgtttacatacgtatatttggggctttgaaggcatatgtattttgggaactgcttttttatatttgcataaaatcaaatacataatttttatctctttttacacaaatattaacaacctgccactgtgtagccgggatcctgtttaagaacctctaaaataaagtgtgactattaatgcctcaattaacttttaatgcaagaattgggactgtctctagagcatgttgaacctatccttcataatggataatgctgaacattttcataaaaagaggtcaaataatttcttctaatgcccatgaaaatatcagctagcatttattgagcacctactatatgtgccagctactttacatattgtctcagttaattctctcaaactcagaggtattattatttcattttatacatggtactattgtctgaatgtctgtgcctgtctcctctcaaaataaatatgttgaaacataatcacaaatattattgtattagaaggcaggatctttgggatgtgattaggttataagcttggtgccttttcaacagtgggattagtgccttcataaaagagaactagttaggtccttccaccatgcaaggacacatcaagaaagcaccatctgtgaaccaaaaaagtaggcccttaccagacactgaatctgccagcaccttgattttggatttcccagcctccagagaattcaatttttattgtttgtaagttactctgtgtatggtattttgttataacagtgtgaatgaactaaggcagtaagtaaactgaggtgtagattggttaagtaacttgcttagtccacacaactaatgagagttagagcgtgggtatgaatccagctagtttgactggtgagtccctactcttagcaactacccggaagagctctattccagtgtatgatggctcttttagaaaggatttttttttttgtatgatagttttttctttatttttggaatgattactttgtccaaatttaagttaacacattgctttccaaattaactaactatccagaaaaataatttaataacattgattagaaggaggaaaatagcaactgccatcaatcacaccctgattacctgccagacactggcttcagtaccttacattttctcatttcattcttacatctttgagggaggtatgagtattctcttttctcagactagcacacagaaggttagaggattgaagtaaactgtcccttcagtgacaaatgtaagtctgtagattaagtctcagcaatgcacaagtacatgttcttgcccagtacacagaattgccacaactacacatacctttgcatgcaatgaaaatatggataagtgaaatagacaggaatggataaaaaacattttatagtttattaaaatatgaagtatggcactgcagttttataaacctaaatgtcactgcatttaatgaagccatctcctcttactcacctctcagaggagagggagatcaggggatgtctttcctccacataagtaacccttttatagcaatagtctcccacctgtaatcccagctacttgggaggctgaggtgcaagaatcccttgaacctgagaggaagagattgcaatgagccaagatcatgccactgcactccccgtctcaaaataaaataaaataaaataaaataaaataataaaataataaaaatcatgagacagatcccttgtcagctgtcatttaggatttataaaggtgaatgaggcatgatctcttctcttaaaaagcatcaaattcaatgagaaagatagaagagcttagagtgagtgtgatctgttgaatctatcagcaagatgaccttagattctctgtaatgcatgttttgtttccatgtctttaacttttttggctttgactatttttaggcaaatccaaagaccattgacatgggataattctcaattttgatgatacactgattgggatcttttaggcttgagaatcaagtcattagcactccgaaaatagggagttatccaattaggcattcaacaaacacttctagagcgcctgttacagtgactgaggcacaagctccagagtctgctttccaaggtttaaatccccactgtcacctactgtcttagtccattttctctttctatgactggatacctgatactaggtagtttataaaggaaaccaatatacttcttacagttctagaggctgggaagtccaaggtcaaagggctgcatctggtgagggccttcttgctggtgggggctcacagcagcagctctaggtagtgcagggcatcacatggtaagaggcttttgagaaacagccaaacctggcctttataagactcactcctgtgataacccattaatccattacttcattaacccttgatatattcccctccaaatctcatattgaattgtaatccctagtattggaggaggggcctggtgagaggtgattgcatcatggcagtggatatcttgtgaacagtttagcaccatccactttgtgctgttcttgtgatagtaagttcttgcgagatctggttgtttaaaagtgtatggaacctacactctgcccccccccccccccccgcgacccccacttgctcctgcttttgccatgtgaagtgcctattctggctttacctccaccatgattaatagctccctgaggcctccccaggagcagatgctgctgtgcttcctatacagcctgcagaaccgagacccagttaaacctcttttcttataaattacccagtgtcaggtatttctttacagcaatgcaagaatgacctaacacaaatgggttgatccattcatggcccaatcacttttaaataccccacttccaatactgttacattggggattaagtttcaaaatgagtttcagaggagacaaatatttaaaccatagcttttaataactctgcaatgttgagcaagtttattgatctttttagacttcttgctcttcatctgtgaaatgtgaatactattagtaatgatgccatagaactgtggtgagagtataatgagatagtagaaataaggcactttagcataacatctgagacacagtaaaggcttaataaatgttagctgttattaccaagagcagcatttttaggtactctacaggatgctggatataaaatgatgagcaaacctagacatggtccctgcccttatgcagccagtatttgaggatctgaaagaatactcagcatgcctggagtacgaaaagcagaagaagttattatggcctgtgaaacaggcagaggacaggtactttgtatatataaaatttagccttatacttaagagtaatgggaagccattgaagtggttaaggtgagctgacattttagatttacctttggaaagattattggctgatggctcgatggactggaagaaagtgcagtggatacagcaagagggctttttttttttgagacaaatctcactctgacgcccaggctggagtgcagtggcgcaatatcagctcactgcaacctccacctcctgggttcaaatgattcttctgcctcagcctcccaaatagctgggattacaggagtccaccaccacacccagataatttttgtatttttagtagagttggcgtgtctccatgttggccaggcaggtcttgaactcctgacctcaggtgatccgtctgccttggcctcccaaagtgctgggattacaggcatgagccaccatgcctggctgagagctcttaaccagtacacaaactgccttaactataaacacttttgtatatagtgcaaacataaacaggtggaaaagtcagaaatagataagagaaaccttttatagtttattaaactatgtgtcacagaactgtaagtggtgaactgagattggaaccagaatctatgctcctagctacatgatcttgcttagttcagtgacccagttaagacacaagggtcgattggaatagtatagagacagtggccaaggaaagcagtgcaccagattcaggatgggtttaggttaaagaatggacagaacttggtgaaagattggatgtggcaaacaagccaggctttgtctctcagtcactctgcttaaggtaatgcttaacaaatgtctgatgaaggtcactgaaatttctcagatcactgcattagtaagctcagttatgtttttttcaaaagtgttcttgaatcttggagatttgctaaggtcttgatacctcctttctgaatgattgccacatttatggagaatatttagaaccttgtgattgtttcccctgcagagttagtcactttcaaactaggatataatcaacagcattttcccccaatgtgtttggtgctggatttattttccctccaaacatattgcagagctttaaaactgttgtccagtgagtcagtgaaaggaatgactttatttgaatgtgttggtggtggtggtggtggtggtggtgtgagtgtgtgtgtgtgtgtgtgtgtgtgtgtttgctttgttttttggctatggagtgttttaaaagctaagatttagttacaaatattactttttacctattactttatattctttccataagttttcttctccttctataaggtctagtgtttctcagaacgtatttttgggacagtttgtgaatatcaatttgtcaaaaatatgttgacttatagtaatatcctcaatatgccagctttctctcccctttgtgtcatccacagcttgaatcccttccatcaccacagctaaatccctgatttttaaagctgctaatacccaggggactttttaaagaaaatttataacatgaaaacactgtcaagttatgacttttatttgacatcacaccgtcaaagcttttttaaaacacgagatgataggcttggtttttacacatttaaaaagttaatttttctcccattattaaaattaaaatgtagtcagttgaacaatttttgaaaacacttaaaaagaaggaagccaaatcactcaaaggataatatcactgcttacgtgttggtatatttccttccaatcttttcttcacatttagtgtcacagttatggtggagttccagtcacaggggtgccatgctctgtcttagtaagaaatctcaaactggcttcatctagtctcaacatggtcaggtgtccccacctccaatcatacttctgtggtgtccagagtgccccctctgatcctggggactcaacagtatcccagattactgaatagagaattgtctccctaaaaatgggtcagatgtaagtggggaaacttttaagattctagcaggtggcatttctgctgggtcattctcaggaaaaatgctggcagctgctcctcactgacagcaaagagaatgatgctcagagtctcttgtgggtagggcttcctcctggaggtagagctggggaagaggcagggaaaggggtgggccttcagactataatgaaaacgattcataagcacaaaggctggggtgggaacacatacattattatcctgatatgagtttttatattatgtaggtatgattatgatcataatgtaattatcattttcttacataacactttattctagttaatatatttcatctaatgtaaacattttattgtcctaggttagtataaatactagaattgataataagaatcataataattaacacatatatagtgtttattttaagtagagaagctgagactagagcaagaatttatgctcttagccactacattactatttccaaaactcttcgtaaacataattgtagtagctatatactattccattgattgcataaattaaaatttacttaatctttctcttactgaagtaaaggactgtttctagggtttatttctccttccacttattaataatgctgctgtgatcatcctggcacataaagcttccttgttgtttcattgttatagattttttccttaggatatattcatcaaggtgggattattagtacaaattttgctatttacttttcaggtttgtgtaattcacactgccaccagggattggtgagagtttctgccttacatattttatctctctgtggcactcacactaagcattctaggtggaaggcactcttctggctgccaaggaggatattttatatgttcctcaggacagcgcagacccttccttgcggcatttgacagcatatagataagtatggacatagaaagtgagtggtataggaaagaaggcatttcaggcagaggaaacattagcaaaaccagatgtcaaaaagtaaaggccttgatttttgagcacagagtttactttttctaaatgtttgtgatttgtgtgactgtaacaatgagttctgaccctggacaaggcatttatagtctctgggcttctgctcaatagattataaatccaaaagattagatcatttgattataaacttcctcagaattctaatattattattatgtaaccatgtaagttaagtaaaaattatccgtatcttgaaagaaaaatcctatgtgttgcttgaattctaaaatatgtatttcttatggggtaagacatggtgcctctatgtgctttcaaatgaaggctatcatttccagaagacagctattaatcctggaagatttatggtggtatatgtcaattgtgaacaatttaagacttcaaagttcctgttaccctctacagcctataaggatattaatttgtttccctgaccttgactggattctatagcatagcatgctctttctcctgtactgtaaagagaatttcttataaaattaaggaaacataaatcaagtcaaacctgacattggtgtgcagagataggacagtatgtaattcatgttcttaatccagtagacaccatctgccctttgaggtcagggaagcagtgatttaggatggggccatggccagtaatttccagaagttgtgtgtttgaaggacacagaatagtttacctcttcccagaaaatcatttctaggggcttctccatctttccaaagttgctacctttgtaacttctttgaaacaaagttattattgctctatcagaccatatatgtcttatccatacttccggccccactcgagaactccttctttcaggaaggacctcaccctcataatacctctattttttaatataaccagtttatcaattaaacatttatttatcttcttcactagtgtgcaaactccagagcagaatgcttgtaatatatcttagccttcccaactttcaacacatagtaggtattcaataaatgtttattaaatagatacagaaataagtgatgggttaattttcctaataagacattttttctttctgttgtgttcctactttgctttatttctgctaggagtaaatcaaaatcgttaagagtacttgccctagagtcagatggggtgagttaaaatcccgactctagttcttccgagctgtgtgactaaccatagtaaatggctaggctttttgtccctcagtgtattcatctgtgaaatggaattactttataaggctcttctttggattaaatgaggtaatacttgtaatgagcttgcttagaacattgtgttacttgtttcttcattattacttatatgcatgtaaatatgattcctcaaattagaatattctaagtagagcctcgtttaactactaagagtgacatctcagcaatatgtgtgtgtgtgtgtgtgtgtgtgtatatgtatgtatacatattattttattttgtgtttttgagacagagtcttgctatgtcacccaggctggagtgcagtgacatgatctcggctcactgcaacttccaccttctgggttcaaacaatttgcgtgcctcagcctcccaagtagctggaattagaggtgtgcaccactatgcacggctaatttttattttattattttttatttttcagtacagacaggttttcaccatgttggccaggttggtctcaaactcctggcctcaaatgatccacctgccttgaccttccaaagtgctgggattacaggcatgagccaccatgcccagctaaatttatatatatatatatatatatatttttagtagagacaggtttttaacatgttgatcaggctggtcttgaactcctggactcaagtgatctgcccgcctctgcctttcaaagtgctgggattacaagcgtgtgtcaccgcgcccagccggaaactattcaaaaacaaactcttgggctaggtgcggtggctcatgcctgtaatcccagcactttgggaggccgaggcaggtggatcatgaggtcaggagattgagatcatcctggctaacacggtgaaaccccgtctctactaaaaatacatttactgaacagaattgatataggtaatgtggaaggttcagctcatcaaagcactgataactgttaaatctgtcagccttatgacctgctttagactctaaactccatgagagctaggactgtacctttttatttgtgccggcttatgaaattcaacaagaagcagagagtataggagagtatgaaggctgatgggtggagggagagtataggaattggggatatacctcaaaatccctgcaaaagtgtttatccagtagatcacgggacttcataccttctacatcactccagctacttctatgcctgccagagccttgctgccatgtttcagtgggatggttcatccctttttcttcttctcctgctgataacagttatatggttgctcaaaacactggctcaggtcctgttcaaagcagatctacttgaatgtgagcctgtgtcactgtgtattgtttataataataataattatttttgtttttcctctggaaatcaaatgctaaactcttcagaaaactgctcgagagatcatgggaagagatggaagcctttaatcttttattaaaatactttaaacataacattgtgcatttacatcaccgtgatagagaggcactaacagctgcactgagacagtgatgaagtatcagaataaatattgaaaatatttggtgtgaatatggtgctgtcctggcaaggaactcaatgcactttcttatatgttatcttgtcctcacaatgcccctgaaaagtggatggtgtgattcctatttgacagatgaagacactgtactaaagtggttggctggaattgctgtttattccatcagggctgaggctcttaattgctctcttagaatctctgactcttccaaatagcgaaagcccccacatttggttccatttggtctcattgccagctagacatcagctctaaaagcttatttcctttacctgacagggaattctgattttccattccacttgctgctgtccaggatgagacccctgaaatatgctttctatgcacatttaaatattttatgttaatagtgatcaaagtcaaatttcaagtaatacttcctgtggtttattgaccaagttaatttaacattaagaaagaaatgagaatgaatgaaaagcattgcacatttccatatgcaaatgtgtgcctggaggaagctgttacatgtggggcaatcaatacattctagaaatttagtagatttgcacatgactttgacattaatttccacaggttctaggatttgttttagaactctttcttcatccattgtcttccatcacaggacatgatattttctgcaactctgaaattccctggctctgaaaatgcacctttggtgctgtacatgagcaatgggatgctgtctcccaggagatttgtaattgcttggtgctgacaggtgctcattgtgggccttcatttcctacccagcatcagcaatccatctcaccctcagcagtaatcctgccaggaagagggaaagatcatggcccaggggagtgattttcatgcagaattctgattaactctgagatccctcagaggtgattgaagtgggggcattgctagagggtggggggctgcgcggagtggtgggcaggggaggaggtcaaccagcagcatgccagacaagttttctctttttatctcatataaatgttatcttaaaaaataagagttctactggttaaaagtaaaaaataactgatatagaataggagagagcttattataataacagacactgatatttgctacgtgctgaaaattgtactaaattccagctctctcacttgatcctataaataactctatgagtatttccattacttccattttatagataagaaagctgcagctggagatgtgaaatcacttgtccaggccacacagctgataagtggcagaaccaggactccttttctttatcttctttctttgaacaaacatgcatcaatctcctgcacagtcccacacatggtgtaaggtattgagaatacagcagtcaacaaagtgggcagggctctgccctcacagggtttatagtccagcaggatttgaatctagatttatgtcactgtaatatctgaactgttaacttctatactctattgtttctaaacaccaactcctggagtctcatcttgaagtagtctctgggaaagataggagagattgaaataaatagatgaattccaaataaatcagactgtgcttactttctgggagatgtgtgggccaggatgatcccatggaatgatggattctgtgctcctaaagtctaagacaactctcctgttttgcaatgacaggaaatgcgtggacaactcagaacaatccctttccaattttaagctctgactttatagtgtaatgcagagcactagactatgagttaaaagaccctgcttcatgtcttgggccccttgtcatttggggaatgtaatttcacttctttagcttatttccccatctgtgagacaaaattaaatggcatctatggttccttctaaatcagatgctctgtgattctgagtttatgagtttagttggtgtatgccctgagattggagggcatacacccatttgtcctcttcaagatgtggtatctcctacaagagtagattttaattttgttgactataaccaataataataaaaaataaattttacattgtgagtcagtacaaaagcacacacacatacacacacatcagaaaatggtataaaatgctattacttatatactctgaaatactctatggtattccattctagtctggtctagtctactatgtttcatttttgtgcaagtgttgactgtgatccaataaattgatttcatatacatttaataacccactagctgagcctggttccatgaaaccagacttccaggaagagtttctcaaggtcaagccatgtttgcctcctgcttgctttagaagattaacaaaaatatacatatttattcctcagacttctgagcaaatgccccattgccctctggggtgttcattcctccctctttgactaggcaagcaatttctcccaatttcctgctttgcctccatgatgccattagaccctctgctatcctttaagtgaattgaaagtgcccccttaggatagaagcacaagccattgttgtataaaaaagtgatcggccaattcagcctggaataaaactgcttcactcagtcatcaaagggctctttaaaattctctaatgcatggagtttaactggagagaaaaaataatcacccatattcgtctgtacaaaacaatgaagtagagtacttgcagcttttgaagtggctttattattatctggttggtctctctttcacttgatggagaaattattgtgggaatgtaacaaatttttaaactgaggctgaaagctctaaacactaggggatctcagacagtgactacatcacattgtgagacagaacagtgtgtttaaagctcgctgatggttctcttcatgaagtatttcctgacaggaactctaatttattgcttgggaagctaataataaggacaggggagaagaaagtggtcatttagccaaatctacatgaatacttaatttctggtgttctcttctgcttccattagtgatgggcatcatttaatttttgccccatttcttagtgacctaggaaaacctataaatgtagtaaaatatttatatctattgggttttccactttaaccagggttatttacttctgataacaccttccattttacctctgacatgtctccaagatggctgccctcttcatctagctcttaactaaaatgtcacctcaaaaaaagccttttctgaaacacttcactgaactagcttcccgtctttgtcatgttaccctcttttattttacaacactttttaccatctgaatttttcttatttatttttatctgtgtttgttatctgataccttccagtgacatacaggttccactgaagataaagactctatctgccccctactgtaccccagaaggcataacgctccctcacagaatcagggttgagcaaaaatatgttgaatgatattaggtgtttactgtccaccccctaactccaagctaaaaataatctctcctttctttcattctcaagcaacttgctcttacctcacttcctgctttggatggccatttcttatgtaaatgttgacatcttttgccaaatagtaagctcctaaggggaaggattaacatttcattaatttaggagtgtaataaactacccatgtgccagtcatggtgctggatactttgctagcattgttttattttttcctcactgcaaccctatgagacagtcattattaccccattttgaagatgaggattccagacttaaaagctcaagaaatttttttcccaattcatttagctagtaaatggcagagctgggattcggacaaaagagcttttgactctattttattttcccttatatttgcatctctttgggcctttcatggagaattatcttattaagtgtttcaaaaattattggataaaaattgaaaataaagttagcagattctatcttgattctcataaaaggagtactgttgattttcctcaagagattttacattttcttctaatatttgttctacattttcttcagatactgtgatgctgatacaaatacctgcttcctaaagaaaccctagtggcaacttccttgaaacagattagtgatttttcagtcaacattgatgttttgtaagtgcctgtaggttccaggcagtatgatgggaatcttaggagaaaggatttagtaagtacaaaggctgctctcaagcaccttaccgttcaatggaaatattgaactggtacttccttgccaaggtgctagagaacagagatcactcaaaatatgattgttctctcttcattccacaagtaacagaagagggaagagagaataggtgaggcccagaaggaagaggaaagagaactgatgttatagagtaaggtcttgaaaacactgactcttcactgagaaatgcatttctttctccttgtttaaaaagagagttatgtgtttgtgtttcccctttcttctctgtctcctgagtgttttagaatcatccttactttccaacctccccccatctttgttttatagcatatttgtattttattttttgcaagttgactctgactttctccttattagtccttctgtgtgtcttaaataggggtttccttttcttcttggaataaaacaccttggaggaaattcttaaaatacaaaaaagtacaaatgcaccgataattccatcactcagataaagtactattgttgattcccttgtagtatgactactttaatctctcttatatcgtgttttgtcagactgaatatataattctgttttctgacttgtttttgttagaatttattaaacatttaggttgtttctgatgttacctgattataaataatgcttcagaggattttttaccttaagctttgtcaacatctctgatttatttcctctaaatagatcattggaaacaataatttagaccaaaggatttccactaaggctacaccaatttagtttcttaccagtgtggcatgagaattcttgttttgccaccctttcttctaaatttgtgtgcctattttggggtacaaaaataatattccattttttaaggtgaaccttttcattgctaataagattgatttttttccccatttctatactggtcctttgcatttttttaatattaacttattttgctcatttaattttttgaggcaaaattgcatacagtgaaatacgtaaatcacaagtgtacttttaaacaagctatgaaaagtgtattcaattgtttaatctcatcactataaagatataaattattactattatctcagaaaattcccttgtgctgcttttcagtcaatcactgtccatcaattctcagccacaggcaacaactgatctgatttctttcacaataatttttcctgtcctagaacttcatataaatgtaataacataatataaaactctttttgacaagtttctttcatccagtatgtttttgaggtttattctcatggttgggtatatcagtagtttatcccattttattgctgagtagtatttaattatatgaatagacccacaatttgtttatccaccacggatatttgtgttaatcctagttttttttttttttttttttttttttttttttgggctattttgagtaaagcttaaatgaacactcttacactaattctctttttggctttatatctaccattttgctatttttttttttctatttgttccacttattccttgttccttttgttactcattttttttgccttctttttggatgaacagaatagtttttactattccactttatctacactattggcttattggctgtatgtcttctttttttgtttttccaatggttgctcaacgatttgcggtatttcacttaaactcatcagagacaaacttcaaataataggatttttgttcatgtttaaactaaaatatttaaaagggtaaattttaatttccctggtccaatgtctgtgtcttcattgttacacattttaaatttatgcatgttataaactctcaaatacatgatttaaaaaaattttaatagttaatttttaaaaagttaaaaatatcttctacatttggtcacatatttaccatccctagcgatctttatttttttgtttggatccaaatttctgtctgatatcatttccttctacctgaagaacttcatttaatagggtgcaaatttgctggtggtaatgtccctcagtttttactgtctgaaaaattctgtcttttgcctacatttttaaatattttcactgattatagaattatagactacttttttttcttaagacttaaaacatgtcattctttgtcttctggctttgaaaaaaaatgcagactgaatatctctgtcttatgattggatggttaatctatttgcatttaatgttatttaaatagttggattggatttatgcctgccattttactttttgttttctacgtcttgtgtccttttgtttttaaatgagtttcattgtgtgtattaaagtataggacatgatattatggatacctatatgatatggtttggctgtgtccccatccaaatctcatcttgaatgtggttcccataatcctgacatgttgtgggagggaactggtgggaggttatttaatcatagaggcagttacccttatgctgttcttgtgacagtgagttctcatgagatctgatgttttttttttttttttgtgggggggactgttgtggggtgtaggaaggggggagggatagcatttggagatatacctaatgttaaatgacgagttactgggtgcagcacaccaacatggcacatgtatacatatgtaactaacctgcacattgtgcacatgtaccctaaaacttaaagtataaaaaaaaaaatctgatggttttataaggggcttttccccattttgcttggcacttcttattgctgctgccatgtgaagaaggatgtgtttccttccccttccaccatgattgtaagtttcctgaggcctccccagtcatgctgaactgtgagtcaattaaacctctttcctttataaattacctagtctccagtgtgtctttcttagcagcatgagaacagactaatacagtaaatttgtactgtgtagtggggcaccactggaaagatacccaaaaatgtggaagtgactttggaactgggtaacaggaaggggttggaaaagtttggaggtctcagaagaagatagaaagatgtgggaaagtttggaacttcctagagacttcttgaatggctttgaccaaaatgctagtaatgatatggacaatgaagtccatactgaggtggtctcggatggagatgaggaacttgttgggaactggagtaaaggttactcttgctatgcaaagagactggtggcattttgcatctgccctggagatctgtggaactttgaactcgggagagatgatttagggtatctggggaagaaatttctaagcaggaaagtgttcaagaggaagcagagcataaatgtttggatgatttacaatgtgatgatgtgttagaaaagaaaaccctattttctgtggagaaattcaagctggctgcagaaatttgcacaagtaatgagggcccaagtgttaattagcaagacaatggggaaaatgtctccaggggttatcagagaccttcatggcaacccctcccatcacaggcctggaggcttaggaggaaaaaattgttttatgggctggacctatggcctcactgctctatgcagcttgggacaggttgtcctatgtcctagatgtttcagttgtagccagggctaaaaggggccgatgtacagttcaggctgttgctttagagggtgcaagccttcagccttggcagcttacacgtggtgttgagcctgtaggtgcacagaagtcaagaattgaggtttgggaacttccgcctagatttcagaggatgtatggaaacacctggatgtccaggcagaagtatgctgtaggggtagaaccctcatggagaacctctcctatggcagtgtggaagagaaatgtaaggttggagcctccacacagagttcccactggggcactgcctggtggagctgtgagaagagggccaccgttctcctgactccagaatggtatatccaccaacagcttgcaccatacccctggaaaaactgcagacactcaacaccagctcatgaaagcatccaggaggggagctataccctgcaaagccacagaggcagagctgcccaagactatgggagcccacctcttgcatcagcatgacctggatgtgagacatggagtcaaaagacatcattttgaaactttaaggtttaatgactgccctattggatttcaaacttgcatgaggcctgtagcccctttgttttggccaatttctcccatttttaatgggtgtatttacccaatgcccatacctctattatatctaggaggtaactatcttacttttgattttacaggctcataggcagaagagacttgccttgtatcagataagactatggacttggacttttgggctaatgctgaaatgagttaagactttggagaactattgggaaaggcatgattatgttacaaaacatgagaacttgagatttgggagggtccagaagcagaatgatatggttcatctgtatccttacccaaatctcatcttgtagtttccataatctccacatgttgtaagagggacccagtgggaggtaatttaatcatgagggcagttaccctcatgctgttctcatgacagttagtgagttctcacaggatggttttataaggggcttttcccccttttgctcagtatttctccttgctgctgccatgtgaagaaggattgcttgtttccccttccaccatggttgtaagtttcatgagacctccctaatcatgctgaactgtgagtcaattaaacttctttccactataaattacccagtcttgagtatgcctttattagcagtgtgagaatggactaaaacactatagatgtgaaaaggtgattatagtgaagcaaattaacatattcatcatctcatatagttaaatattgtaatagcaactagaatctactcacttagcatgaattctatatacagtataaattatccttctttttaaacccactttttaaagtatacatataagcctttttaaagtacactgtatactttggcattaggtaaatgcttttttgtgtaatgttttaattactttaatgatccttttttactagatgtcttgggtaatttttgtaaatcattcctctagggcttaccatatgtacctaatgagaatctatgtcagattaatagtaatttaataccagtgatctatagagatgttattctcacatagttctgttttctcttcttctttgtgccactgttgttatactgtacatgttacatctatatgttataaacccaataatgaattacaataattatttctatatatagcttaatgtcttttaaagtagctgagagaagaaaataaattatatgtttgtaaattttgtcatagtaaacttcttatttaccattgttggttctcttccttttttcctgtggatctcggtaaccaattaatatattctccctacttcaatatagctttgctcctaactaccttctttgtgtggcaagtataaatatttacatatgttgttaagtatagatatttacatatgttataggcttaacaatacaaatgcatacacatcatattatgcaattccatttaaaacatgttaagagaaaaaaggaaaatatgcatttatactgtctttaaaaattgcttaattacctttacttgtgcttctcctccctcacaccatgtggaatagaattccatttgggggtcagttggttttagactgaagaaattcttttaatagttattgcaagtgcctttactagcaacaaattctgtcaattttgttcctctgaaaatggctctttttttcttcatttttgaaagatagtttttctgggaatgagaaatttgttagttttattctttcagcactttgaatatgcatgtcatctcactatattctggcctccactgtttctggtgagatgtcagttgttaatctgcctgggattcttttatgtataataagtcatttttcctttgctgttttcctgattttctctttgtattttactttcaacatttttactatgatgtgtctgggtgtatatctgtgtttatcttacttggaatttttttgagcttcttggatgtgtcaattctttctgtgaaatttgcaaagtattaaccattatttattaaaaatatttttgttcctttctgttttttctcttcttctggcaccccaattttgcatatattggtacaattaatggtggtcttcatatctctgaaacttttaaaatttttcttcattgcttttctgttgttcagattgcataatctttattcgtctgtctccaggttagctgattcttctacccactcaaatcagtttttgagaccctctagtacatttttcatttcagttatattagtttcctactgcagaatttccattagattcttgtaaaaataattcttattttttatttgatgagatattgccctcatatcttccttaacctctctaagcatatttttctttagtactttgaacatatttattgtagttgctttagagtctttgtcatgttcatatctagtccttctcatggcacctcttgttgtctgctttttatttttatttttctgtgcatgagttatactttcctgtttatttgcatgtttcccttttttttagaacagtaggcattttagataatataatgtagcagtgtccccttccctaaaactgctttttcttatcttttatttgtttgcatgcttatttgtttagtgacttggctgaataaatttagtgacactggcagtgtaaagcagtgtaaagcctctgatgttgttcctcagaggatgcaggctttggcatgctcacagtcactctgggagacagtagttttctcagaactatccttgactcttcccttctttggtcttgctggtaaactgcctgactctactggtaatacactcaggtattagtgtttgctaattttcagtcagtcactttattgttttggacaatgctgtgggaaataaattaccctacaatctgatccaattaatttcagacctctttgcagaagttttttgaggccaggctttgaagtatgttctaaccacaggaggtctctttattgctgtctctttcccagttcactctgataaactagctgacttgtggtttagtttattgctcttatggaggtatcagccttctcttaattgcttattgttgaaatcttcctggtttttgagaatgccctaaagcttgaacttccccactctcttttctaaataaaatcagtgattttgaggagctctttggcgctctttccccttgtggcatgttgaggcttccttctaagtttggttcgtgtcagtctaatatagactttaccctagggctcagttagttctagaactatttctatagatggtctttctgaggtctctattgaattactcaagtattcaactggactctcagctcttactgatcagaactttaatgtctcccagacttattaagcttccatacgttcttgtcataatgccccattggttattctttgactggcttttctgtgtattattctaaggatgcactgctttgcgttcaaaggtccaagggggctcctatggagatttccaaagtgttctctgtacagtttcctcctgttaggtactctgcccccttaattccagtcaccttggcttcttcaaactctaatcattgtctcctgattgcagcaagagtactgtgccctgtttagagttgcttatcctatgccatttttctagaatatacctgcagacacaaagttgaggcaatcttggggatccctttatttgtatcccttctatgtgtcattatatcctttgctactccttgtttgatgtctgaaaacagttgttttatatattttatacaattatgattgcttatggtagaaggtatagtctcatacaaactaaatcttcatgggaagaagtggaagtcctgtctttgatttttgtggctttgtgtttttcttatttgaccaagctccttaaaaattcaaaattttgatttttgtctgttgtattagctaacaatattttcctttgtgtcattcacttttaaattattttacagttttatgatttccatattttaatttttatataactgaaattatttttttaataatttcttccaactagagaacaaacattttcctagaatttctttcatgggtgtttgaggggcttcactttttataattaatattcagtctactgagattatttttggtataagttataagatggttttgtgtgtcttttattctaaatttctttaaacaacttgtagaaaatgatgtggtataaataaatcaataagtgcatatcacaggaaagtggttgaatgtcatttttcattattttagaattcatgtatatcaattttgttccatggacttaaggtcattcttgggtgatataagattaagacagataatactgtgtgcttccttttaaaaggtaaaatttgcttaaaaccaataaaaatgaaaatgaggacataaggactaggatgtaaagactaaagggcaaagcagcatccaaagtgggtgtttctcatttaagacaatggataccatggccagacttgcagtcagaaagacctagttttgaattctatcatttacttcctttctttctaggttacggttaaggtgaaatcagacaatgtaggtaaaccattcttgccatatcatcactacggccaccatcattgttgtgattatagaaatagaaatagaaagattaaaagatgaagatgcagtttgagtagacaaggatgaagtcatatgatctagcctttgctttctttgtaataaattaaatagcataatgtggattatgtgctttcaaactttcttccatatgtatgtatacacatatgtgtgtatttagtttcatcacatggttcccatcgatacatctctttccatttactgtcaccatgggttgtcgtctatattcagctcctggactttgtaaagagattcactaaagcattgaagcatttggctggggaaagtgatgaggaggaaaaggagacctagtagtgattgtgtcacttttccttgtccagtaagtgactgctgtccctggcttatctattctccatgcacatatgtttaaaccaggtcacacaaaattggctcttttcttgtttgctcaaaggaagtctgtggtagaattttactggaattggagttggtatcactgaattgaaattcctttttctccactgctgagtcgtgagatttggggcaggtcccttcttctttaatgtccatttttgggttggaacacacaattacttaagggccatagaaatttctgcatgtgcattggagttcattcatttattaatttttaaattaaatcattgttgagtgatttctatgtcttaagcactgtgtttggtactgaggacattgatatgtaaaaaccatagaacttattcctaccttcaaggaacgtgtgtagaagaatagacaaacattagagcataaaaagaacataggtataatgaatgctacaaaggagaagtgcagatattatgggtggtaaatattggaggccaggagtctaaaactattttggtaaagagaaagacagtaatattttaggctttttgagccaataggcaaaatggaacaattcttcttaccaaaatgccttgttggtaagttttaaaaatattttatatctaaaaaaaattaagtcacaaagcccttacgaaaacaggccacaggctacagtttgtctgattagacaaacattatattcataatagagtatgctaagataatacccccacctaaagaatttctgtggtcactattctcctaaaggactgtgtaagagacctgtctctgtctctctgttttcccctatttctaagtccctctctctttctttctatttctattatatctttgtagaattcaaaaatatgtatggaatacataccctcacgcctacaattttctggtatcttaatttggctgcctatttgtgtcttctgagaattttaaccattttattagttttcatacaatgttctggcgactgtgtcgttgagtaactgcaattgtgtagatgctttaccaggagctgggttaatccatcaatatattgtatgtcaatatgctgtatctgctgaggcagctggagaaggagattgagagcaggtactgagggagcagaaagaggaagagaaaaaaacagataaaatgcctagctgtcccagagcaggattagcaaacatgttgttttggttatccattgtttcacagtttaaaaaaaatctctttgcgtcaacagaattagaggcatggtgtcctctctgaacacattaagccatttgaagaggctccaaaagtggaatcaaattcaattaaggaaaaaaagaccacttattaccctttaaaactcataatatggaagatatttcaaaacataaaagttgaaatgttttaaaatagcattttaaatgcctgaatcacttaaaagtgttctgaattttattcattctattttaattctatcctgagatatttcctatagatatttctaaatattttttgcagttacatcaagagctagaaaaggacaaatatccttatgcaatcaatttgactttaactatttcctctctctctctctatttttctcactttcctattacttgtgtcagtacctgagttttttcttatcctattttatttagagtgggaaaaagctatgactgaggaaaatgccaaagatctaatcaaggaattgtcaataataatcgtgtggctcaagccataaatcactttggattaagcatcacccttcatctgggtgtgaaatttccaatgccttttatttgttatctgccaatggaaattaaaacattcccttcacaggggatctttcagaagcagatggatccccactgtcagggcatctgggaagttgtctacctgaagacagtcaaataaagcttatgacattattaggtcctttccccaccctctaaaaacgcaaatccatttgtacacaacattcagttagcaagtaaaattttggtcaagccattatgttttgtatatgatgccaagtacatcttaatggatgagagagccaattgactgatggccttaacatgttttataaatcatctctgtttgcatgttcagcccagcccaaaagacagaggcaatagacaccaaagcctgccattcttaagcaaagtttgctttagttctgtataaatattaggccttaacatagtttactacaaatctgttttagtcttaatttcatgcgaaatcaacaatggacatttatatagcattaattaaggtacactattcaatacatataaaatttttcaacattatttatatacaaccttagtttattataaaaactgttattgagatgtcaaagcctcagtgtttttttcgtaaactttctcaggctatgacattaaacctgcccttagacattaaactagaacctttttatgtatatatgagtaataagaacaacatcctgcatctatgtagaacttacagaaacacaaatacttagtgtttactgttagccaggaactgtgctaagcctttttatatacagtatcttattgaagctcacaactctccatacgtttgtacccattgttaacagtgaatcacttgaggtttgtagaaatttgtggcttgcccaagacaaagtcaacaagtgggcaagttaggttttatacccagtactgttctattcagaatctaggttgtttccactttgctttccagtctaacctggttttctcaaaattatctgcccccacaaaaaaaagaaggaccaaacagtggatttgctcaagatcataaagttaattgaacagacaaaggctacactagaattcaggtctttttcttctaacatgttgctcttggcatgacacttactgcttcatatgtgtgtgtatatatatatatatatatatatacacacacacacacacattaaacagaaatcagaatgaaatgctttgtatttgaactcttctttttttagttttactgtctgtttttcactgctgtactcagttggccctttaaaaattctaattactgaagttattatattaaagaagtattggaagaacaacttaaattctagaaatcacaggaaataaaagttattccctttgagaatcttattgagatgctgagagaataatgcttaaataaagagatacctgggttgaatttgagaccaattttgcatgtgaaatctcagcaaatattatgctcagttaaacaatatgtgaccatttgaacagatgatgttgtaagaaagaacttttctgtaaattgttgaaatggaaagaattcttcatgcaagtagaaataggcagctagttaggcttttcttaatgaaatgacagttttcaaggtacttagcttgagagtacagagtgcagtatttcctgaaaatggaaccaaaatggaggggcctggggtgtactagtcagtctatataatttactatcataataaactgggttctttttgttttttcttctatgatgaaaaataatgtaggaacaaaagtccacataattccatccatcacatttgatatgtccttgtattaatcaggatagaaaaactatgttgttctaatggtaaatcacccaatctcagtagcttattctataaaagtgtatttcttgctcacataaaatctgatatgctttggatcttgctcttccattttatagctatgccaaatggaaaatatgtcttccaagatcactgcaacaacagaaaagaaggctagacagcatacaggagctcttacatggcccctgtcacttctgctcatagcccattggctagaattagtcacatggcccaggccagctacaagggaaactgagaaatatgtaaaagaacaagtgattatttagagaatgatgtctctgacccacgaattatttctaccctccttcctgctggcaccctgcttttccctttcccgcttttcattcttttctttctttcctttctttctttctttctttctttctttctttctttctttctttctttctttctttctttccttctttctttcttgctttccttctttctttctttctttcttttctttctttctttctttctttctttctttctttctttctttctttcagtgctggtctttcttcacctttttgtatttcttttgcatttagccactatttaacaaattatacatctatcctatagaatacttgcatgaccctaagggtgaatgcatcctaaactgtgtgccctaggtgcttttcttgccctagtcctgctattctgtgacaggttgtttctaagttgagcaatatgtaagagtcaaacatgattcctaacttcaagttgctttccgtcctgtgagagagatgtgatgtacagatataatgacaatgcaatgtaaaaataaaatgccggtgtcatgcaatttcgacaggtgttgtgctgtgggaattgattgaatattgttctacactcaacagtgcttgctaaatgcaaatcagagcactgtgagcacatgttaaacaggtaaagaaagtgtaatccttctgctttagagaggacaatcacaaatggagaaccttggagaaaatacatatggttgcccatcacacacactttaactgggtatgtgcatcgtgtcagaggttctcagactttgctggatggacatgggattctctgtatagcctaaaatgtgtgagattttctattctagagaaggcccagatctataaatgttcctgaaaaggttattgaccccagagtttccagggtttccagggtgggtacagatggcgactactcttttgtttcatgaggatttaccccagacttataggaacagagacactctgaatcctcataaaatagccaacatcattcatcccttgaaactactggcatgaattgtcttgcacggaggaaacaaacatttcctttttttttgttcaatgtctgaagggagctatccctgcagcaggacttggaaaggctcataaaacttgagcaaaatgtttataaagcatggaagtaaatgacaagactgtaactttgcaaagtttcaagaggagcagagattggtctcagtgatccagggatgggctttaggaagcctgtgaatccccagaaacatttgtgtgtatttggttctatgcatttttatggagaagggtccacctataaacattaagagccactaatctcattttaaaaagatggaatctccagtctaaatagatttaaatacatacctaagatcaaataattaatcagcgctgaatccagttctgaagccctattctaatccccactgttctgggctaaattgtgtcccctcaaaaatattgtcaaagttctaacatttggtacctaagaatgtgactgtatgtggaatagggatgtaactgcagatgtaattaagttcatataaaatcatgaagatgtccctaatccattataagaagaggaattctccctgtgaaggcaggtacacatagcaagacaaccgtataaaggtaaaggcagagattggagttacacaactgaaagccaaaggatactgatggcttaccaccactagaagctaagaagagtcaaggaaagtttctcccttagagccttcaaagggaacagagcactgacaacagcttgatttcagacttcagcctatagaactgtgagacaatgaatttctgttgtttaagacattaagtttcttatggtagcccaaggaaacaaatacactcactatagctaactctccaaactggtacatttcttttcatcgtgtcagtgccaatactgataattatgtttcctggtttttaaaattcatgtttaccagacctagtttaggcacctctccaggcaatcagggtccgctggtccttggtgacttgctctgtttcctggctggaactgctgaacaatggcttctgccattcccacaatcaaaattgtagctaccaataagaatgtactaattctaccacctttctgggctcaagtgccaggctttagggccaccttcatcatgctagctctggcagaagctgcagcagtttccatgtccaagtccaacctgactagacctatagaggccccagcttccccaaaagctccacaggggctggctaacatcaactggagttgcagggcagtaaatgctccgtgaggcaaactttaagggaatacaggagtcataaggagacagaccatgaattgttctgtcttcctcccatcttagaaactgttcagagatgcagaggctctacagtggctttcctgagttatcctatttaaccaagaaaccattgctactttcttggaaagctttagccagctcatcatacacaaggttattatttttgctttacctactttttgtttttgcttttgtttttgtttttgagacggagtctcactctgtcgcccaggctggagtgcaatggcgcgatcttggctcactgcaagctctgccccccaggttcatgccattctcccacctcagcctcccgagtagctgggactacaggcgcccaccgccatacctggctaattttttgtatttttagtagagatggtgtttcacagtgttagccaagatggtctcgatctcctgaccttgtgattcgcctgccttggcctcccaaagtgctgggattacaggcgtgagccaccgcgcccagccagctttacctacttttatgagttgaattaaatttatgtgttgaactcgtaacccaatgtgtatcagaatgggactttacttggaaataaggtcattgcagatataattagttaagatgagggcatagtggagtagggtagggtgggcacctaaccctttatgacgggttacacacacacacacacacacacacacacacacacacacacagaatgagagagaatgagagagagagagaacactccatttgaagatgaaggcaaatattggggtgatatttctacaagctaaggaatgccaaagattgtgaagatgggagagatgcatgaaaatggccctcctttgtagccttcagaaggaaccaaccctgttgacaccttgatcttagacttctagcctctagaactgtgagacagtaaatttatgctgtttagcaccaaatttgtggtactttgttatggcaacactagtaaatcaacgtacctatttctctaccatacttctcacattctcttattcttgctgtcattggattgtgacaactccatctctgcccccctataatgagtaagcattcaaaattgtcctcagctctgtttccctggaaatataagctaatatagcctttattcctatttaaaaataagtgtgtagttagacctgggttgagcactgactgataaaaagaaatatgatatgtcctcttcttgaaaacgcctacagtgttcagcaagactaatctaattcgtaagaccactagaaatcagcaaaggcagaatgttgcaggtttgacatctacattgtgatagagttcaggaaagggagagttacaccataagcctccagaactacaaaacaaactattgactatgagaaattctattctatctctgtgttttcctcatatcaccaaaaagcaagagttcatatttggcgtattctgtacatattttttaattcttacacatgagtgtgtggcaggcaaaggggaatcattccaaataggaaactcaggcatttgtaaacaaagcctcatgttggtaattcaaagtaattagtgtttatgactgtaggagtctggagtatatgtgatgaattatattaatcgggagtgaattgatactggagggtaaagaaggataatttctccagctaagagcgcatggccagtagctgaaactgttccccagaccaagccattacatctatcaaaaggcgtttattaactgcttattcacacatcacactatgctaaatgaggaaccaagtcttaaaactcactttcttaacttgtgtataatctatactggtttcaaagaaagagcaagaaaacttcacttgaaatttagagccttagagcttttagagttcctttaaagaaatctttatatgtaataatacattttttttggagaagaaatcaattgagatctcatttttcttgttcacgttttctaaacatttccactgttagtggttcacataaacttgtttatgtgtatgagttattaatatatggattgactcaaactctctaaatgatttttgcttccataatatagcttcactaacctaaatgagttgtcgatagcaataccatggactgtaacttctgtaataccattgtcttcactgtatgtggagtgcctacagaaagcctgggtgagagaaggtatataaaaaacatctgttgaatgataaaaccctcattcctggttggatccaggaaggataattttttcaaacattcctgtaaggaaagatgccaaaactttttgagcacctgtcatgtcccaggctccctactaagcactttacataatctcaagggatatcccttctttcactttaacatgggtgcaatagcatttacttatctgtttatagcaatagaaagacttaaatactgctgggcatggtggcttgtgcctgtaatcccagtgctttgagaggcttaagtgggggggggggtcacttgaggccaggagttcgagaccagcctgggcaacatagcaagaccacatttctacacattataaacaaattagcaggcatggtggcatgtgcctgtagttacagctacctgggagactaaggagggagaatcacttgagcccaggtagtcgaggctggagtgagccatgatcatgccactgcactccagcctggatgacagagagagactgtctttaaaaaaaaaaaaaaaagaaaaagaaaaagaaaagaaagagataggaaaggaaggaagagggagagagagagagagagagagagaaagagaaagaaagagaatagtatgcatgtgaggaacttagcattgtgtctggtgccaaacaaatgctgagctactggttacctttctcttctttttcttattacattcagtatccactgaacattccttacagtgattttccattactctttatatcagatgcagaaatgttgactgtgtttttggttagcatcatttataaggaaattcctccaggaagcacatcttcctctttgttgttcttcttttaatactgttgaatggaaagctcaccacaaccacagcctaggccccagagacctgtcgcttggactattcaactgcctcctaagtctaacagcttttggttttgtctcttgcaatagatactgctctttgcaccaagaaagctctattcaaaatataaatttgactatattattcctttgtttactctaattgccattccatacaaataaagtccagactccccagcatggcatacaagattcttcatgtccaaagccctgtcttcctcttaagacttatataattcagctgcttctatgcaggatgcattttcacaaatgtatatgattcatgatctcgttgctcaacgagtctgcactttggcttgtgcaggatcatctgctttgcagcctccctctctttccttatctttcttcacctagcctactctgctcaatctcttagacacagctcatgcatcacttcctcttggcagcctttggaaagcttaggtacccttccttaatgtttttttaattactctgtgatctgattatcaggaatttaggacattgccttcaaatcatccattagtgtctgttgctgccacaacagtctaggccatgggtgggcaaacttcttctgtaaagaaccaggtattagatattttagctttgtgtagcatatggtcttcatcaaaattacccagttttgcctttgtaacacaaaaacagccaaagacaatatgtaaattaatgagcttcactgtggttccaatagtttacttacaaaaaaatagatggcagggtggatttctccagtgggttgtaggttgccaacccctaatctaagcctcttgaggatggggatcctcttatctttcttagattctgtagcacctagctcagtgtctgtgttaaaggaggggctcaatcaatgttaattgaactgggagtgtactatgccctccaaatcatcatgtgccaggtgctgattcttgtttttattcttgcttttatttgaagtataatcaggttgctgttgaacatttttaattttgtaccaagcagatgtgccccatttgaagaacagaagcaaatcagtacatactaaattaccaggtcacattctaacacagagatctgcgcattctgtctgagcatctaaggcttctaattttctcgggtatcctattgccctcaaatgttgtggctttccttgaaaccagccagtgttgtctgtgaactgtttattgaaagctgtgtaactaagtacagtaatagaatttttcaatcaatactcaattgcagcaggagctggtagagagatttcagcagccataacatgctgagataacttggtgtcactaagaaatcaggcagcagagagcagtactaattgagttctgtcagtcatacatgtgggcactgggcttgaaatctggtgtagaagctatagtattatttaatgtgtatttggttgtgtaaacccagacagcaaactcatgtgaactcagctgaataacattcagctgttctaggcctctcataacaattttcttttttttttctctgtttaaaaactcagcagtatcctgtatgtgcataacataaaaggaatagcagtggtatttaattgtaagtctgggatagatggtataaagaggaaatataacctaatagaaagagaattggaagtcaaaagactcaaccttcaaattccagctgttctacctgttaactctgtgttttggctgtgaatcaagtgatagccaacgcatcggtttttctatctttacaatggggattatacctgcctgccttattagtgtttcagtgaacttcaaagcaatttttggctgtgaaaatgctctgcaatgatagttgttgttttatgagcaccttaattattctgcttctccaggaaaaaaaaaaatgtgtcaacactaagtgaattttccttgtaatttaatcctttaattttaataatttttattgaagtctttcccaaagaatgcacaataaactaactgctttattaaactgaatagtttatgcaaattgaacccatttatggctcagagttaacactgggatttctgcttctgtgattcatgttgtagctgtaggtgctgctgactgtgggatttacctgtgattgagcccagaagtagcttggtttagccttctggaaaaattccaattagtcactttgttaatttgggctatttgcctcttctgcaaaggaagatttagggaatgactgaaataatgttatagtttgaaggaacactgaacaccattaagtccaatcccttcttagaaggaaataaactgaaatcccaagggtttaatgagttgctcaatgtcacacacaaaatgagtgtttaagtgtaccctatccccaccttctgacaacattaacattaatgaacattttctcaaagctttactattttcaaagcatttgcatatccatatcttatttagacatctccaaagctgtgaagttgacagagcaggggccattctctccatttcatgagtgtcaagtgacttttcctcagtcacttagtgggtgtatgctcagggaaagatgctgggacatgaaaacagatcttctgaccacaggtcctagtatcatcccaagacattatgtttcatgctattggactatgccttgtctactataacatgcaatattaatgctgcataacctctgcagtagcacgacttcgctgactgctgtaaaataaatcatcttcctaaagatagaagatgtcttttcccaaatgagtttttcatgttccagagcagtttcttcaatatcactgtttgtgtgctttgaatttttcacagaacttacagccttatgtatgagatctgcacgaccagcaataggaataactggcaccttcatatcagcttttacctacttgcaatcacagtgtgcttctgcctcaaacctcatgtcctataactttttcttagcactttagattccaccaatactattagttgaagttcccaaatacatgatagcctgcttttgtgccatattagtaaaatgtgtttctctgagaactgttgcaaacctaagtcaaactggcttaagatcaccttggattttttggttcctgaaactaaaaatccagggatagagcaagcatggctggactcaagacttccaaattagtgtgaggaaacatctctctcttcctctgtctctctcctctttccttctatctgaatttttctgcattagactttgttctcaggcaggttctaacaagaagaagaaaagatggccactgctgggtccagaattatattagctagtgaattccattgaatcaagagtacttcccaccagccccaaccccacaatagcatcaagaaaaaattctctttgaattgattgagttatatacttccattcttggaactgggacatgcagccaactgtacccaagccatataaatggagagaaagggtaagagggattcctgaaataaattatatcaatataattcaattattaaatttaaaatattaaataaattatatataatttattatatatgatatataataatatgtggtatttgatataataatatatatgataaatataatatataatgtatgatatttgatatatatgctgtatcaaatatatattaattatatgatataatatcaatttataatatcaaattaaatatataatatatatgatatataatgtgtgactattaatgaagcatagatgcttaacaggaaaaaatcacaaaatattcactacacacactaaaatgcctatgccatgttcactgctaaaatgccttgctctctcacttacttgaaaaactcctacttcaccttctaactctactcaaaagccatttactatgtagatgatcttggggtaacttacagaacctctatagcctcttattataacgtggcatacaataataataaccaaatgttaagctagtttaggagattatatgcctgatccatataaagtgcttaagacaatctttggcaaaagttatgtgctctataaacttaacaatgctgctgctgctgttgctgacacttgaacatcatggagagacaagtgctgtgagggaagacaaagcagggtaaaggcacagagtggcagtggtgttgtttaagaaatcctaggtcatgcaaggcatttccgaggagttgacatttgagtggagaagagaatgaagtgatgctatgagctatgtgaacaacttggaggtgagtgttctagtcaaagggaacaacaagtgtaaaggccctaaagtggaaaagagtttggcttgtttgaagaataaaatcataacggggctggtcttggtggctcatgcctgtcatcccagcacttcgggaggctgaggtaggtggatcacctgaggtcgggagtttgagaccagcctgaccaacatggtgaaaccccatctctactaaatacaaaaaattagccgagtgtggtggtgcatgcctgtaatcccagctacctgggaggctgaggcaggagaatcgcttgaacctgggaggcagaggttgcagtgagccaagactgcgccattgtactccaggctgggcaacaagagcaaaactctgcctaaaacaaacaaacaacaacaacaaaagaaaccataacaggacatttactagaggtgtcatttttcttaagatcttcaattttatcttttaacaaattatggacatatataaaattaaacactgagtcattattattagtaagaatttctatccatttagtcacccttcttgaaagtttggagctgagtcaagtgcagatttttccaggcagagtcctgggagccagtggaaggtaaccaccggtgccttatattggcattggtagtatgtggagccaagggaccaaattgtgtccagaaaaggggcgcatgtctgatttgaagtaagtagttcaaaagaaggttgccaatcttaggagctggaaagagaatggaggataaagctttggaactgaaaaggctgagctaacaaggatatgacaggacaaggagtgttgtgacctgatgtggctagaagctccaagacagggtgaattattgttgtgcaacttgggttgcaatgtcttccagaataattttttctatttaatataagatatggctttctagatagaatcattaagataacattaggaggtagaggcatgctcaggctatttcccaaaccttacttctatttcctcagtagagtgaagactttggatataagatgaaatgtaaaaatatggtagaatatattagaacaaagaatgttctttgaatttgacatccttttagttagtcactgaacatgtggtattcacttacttatgtgtaccggaccctgtgctgagctctaggggagatacagaaatgaggattttagggctctttctcttttgtaagctggaataaaagtaaagtacatgtaaaccaataattttaataaaatgtgtctggtgctttaccattcatgagctatataaatttgataagatatttaagcatttatttcttgatttataatgtttggataaaaatagcacctaccttatggcattttggggtggggttaaaagaaaagaaaaaaaacagtgttaaaatgtttagtacattacctggcacatgctacatgctaaatgcatttttaaagggctttgataccagcaaggggttgtggtagcatggagcaaaaaatgacttattttatctgggcctggaaaaatccccataggactactaagtcttgaaggctgaattgataaatggggaaggaattacagagtgaacagtcatgtgaaatactaggaaactttctggaggagaattttgtttatcaaacaattaggtaacatatatggaaaacattaagagaaactttaggaaagttgggctggggtcagattatgaatggcttcatatatcatgtcaagaaacacttctttaagtaattacgaagagccttcacaggtctttatgcagaggagtgaaataacaggaaatcaggtgtgtctgaaccaacactaatgagatgtagaggaaagcacaaaaggtcatttggcaaccatgtgcctgggtagaatcacagaggatgattctgtattagagctacaactcttgggtgaatggaaagagaaaataacaagaggaaaaaaaaattcttgcttttaaggcaactggtatatgtgtgatgccttagacagctgtaggagttgaaatgtgccactcatcagtgatattattttatggaagctggaaaagcattaacatgtatgacaatagttagcctatccatggtctatatagttgcagggaaatgtaattcacaaacacctgcctgagtctatttggcaagtattgggagcatcaaccttagttttatcagcatgaaaaactgctcagggaatgtactgcattcaaaaaagactttgctgaaaaccccagaaaatggttttgaaaattcatggtgttatggttattggttttaattttaaatctacaatgctttctgtcactctgaaatgcctttattttgaaaaaataatacagaactcagtctattgtgttttcctagtaaaatagtgtccttttttttttaaagcagtgaatcagaggaagagactgattttgatcacttgagtttgggaatgtatatgttatattgtctgtggatagagagacctttatatctttgctgcttgtgcaaatgctacagtgtaggttgcagtacattgctgcattatagtttagcttggtgacctactgtagtgaacataagtctgagatcctagataggtccatgtgtcctcaatatggctgtatcttattacaataatgccctatgaagccaatattatgaatataatttgatatggccttttattaaatgtttcacaatctactatattgtaatcatttcaattaactgtgcacctcttaaaataattaagacttagaccttttacttgctgtccaacatagccaataatttttaaaaatctgatagatgataggacacctcagcagtcatgcttgggaggcttcaaacttttatatccagtgatcatcacatccatttttttctgatttgagacagaattaaaacatttttggatgatattttgattcactttatttaattatttagacattttctctcatgctcactgctttgatagtctttcttaatgccagtaattcttgggtataactattggatatggtattattctggatgttggaagttcctgatcccaattttgagaatcatcaaatggaaactaacagcactagtaatggctaataaaagaagagaaaaatgatttaactactgagcaagatctttttaaaaaaaaaaaactttaataaccactaatatttaacaaataccattgtccatatagttaagaatccaaaaggaaaaaaacttcattgcccaatgcatatgtttataatttcatcctgtgcattccattctgttgaagaacaaaatagaagccaaagcatttataaaaggccaacattaggtgaaaacacctgagtgactcttctggcaggtttaaatggcctggtgagactcgctaactctgctggttttttaagtttactctgggatttgtaattaatttattcaataaggagtgattgattatgtattatgtgcaggaattttgcttggaactggagacagagagttgaaagacaccatctgtatgtttcagaagctcaagaatctattaggctaaacagatcagtgggaagacaattataggacagtttgataaatgttatatgagtacaacaaagattccctggaggaatacaggagggactctgtactgggttgaatagtggacctaaaaaaatatgtccaagtcctaaccctcattacttattaacgtgaccttatttgggaataggacctttaccggtgtagttaagttaaagatcttaagatggtatcatcttggatttagcatgggtcctaaatccaattactggtataattggattggtataaatgatatcagtaataaggaaaatgagagggcaattcgacacagagcacctagaggaaagtcacataaagatgaaggcagagattggagttataatgctacaagccaaggaatatcaagaactgctagcagccaccagaagctaggacagagcacatggaacagattttccttcagatcctccaatgtgaacctatccagccgacaccttgatttcaaactgagtgaatattttttttgttggtttaagtcaccaagtctgtggtaatttggatatggcgactctgggaagctaatacaggtctttaagctagactggaggtctgggactggagatggtcatcaggtaattacaaggcctcccagttcagggaacatttcagctgagatttgcaggtcaagtgagagttacctgatttactaatgggaaaaataattgcaggcagaaaaaagtaagtgtaaatgcagtccatattatttccagtaaaaaaaaaaaaaagaaactttttaaatttctaattctataggtggaaggaaagagatatgctgctcacccagttttgtctactccggacaaagatctgatctctactatgtggtctaccttctgtggatctctgtagtacatagattattgtcttctctcacatctccacttccatcacactgattgaggggaccataaatttctctcctgaattattgtaatagcttttaactagtttatttgcattcaccattgcttatgccagcccaagttctatttttcttaacacgttagtcagagagagcgtctattgaaacctaagtaacataatgtcattctgtagcacaaaatcttccaatgcttcttaattgcgttcagaacaataaaataaagtctttaaacatcctaatgaccgtaggagaactgatgctttatgaattttctgttaccgtctcctacaactcagcctctgactcacttggcctttttgcaattcctggacatactaagtatggtcctccatgaagcctttatgctaagctattctctttgtctagagtactcatcaccacaccatctgcctggcctgttctcggtcttcctttatgtttgtgccaaaatgtcagtttattaggccttttgtgatcatcctaaataaatagtaacccctctaccaatatttcttatctcctttaccctgctttagtttttcccgtatcgcttactataatttggattattgtgtatttatttgtttagtttatatttttctccactagaggataagttgcatatgaccaggaacattatctgttttgatcattgttattgttaagtgcttaggagagtacttggcacatagtagtattttgattgatagtttttgaatggatggatgaacaatacatagaagattttttttaactgggaaattcatagaagcattcaaaatgtttgatgagaatttctgggtccatgctttattaggaaaaactcaataaattttaagtgcaatattacttaaaacagattacaaaggctgcagtggggtctgatattaattcctcatttcttctcacgaaaaatacacacaaataaattggggatggcccttaattggtgtggctttaataacaggtttgatcaattttggatcctgttcagtgatgttcttatcccccataggctagtttctattgcaaactgcttttcttacgtgagctctcttgtccttaattcttattactcttacagaaagaaagaatatagtccttgaggcccaaatgttattaaatgatttctctgggaaactttgcttctctcctgtgtactctgcaaatgttggatgaagccgtgagatgccacttctttttgtccctcttacctgggtactctgtgcctgtcctttctttgttttgatcataatacactaatgagattccatgttttctgcatactgtggatatgggagaagcactttaaagatctcaacatgaggacatgagtagattcctttccagctgagagtctgagttgagaatagctctccagttgggcagaaagatgaacattatggaaacttcattatagcaccctcaggaaatagtcagacaaggcatcttgcttgatcccttcatggccagtatcatgtggactaaacagatgggtaaaaaaagcaaattcagcatgattgaggaactatacctagttggataaggctatagaacttgctactggtgaacagtggaaagtaaaaatctttgaggtatgaggcacttactttcatatttcccttgtcatttaaacttcatcccaacttgaagaagaggtattcatttcacaagtgaggaaactgaggcacagaggaggtaacttgctgaaggtcacacaggtggtgattaaatccagatttgtctgtttttccacagactatgcttttacctccaccatgctgcctataaattagaaatacattttgagggatttgagcttaaacctttcaaaaataacattagcacaagaacaagggcagcccatgttgtagatgagatatagctaaacatctagaaaggcagatcgctgggctccagtgccagcggctgtgtgcagcatgaaagcagctattaatcagacacgctcgcttaagaggaccctgggttttgactttgaaggcagccaaagaaaggtcgaatatatgcttttgaattctacagcaagcagagctcttttgaattctttattttctaaaaatgataattaataattctaatgcttacttccttggttgagctcttcaaacatggaattaaaagtagtaaattttcaacaaaatacatatgacagactgttaaccccataaattagggtttcatttgccttaatttctcacatcagtgtatttttcccaagatggctttccccacatgtatgtgtctaataaaccaatgatgtcaacaataattagtacctttgaagcagctgaaacttaacgctggacctgtggttacattattcctcacaacaactatataaagaaggtgctgttttaacattttattttgtcaaaaagaagataagtcttaccgcagtttctagatgagcccaatgtcacatagctagaaaatggcatatgtgagatttgtgcgaggctccccacatccaggagcccattgtctgaaagaccaagtctctgcatgtgttaagtatttgaaggggtggggttaggggcagggacagtattgtctgcaggatatgatggctaagttgcgagatatgatggttttttcttttctttatttattgtttgtattattcctcttttcctccctccttctttctactctcctctccttcccgcttcacttagttaaaacttcaaaccaggtttctctcattgggtgaaactggcattgcttctcaggcacctgatgttctgctgaatcctgggtgtgactagaatcccagcacctggaatttagtctcagcctcataattaactttctccgggctagctatctaacttttctcctttcagcttccccaactccagaatgcagatataattacaaattaccttttaagattattgtgaagtgctttttaaacaaaagcagaaaatgctttacaaatctgagaagttgttcaggtttcaggttggagatgggaaacaaagaagctctcttgagaactctggtccacccgaattacccagctactatcactgcaggttggattcgtatttctttcaagatttaacatgtaattccatgcagttatataaagttgcagaatgcttttacctgggagagtttgctggaatttatctctttaaaagtctctagactgtgacctccagggctaatataagcgttggctctgatatagcagtgtaataggaaaccttctgaccttcttacctggggctttctcttcaactgcttttcacagatagccctttcaggctcccatttcctagtgctcctgtaaatgttgaatgccaaattttgaactgctttcagaggttttactgcaaagatataatttgatgttgctttagtgtcctagggagtcctgaattaatttcttgaattttgcatgttaaaatgtgaacatcatcttttattctattcctcttcatacctttttgtcttaatgtcccatcattttccttgctgttgattccagtgcccaacaagctctcaaagtctgacactgatgtgtgcaccagttagtgagaggcagactgcaaagagtttttgatatttgagaagaaaattctctgctatatgaattaacctagagaaaacggggctgatatatttaaaaagtgctcaccattttgagcactcactatgggtgggcactatgccaagtgctttacatgcactacctcatttaattccagttttaccagtatgatacaggttcccttattgacctgattatacagataaggaaggtgatacttcatagagattaagcaatttggcaaaatcagtcagcaaataagaagtgaaaccaggactagaagatagatctgtttctagaatcatgcttttactaagccaaaggctgtatggaagaagtactcaggtacttgagttgttttggaaaatgtgtccatgattgaccacaaggttaggattaaatactcctcactcctaagttcttggtgattatctgttgaattgcccttccttttaataaatctttcatttctacattctggagagtttaaattcataaaaactttttcaaattcagcatcagttctatggagccattcttgaccttctggtcagaagagttttccttcttggcacctcctcttgacttgtacaggcagtattgcttggatctctaagtcactacgtgatctgcacacttcattccttggggcctttgcacttgctgtaacctttgcctggaacattctttgcttgataatttcatggctcactcttttcccctttaggtctctactcaaatgatctcttttcagtgatcacccgttatatgtcaccctatttaattgcaaccttccccactgacacacttcccacactgtgtctgctttttctcctatcacttgctatcatctaatatcctatgtctcacatttattttacctgtctcttctccataagaatataaacatttatttattctgtctcttctctatgagaatgtaaacccatcagaaatatttttatctgttctgttaactacttgagccctggttctgagtaatctctggtacagagagggtgcacaatatatatttattgaatgactgaatgaaggactgtctgccttttttcacctttgacactgttgagatagggagctagataattctttgttgcaggactgtcctgtactgctaacctgtaagatatttagcaacatctctggtttctgctcaccagtagacccactagtagcagttgtgacatccaactgggataactgagagtgtcaccagacattactaaatatctcctgcaaatggggggcattgtcctccgcgcaaacactgttttagactcaaagatcctggagaacaggatctatattactagagcatataataatactgtagcgcatagtagatgcttgataatattttacaattaatttgtttattaaaatagtttttggggaacagggtttttggttacatggatacgatctttagtggtaattactgaggttctggttcacccatcacccaagcagtgtacactttacccaatgtgtagtcttttatcccttgaaccgctccctccttcatcctgcatccccaaagtccattgtattattcttaggcctttctgtcctcacagcttagctcccacttatcagtgagaacatacgatatttggttttccattcctgagttacttcacttagaataatggtctccaactccatgtaggttgctgcaaatgccatttcttcattcctttttatggctgagtattattccatgctgtatatataccacattttctttattcacacattggttgatgggcatttaggctggttccatatttttgcaattgtgaattgtgctgctctaaacatgtgtgcgcaggtgtctttttcataaagtgacttcttttcctccgggtagataccctgtagtgggattgctgggtcaaatggtagttctctacttttagttctttaaggaatctccatactgttttctatagtggttgtaatagtttgtattctcaccagcagtgtaaaagtgttccttctcaccacatccatgccaacatctttattgtttttttactttttatttatggccattcttgcaggagtgaggtagctcattgtggttttaatttgcatttccctgataattagtgatgttgagaatttttttgtatattcgttggccatttgtatatcttattttgagaattgtccattcatgtccttagcccactttttaaaggattatttgttttttcttgctgacttatttgagttccttgaagagtctggatagtagtcctttgttgtccatagttagtgaatattttctcctgttctgtgggttgtctgtttgctgattatttcttttgctgtgcagaagctttttagtttaattaagtcctatctatttatgtttgttattgttgcatttgcttttgcgctcttggtaattaactctttgcctaagccaacaactagaagagttttactgatgttatcttctagaatttttaggtttcaagtcttagctttaagtctttgatccatcttgagttgatttttgtataaggtgagagataaggatccagttttattcttctccacatggcctgccagttatcccagcaccattcgttgaatagggtgtcgtttccccagtttatgtttttgtttgctttgtagaagatcacttgactataagtatttggtgttatttctgctttctctattctgttccattggtctacatgcctatttttatactagtatcacgctgttttgataactatagccttgtagcatagtttgaagttgggtagtgtgatgcctccagatttgttctttttgcttagtattgctttgactatgtggggtctttttcggttctatatgaattttaggattgctttttctagctctgtgaagaatgatgatggtccttcgatgggaatcacattgaatctgtagattacttttggcagtatgtgattttcacaatattgattctactcatccatgagcataggatgtgtctccatttgtttgtgtcatctataatttctttcagcaatgttttgtagtttttcttgtagaggtctttcacctccttggggctaggtggtatatttgtaaggttttttttgttttgttttgttttttttgaggcagagtcttgcactgtctcccaggctggagtgcagtggcatgatctccgctcactgcaacctctgctcccaggttcaagcgattctcctgcctcagcctcctgagtagctgggattacagacacatgccaccatgccctgataatttttttttttttttttttttttggatttttagtagagatggggttttgccatattggtcaggctggtcttgaactcctgacctcgggtgatccgcctgcctcagcctcccaaagtggtgggattacaggcgtgacccaccgtgcccggcctttttgttgttgttgttgttgttgttgttgcagctgttgtaaaggggattgagttcttgatttgtttctcagcttgggcattgttgatatgtaccagtgctactgatttgtgtacattgtatctttaaacttgactgaactcatttatcagatctaggagctttttggatgagtttttaaggttttctaggtatacaattggcaaacagcaacaatttgacttcctctttactgatttggatgccctttatttctttctcttgtttgattggtctagctaggacttccggcactatgttgaatagaagtggtaaaactgggcattcttgtcgtgttccagttctcaaggggaatgctttcaacatttcccttttgagtgtaatgttgggtatgggtttgtcatagattgattttttattaccttgaggtatgttccttctatgtaaattttgctgaaggttttaatcataaagtcacactgaattttgtcagataatttttctgcatctattgagatgatcctatgatttttgcttttaattctgtttatgtgatatatcacatttattgacttgtgtatgttaaaccatccctacatccttggtatgaaacccacttgataatggtgtattatctttttgatatgctgttggattctgttagctagtattttgttgaagatgtatgctagtattttattgaagatgtatgcatctatgttcaccagggatattgttctgcagttttgtttttttgttatgtcctttactggttttggaattagggtaatactggcttcataaaataatttagggaggattccctctttgtcttttggaatagtttcagtgagattggtaccaattcttctttcaatgtctaatagaagtcagctgtgaatccatctggtcctggactttttttgttggcaattttaaaattactgtttcaatctcactaattgttattggtttgttctatttcatcctgatttaatctgagaggggtgtatatttccaggaacttatccatctcctctagattttttagtttgtgtgcattaggtgttcacagtaaccttgaatgatcttttgtatttctgtggtatcgtcgtaatatttcttgtttcatttctaattgagcttatttggacctcctctcttctttcttggttaatatcactaatgttctatcaattttgtttatcttttcaagaaccagcattttattttatttatcttttgtattgatttctttgtttcaatttcatttagttctgctctgatctttgttatttcttttctgctgctgcattttggcttggttttctccttgtttctctagttccttgaagtgtgatcttagatcatctatttgtgctctttcagactttttgatgtaggcatttaatgctgtgaacgttactcttagcattgcttttgctgtatcctagagattctgttacgttgtgtcaccattatcattcaactcaaaaaaaatttaaatttccatcttgatttctttgttgacccaaagataattcaagagcagattatttaatttctatgtatttgtatagttttgggggttcctttggagttgacttccagttttattccactggggtctgagaggatacttgatataatttcaatttttaaaaatgtattgaaacttgttttgtggcctatcatatggtctattttagacaatgtttcatgtattgaagaaaagaatgtatattatacagttgttgggtagaatgctctgtaaatatctgttaagtccatttgttctagggtatagtttaagtctattttttctttgttgactttccatcttgataatctgtctagtgctgttagtggggtattgaagtttcccactattattaagttgccatctaccttatttcttaggtctagtagtaattgttttgtaaatttgggagctccagtattaggtgcatatgtattttcctgtttgatccttcatctttatataatgttcctctttgttttaattgttattgctttaaagtctgttttgtctgacataataatagctactcctgctcacttttggtgtccatttgcacagaatatctttatctgctccattcccttaagtctttatgtgttaggtgagtctcttgaagacagcagatacttgtttggtggacttctatccattctgccattctgcatctttttaagtggggcatttacgccatttacattcaacgctaatattgagatgtgaggtactgttctattcatcatgctagttggtgcctttataccttgttctttttcccccactgtgttattcttttacaagtcctgtgaaatgtatgctttaaggagtttctttttttgtatattttgaagttttgtttcaagatttagaactccttttaccatttcttgtaatgctggcttggtagtggtgaattctctcagcgtttgtttgtgttaaaaatgttttatttctccttcatttatgaaactagctttgctagatacaaattccttgtgtgacaatttttttttttttttttttttttttttagtttcaggaaactgaagatgagaccccaatcccttcttgcttgtaaggtttctgctgagacgtctgctattaatctgatagattttcctttataggttaactgatacttttgtctcacacctcttaagattctttcctttgtcctgacattagataaactaatgactgcatgcctatgtgatggtctttttgtgatgaattttccaggtgttctttgagcttatcacatttggatgtctagatctctagtaagaccagggaagttttcctctattattctctcaaataagttttccaaactttcagatttttcttcttcttcaggaacaccaattatccttatgtttgcccatttaacagaatcccacatttcttggaggctttgttcatgtttttattcttttttctttgtctttgtcttagtgggttaatttgaaagccttgccttttagctctgaagctccttcttctacttgttctagtctattgttgaatgtttccactgaattttgtatttctctaagtattcctttcatttctagaagttgtgattgtttttcctttatgatatctatttatctgaggaatttttcacccatatcctatactgttttttaatttctttaagttggttttcacctttctctggtatttctttgagtagcttaataatcaacctttcaaattctttatctagcaattcagagacttcttctgggtttggctccattgctagggaactggtgtgattttgaggagtgttgtagagccctgttttgtcatattaccagaattattttacttttctttttttgttttttcatttgagtggacgaattcagtggagaggtctgaaactcaaggcctgctgttcagattctcttgtgccagaggatgatcccctgatataatgctctcccactttccccagagatgggacttcctgagagctggactgcagtaattgttatggctcttttggttctagccacccagcagagctaccatgctccaggctggtggtagagggggtctgcaaaagtcctgtgatgtaatcggtcttcaaatcttccagccatggataccagcacctactctgttagatgtgacagggaagtgaagtagactctatgagggtccttggttgtggatatgtttagtgtgctagctttcttgaatgctggttatactagcagtgaagttgtcacatagacacccttacgacttctggttagccaagatgttgtgggcattggaattaggtgtcgtcttcttctttctgagatcagagttattctgtcctgaattgctataatggagttggttggcctccagccaagaggtggtactttcaagagagaattagctgcggtagtagtagggggctctaagcttgccctaagatggccagggtaagtattttggtttctcaggcaaagggatgggccataaaactcccaagagattgtcttttgtgttaggctaccagggtgggtagataaatattatcaggtgggggaggcttacgcaagtcttggctcagactctccttgggtggggcttgctgcagccacagtggagaatgggggaatggtcctcaggtcaatggggttatgttccagaggggatcttggccacctctgctgtgttatatggttcatcagggaagtgggggatagcgagaggtctcacccagctcccatacagttggcgagaccagtctcactcccgcagtgctctgctcaggccttgccccaggccatgagctactcttctgagaaagctcctatctacagatgctcccacatcccccagacttcactcaagaaaatttgtacccagtcaaaaccactgccaatttcaggtgagagcttcctttgccccaagaccctttcccaattccactggttgcctgccccgaggtcccctgtgagatatagtgaagggatggcttcctggggctcaagttggaggctgggagtatgttcaaggtacttcctgtgctacttgtactttcaaatttcttgcgactccctaaacccatttcatctctaggtaaggtaaaatccttctttggtgatctggattttcagattgccaagtggagatgtgtgttcagaggtaggtttttccccctttcacattttgggcactcacagtttttcacctgtttcacagaatttgcttctttcaaaggattggtgaattccttcagttttcctggtatgtttctgcagtggttcttggaacaaaagatcatggtgtgagtctccaaatgctgttctgtccatacatgtgggagctacatgttagctttgtctcctatccgccatcttccccagaatctcttgatattttaagctggattgatctgactttaaatgtttatctcaaatattatgatatagttactataagactatcctctcaaaatttttattttctcatataataaatttacttcaataacaaatacatgtttattatcacacaggttcaagatgatatacaggaattcagaattgcaaaaaatgtgatcttagtccctaagaatctcacagtctggttagagaagcatatacactggccaaaaatgaaatgcagaggaatgcattatctgtctcctcaacccatgcctctcccatctaatttatcctctatagtagagattttctgcagaggcctggataataaatattttcacctgtggaggccatattgtctctgttatacctacattcatggaagatagcacttgtagacattttcttatataaatatttctaaaactaagagcaacatctcaatttgaagatttcaggagtaatgtaaaagacttcaggccaggcgtggtggctcacgcctgtaatcccagcactttgggaggccgaggtgggtggatcacaaggtcaggagatcgagaccatcctggctaacatggtgaaaccccatctctactaaaaatacaaaaaaattagctgggcgtggtggcgggtgcctataatcctagctactcgggaggccgaggcagtagaatggcatgaacccatgagacagaggttgcagtgagccgagatcacaccatggcattccagcctgggagacacagcaagactctgtctcaaaaaaaaaaaaaaaaaaaaaaaaaaagacttcattcccctatcctatcacaaaatgctatggactaaaagggtaaacaagtggtttttaaacttcagttttagtggattgcaaaaacaagtcattggatcgtagccgcactttataaatgatatagaatagagtacaatagagtagaaaatatcagaatgcattatacatactaagaatacattttatgtttctgtttatatgtgcatataaaggtctttaataaaaattttatttcatattcttctaaagttagcaatgcatagtcttaaactgactaactcaaataatagacagggcaaaagtctgtatgcagatatgtaggtggtaaatgattgtgccttaaggtaaccaacaaatccaagaggtagcagggagatgagaaggtgaaggggatggttcacagattctaaaatgctcctgcttctctgaatggcttactgcattctttttaaatattcagcctctcacctcagtgtgagttataaacaccttttcattttcttctattaagtacctttcctcaggacaaaactttgacctgaaatgtctcttttcctgtacttcacctggcaaaaagcccattcattcttccaggcccatctcaaatgctagctgttttgcgcagctttgcatcagtccaccgggcatagttaatcattttctcctctttgttctttcaacactgtgttcgtgctactgcagtagcatttatcacattttattatgcttggttttatatgcctttctctctgctattccactatgagattcttggggatggggacaattttcatgactagttgtagacttcccaacacccagtacattatctgcgcatagtaggtggtagagccctaaacggagaaagcttagtgatgtggttaagactctgggcttgaaacccaggatgccactgtgcagtggtgcaaacttcgataacttatttagcttatctaagccagctttctcatctggcagtgagtataatatgattaatcgacagtgttactgtaaggatgaaatggaattatgatatcaggctttactgcagtgcctggcatttgataagttttcaacaaacagaatttaccattagtattgctgtcattattattatgattactgttgaaaggacagtggaaatggctactggaactgctgatacaaacgtatatagtaactgatagtgtcaaaagtgatttttgaagtaaataattaaattttgtaatatactctgtgctttagaagagaatgataatatgaaaagcaagtattgtagacttctggatgtttgtttttatattcaactggccatgttactgatttttactcttatctttcctcgatattttaaactattttgggggagaggttgaggggggaggaatggaaaacaggattaaaataatacaattttgctcctgaagacacttcatcaacttaattgtgtaaagttggggcagaatttctcaacatcaccactattgacattttgggccagatcattctttgtcatatagggctgtcctgtgcattgtaggatgtttaaacattcatggtctcgactcaccaagtaataggaccacattgttcctcccttcatcttgtgacaaccaaaaatgtttgaggggcgtttgataaatatgctctgaacaaggtgaggaatgaaaccaaaaagcaaatgtaaaggtgatgatatcacccttattatttacagagctgggttggagaaatgagtttctgtttgtaaactgagctggcttgataaaaatgaacacagaagaaggccgacttatccgctgagttccagagaggaaagtgtcattaaagaagtaaggaaaactgataatgtctgaagtcagctcattctcaagaaagaagaatggcaggcatggtcctttgctgaacatgaccagattttaatgatttccttcccattttggattttaggcagacatggtcaaattaattataacctttggttcctgacaccttgtaatcactgtctataggggccagcttttatttatttaaacagttatttttaataatataattcatacctactaacatgctacccaaaataaagctggaaatgcaacaattgtcgcatcgaagcacatagagcttcccaaaccatccttctgcctcttccacttgagcagcatcatcctgatatttatctttctcaaatttaccaacaaaataaatccctccacctccatggggtagaatgagcaaagtcagcaggcagaggtcagaaattagcttcaggaaaatgctgcctcaaggaaaattcttcctcaaggaaactaggaaggaagaaaaggtttaccttctaacagatggtgttgaaatttgtatgtttacttactgtttcaggatttcagggtgtccctaggaactaaatatatgtcaataaactttaagaagattatgagaagtgtttagaaagtgaagggctattactttttattagtgtagaactgcttttgttgaattgagtacatggtgatggtactggacatccacaaacctggcatctgcaaacccaccttctcattttgttccccttaatacccacattttattttacatgctgagaatattttatattttaatataaaaaaagtactctttctgtggattgaacctctctcaaatatgaattttgtgattttattttcttgcacaatgaaaagagttctttcaatattagaagcataccattttacagttgatccaatctaacatctcctccagtgcagcaagttaataacaaatggcactataatgacagattcaggtttatcttactacacacacacacacacacacacacacacacacacacacacaatctatttttgccacacttcagaatctgggtagcagttgaagaagtaccaacatatgaagtcacatatccatggtacctgagtttctctgagttttcaaaggagctatgattctaagttgcattgcaaaccacacgatattacaaagggcactaagttaaggaaggagtgacgaggagtcctcactaaagaataagctccgtggcacagggatctttgccgtcttactgcagcatctttagaatctagaacataaactggttcataactgtaccgttatctggaaaagcagagtcctggtgataaataacaacaatcacatccagttcgtgagcacattccattggctgtgccttatgctgtgtgggtatacattggtaacttaatttaatccccccagcatgagtgttattattatcctcagctgctttttttcttgagaaaactgaggcacagaggagtggaatgatttgctgtagttcatacagttaataaatatagagccagaattaggaccatataatttctgccagcccatctcctcacaaactggaaaggcaatgtagcggtgacccagctccttgttttgcttctgccatcaactaaataatgctgtgcaaattaccagtcctctgcatatcagagtccttttcattgaaatgctgagttcatagtcaatcaagaagagcctgtccatatatgaataatccgtgcacaatctttagactaagatacatcagtatttctgatattttattacatattcaaagaaagcttgaattgatcttaatttccacaaagtattttatgtttttgatgacatatcccttctttatttgctttgtgttgaaattactttggtatattgtctaaggttcaactagggaatgatttcttggttatttcagataaagatcattaaaaataatgtgtgcctagattgggagaaatgtgactagtctcaggcaaaaatagaaattagataataggtacatgaacttgaatagctcttcatccctatcctttaatgcgacatgtgcaatttaggcattggttttttttttttttcttttaacttttagtcagttcccttagcccttatggaactattttaaaaataaaataaacctgcctttgtgaacaccggattgtagattaacccacactgtaacaaacaaggaaggggtaagatttcgaaggcaaagatgtcttcacttgaatcttgtctctgctactttctacctatgcagccttagggcacttgatttcagagcctccagttcaccatttctgtaataagaacaatatacctatcagatacctccatgaaaagaatgaaaactacccttgttaggaaacaaatcaagcataaatgaaaaggtatgtcttaagcccatcttggtgaaggtgaacaccttgtatgatgatgattacattgtattctagtatcaggtttatattgtctggatattagacaatttgttcctggtccgtgtccgtgtttcacagtcataacaattctgttatcagctaattttatttaacaggatatttatataacactatgtgccgaacaccattttaagttctttgtaaatgttaacttatttaatcatcgtactactctgtttattctaatatctgcacatccttagaacatcacagacatctcgtgctctcctcataaaaccctccactgtatcatcatttctacttaaagactgagtaaatcaaacgcatatacctacgatgaaacagcatcaagtctcctaaccaggtctgcaaaacttagatgaagtgcagtttcaactctgcactaaagaaacccaagctgaaccttctcttttcaagccctgccttcttttggtgctacttaaaactttttcttactggctttccatctgttatttttagcttgcaaaaacactttactgttctttgaaatgtcagtcaccacagcccacaaggtataatttttgggacaagagattttacctccatctctacatgtgtattttatatatttcgttttctgtgatgaacttaccatggtaggtactattttttttttttttttttttgcataggcgaagtgttctaagatgctagaaacaggagatgatgtttgaattctaaggtacacactatcctttggcagaggcagaggaagttgaaattaattgctgaagctatgaaatgttaaatcattcaagggatattaaataatgtggaaaacaacaatattgtgaggggttctacgtatttggaatagtgttcagctttctgaacacatcatgtggcttttgaagttacactcatattaattttgagtgagcatggcaaaatataaccatgacatttttctagggtgactttttcaaactacaattaaaatttaaaacatttgctcacctatctttcttgtgaataaaataaactcagggttaacagttgcaatatcttcattaatgagaaattttgcacgtttagtactctaaattcttggttatccagcaaggtttgatattaaattaactggatggaagagttgcagaattgttagaatgagagttttactatcagaacaacctgtaaaatgtagattaattcatctaacaaatcagttttgagcatctgctatgtgaatacatactgaggctacaatacagtggtgagtaaaaacaattatgctacttattcttatgggtcttacagttcagttgataaagcaggggatggtaataaattatatgtaaatttacaattgtatttactattgcaatggagaggttcatggagctattttatgctatgcaagtatgtactaacgggaactaacctggtctgggaaggctgacagcatagcactgggaaggagtaagaatagctttgcaatgcttatcaagaaaacctaaaaatccatacccttgggaccagcatttccacactgaggcatttttcataaaggaatagttcaggttgtgctaagcattttagctattaagacaaggcattgtttttattaccaaaatattggaaacagcttatatattcaaatgtaaatgattagttacatttatattataaatattaagctatatggactatcagaaatcttttttaaagaacataaaagtttttattgtcataagagatgtatagtggaaaagattaggttacaaaatagtgaacattagaaaggcctttaccttcatcctgaccctacccttcctagttactcaatttattctatttgatttcaaatgtataaatgagagtaaaagttatagcggttactactagctaccatttagcgcatgccagccctatgctaaacattttacatctgttatttcagttgatttcatataaaccagtgaaataggtattattacatttatttctttttctgtatggaatttttaaatgtatcaatacagatgtgtattccctatgcaacaaagaaagaattgcttcagtgctcctgctgtttaccgtgaatttatctattgcattttatctaagataaatactttgttctcttgcaacagctttctgtgaagagggctgcagatacggtggaacgtgtgtggctcccaacaaatgtgtctgtccatctggattcacaggaagccactgcgagaaaggtaatctagcttgttttatgggggatagggacaaagattggtagaaagattgattcagaaagaataacagctctttctttagaaataatactgtgggttgacttgatacattgtgttgtgacggtggatggagctctcccaaagtgggtaccttgcttaaaagcctcccactctctgaaaatagagcttcattcgccttccctccaacgatttaattttagcaaggtcaagtattttctctgctatagctcagtgtgcatttttagtgctaattagagataaagcctgatgaactgacctgcctcacttatcatctactgggtagcatcacacacagttattagaattataacaatctgctgtgtcaacggaatctaaattagcagcacatgctccttgcgtaaaaccacattaaataattccagcagcaggtttattggtgtgcttgagattttattctaatattggtttattaggaacattatcattcatagacctgataatataagccaattagcgtaagtaagattacattatgtgcaactttctatttgcaataaatgttgtgtttacatttggcactgtttggtgaaatccaactcttattgattggagaagccctcctatttgtgtataagtgaaatttgatgttcaatgccaatgtatgtgtcagtgcaaacaaggggtttatgacacgtaaaagtgaatatttcagtttgttcttccatgtgttttgttagggtaaaatcactgcattgtgtttttgttctggctctggaatgtcacacttactgcttttcatatcatagcacagaaaaatggaaataggatgtcgcatttattatccttactattacatgacgggggaggtgtcttcatctggtgccagagatataagcaaagttcttgtttcctttccttcatgtttagaagcttctgaatttagataacatttttttatgtgcccatttattatttctcaccctgaccaacctgttatattgcactgcctgtatatttatgaggcagtctaatccttttaaagacatgccaaaaggtaactaaaattgttcagtaaggaagtcagtgaacaatatttgcaccactgtttctatattttgtgacattatcaacaaataaaaatataacaaataataactgttttttcttaaaaaaaacatatgaaagaaccatgtactacctttgcgcagcgcaagagaattaccacatagagctaaagaattcttgctaaaagcaaagaaacttaagggtagcttaggacacatgtctttactgaactacatttaattttaagtaggttttttaaaatgaaaaaaaaaacaaaaactaaaagattcttactgcttcctgtagaactgctgtatttccctaaactgaatacacagaattaatggggaaagaatggtaataatgatgccaataatcatgaatactactactaatgatatgtcatttatttgcaataattgttaggatttttaaatgaatattttaagattaaacaaaggagttagatattattactcttatatgtaatcaaactaaaatttagctggtgtaagtaacttatgcaattattagaactgagaataaaacacagttgtatctcacaaagcctgtgttatcaaaccttgcatgggtttttcaaggatactagatggattttttattaaaatacatattcttgggccacctctccaaactagatggaatatcagggggtggtttcacgaatctgcattttcaccaagcacctcaggatatttaaccatagcaactactgtaacattcttatttttttacattagaaataactggagggaaacattaccttagaccagggcctgtgatcagtagcagaccaggaggaattgattatggtgtctcatgccttcttgatttgtcctttgtccttttctctgctgagtaagtgggtgattgcatcagtgcttacagtctggtttgtaatgtgaagtcagaaaaatataaaggagaaaatcaagaccagggaaaaagttagacagagataggcaagcatgggtccctatgtaaatattaaagttgacatggagaattgcatattcttgaactcttgcacagtcatcataaagggaaaaaatacaataaaacaagatttctctgcatttaatgctatacttcatctgtagcaaagtcattccacttaatattggccaatactcaaattctatcagatttttcatggaatgaatagagtacatagttttcagtcagttgtgtgcaagggatctaaataaattataggctaaacactgaaaatctgtgccattatcttgtctgagttattttgtcatgttgatcattagcaataaacattaaataagtctatttgccttcaaatagttgtgctagatgccttgagactcatagtgccaaaggaaaaatgcaaatgaattgtgaatgtcttgtggcatgattacactaaatctttcatttgatttgttttaattttaagactaagtaaatggtcccatttgagctatatagaatccacttatgtttagtctgaagcatgttctcttatccccctagttactggttttattcattgcttgcaatattcagcctttcaaaattcaagtacacttagtaaaatcagttaaataatttgttaaagaaaattcctgtctgatgttaataatcccacttgtgtttggtatgtaacacacagatgaacaactctgcatttactttccattgatgacatttcagtaaccttaaacttttcataaccccccttaagcaaacactttgcctcctttggtttctaaacaacgtataattctagttcttctcctacccttcaacttccttctctgtgtgcttagtttgatttggttttacaattagcatggagatgtgtaaagagaaagatgagtgaagaatcagtaagaggagtagttttgccactcttaggatggaaaagggctgctggtgaatgctctcttctcaacctggctaagaactaaaaggacagaatgccacacggatgtaatgtagccacctacaaaacagcatgaaacaacacaaagtcctcctagagaattttcacatgtaaaatcaaagagctacactaaatccagagatatgttaactgccacaaaacagcagaaaatcaccctctaagaagtatgtaagactaagttttctatttggtacttttttctatttttttttagtggctttaaacaacaaatgtttattatctcatagtttctatggtttgaaatttgagagcagcttagctgagtggttctagctcagggacttttatgagattgcagtcaagatgttgactgggccagtgattgtctgaaggttggggagtctgtttccaagatggctcactcatgtggcgattggcaggaggcctcagtttttcattttgtgggcctctccacaggctacgtgagaggccttataacatggccactggaatcctgcacgtcaagtgatgagaaagagagtgaaagcaaggaggaagctgtaatgctttttgtgactcaatcaaatgctgttcacgttggccacgttctgttccttagaggagactcactctagcccacactcaaggagagaggaatgaggcaccacctcttaaaaaaacgattgtcaaagtatttgtgggcatattttaaaaccaccacactgtgaaccctgttacttattctcaaaccttggctctgattttaaactccttgctttggaaccttttccatacctctcaaacttcccttgaaattttctggttttagtctttgactccctacatcttgtactcttgatcatggaacaggatatattgtttacttatctgacgttgaacagccacaaactgggattcagctaccaggctgtgtggaactgactgtgtgtgtctgtgtgtgtgtgtgtgtgtgtgtgtgtgtgtgtgtgtgtgtatggtcttctgtgtgtgcacatgcaggtgtggacttgcacatccaaacagagaagaaggaagaaggcaggagtttatggatgtgaatgtaggttgatcctaatgtgtgttcttaatccttttttcaacttttattttagattcaggagttacatgaacaggtttctcacctgtgtatactgcatgatgcaataaaatcctagatataggatgagtaatcctgtcacttaggtactgagaacagtactcaatagttagtttttcagcctttgccccctcctttcccactctagtcgttcccagtttctatcatcgccatctttatgtccatatttacctaatgcttcgctcccacttattagtgagaacatgaggtacttggttttctgttcctgtgttaattgacttaaaataatggcttccaatttcatccatgtgtctgcaaaggacatgatttcattcttttattactgtttagtattccatggtgtatatgtaccatattttctttatccactccactattgagcacttagattgattctatatatttgtgaatgtctactgtgaatagtgctgcaacgaacatgtgagtgcatgtgtctttttggtagaaagatttgttttattttgggtatatatacagtaatgggattgctggatcaaatagtagttttaagttctttgagatatctccaaactgctttacacagtagctaaactaatttacattcccaccaacaatgtataagtgttcccttttctctgcagcctcaccagcatctgttgttttttgactttttaataatagccattctgactggtgtgagatggtatttcactgtgattttgatttttatttctccaatgattagtaatgttgagcattattttatatatttgttggctgcttgtatgtctgtcatcttttgagaagtgtttgttcatgtctcttgtcaatggagttatctgtttttgcttgttgaattgcttatgttccttatatattctgaatattaggcctttgttggaagcatagtttgtgaagattttctcccattctgtaggttgtctgcttactctgttgatagtttattttgctgtgaagaagctctttagttgaattaagtcctacttgtcaatttttgtttttgttgcaattgcttatgaagagttaggcataaattctttcctaaggctgatgtccatagtggtgttttctagatttttttataggattctacagtttgaggtcttatatttaattctttaatccatcttgagttaattttttgtatatggtgaaaggtaggagtccagttttattcttgtgcatatggctagccagctatctcagcaccatttattgaatagggagtctttttcccactgcttatttttgtcaactttattgaagatcagatggctgtgggtgtgcagctttatttctgggttctctgttctgttccattggtctctctgtctttttttacaagtaccatgctgttttggttattgtagccatataatatagtttgttgtcaggtagtgtgtgatgcctctagctttgttccttatgcttagcattgctttgctatgcagtctttttgtttcggttccaaatgaattttagaatatttttttctggttcagtgaaaacttgtatcagcagtttgataggaaaaacactgaattttgtaggttgctttgggcagtatggccattttaatgatattgattcttccaatccatgagcatggaatgtttttccatttgtttgtgtcatctatgatttattatagcagtgctttgtagttctccttgtagaagtatttcacctccttggttagatgtatttcgaggtatatttttgtgtggctattgtaaatggaattgtgttcttgatttggctgtcagtttgaacgttattggtgtatagaaatgatactaatttttatacattgattttctatcctgaaactttactgaagtcatttatcaactccagaagccttttggtagtctttaggactttctagatataggattgtattgtgcatggagagagacagtttgacttcttcttttcctaataggttgccttttatttcttcctcttgccatattgctctggttagcacctccaatactatgttgaataggagtggtgagagtgaatatctttgtcttgttccagttctcaaggggaatgcttccagtttttgcccattcagtatgatgttggctgtggatttgtcatagatggctcctattattttgaggtgtgttcctacaatggctagtctgttgagagttttcatcatgaagagatattggattttatcaaaagcattttctgcatctatggagataatcatatggttttcatttttaattctgtttatgtattgaataacatttattgatttgtatttgttgaaccaacttcacatcccaggaatgaagcttatctcatcatggtgagttaactttttcatatcctgttgaatgcagtttgctagtattttattgagaatttttgcagctatgttcatcaggcacaatggcctttagttttcttttatcattgtacctttgtcaggttttgctattagggtgatgctgtctttgtagaatgagttagggaagagtccctttttttgattttttggaatagttttagtagaattggtcagctctttgtatgtctagtagaatttgactgtgaatccatctggtccagggcatttttgcatggtagaattttattataaattcagttttggaacttgatattggtctattcagcatttcaatttctctctgattcagtattgggagataatgtgtttccaggaattcatccatttcctctagatttgctagtttgtgtatgtagtggtgttcataatagcctgtgcggatcttttgtatttctgtgggatctggttgtaatgtcatagatcaggatttcttaacctagaagacactattgacattttagttcagataattctttattgtggagggctgtcttatgcattgtaggatgtttaacatcatccctggactttatccatgaaatgtaattagcagtacacctccagctgtgaccatcaaaaatgttttcatacctatcaccttaaacctttgtcgtttctttgtggtgagagcattcaaaattaaataaagcttttaaaaagtctctagtaaaattaaggaaaaattctccagacgttgccaaatatcccctgggagacaaaatttcatcccattaagaactcgtggtctagatgtagcattttaaaaagtctttttaaaaaatatgcatatatatgtatatatatatatatatatattatagataatcatgtctcagtgttatttgataataatatgaaaattataagctttttttgacaagaaaaacacttaataatctcttgaacatttttagaagtacttagggtttactgtgattagaaaatgcttaaccattcaagagccagagactggatgatatccatcatgtgctatgagaggcacaccttcttacagtcttaggaaccaggttggtatggaaactcagcctactctatgttcaccctctctcaatggtggaataaacatgattctccaactccacccaaggaacatgtgactccaaaccttgtgttctcctaaaggaagatagtatacttatcctctttcttagaagaaaaatttaaatgtatgtaataatgaaagaatttctcttatggtgtaagacttagacacacacacttgtacattttttttttttttttttgagacagagtctcactccatcgccctggctggagtgcagtgatgtgatcttggctcacagcatcctccacctcctgggttcaagcgattcttgtgcctcagcctcccgagtagctgggattacagatgttctccaccacacccagctaatttttgtatttttagtagagatggggttttgccatgttggtcaggagggtctcaaactcctggcctaatgagatccacctgcctcagcctcccaaagtgtgcccggccaacacttgtacattttaaggagaatttgcactgaaatgctttctgtattacaaagccactcaattaatcagtttttttggtaggaaattggactgggctgtaaatcaagttatttatttatagtggtacagacaagcctgccaattatactacatttccacattgtatattatatgaattatagagtgtataaatacaattgtgtagatatcaggtatctataaccagtgatttgtgaatcagactgagaactggacacaactacccaagttgtaggctagaacacagtctagtataaaataattggaaaaaatatgctgatgctataaaaatagcagaccttgactttctcctccacatttgttcagaaataggttcatttactgtaactattattaaataaactctcataagctttgaacctctcacagtatccaagtgtttttgaaatatagtaagtatctgatcaagaatatttagggatatcggtaaaaagcaaacaactttgaacagctttgttcattcacaatataattttgagtgattttctcctgttttgcttatatgattttccaattttcaaaataatacatttaaattatgtttgtaataacaaatgatttttaaaagcttaaaataaagagaacataacagtcaaaatttttcttagttacttgtgattttttgaaccttttctaaaggaaaaattttgcagaaaaatttattctactctcttttctgtgccccgcggacttgcaggtatgtagacagagagtaatagtttgcctgaagtatattgtcaatttaccaggtaaaaagaatgatcagaaacaaagacttctgtgctctttcatattttatatcttgcctgtattttgagagatccctatcagcatccatctattggtaactgctttacccatccctgttactgggggagattttaagaatttttaagaaggtgaatacttattcccctcccataacagagaatacaatatttattctatttcctctccagttatcacaggactgtggcaagggcatctggggggagaatgaatgcaaaagtacatctttacatccatagcagacaggagaattatttaacttttctcaatttgagctttctcaggttgtctggcacatgattacttgctcagtaaatggcaacttctatcatcaacgttgcttcttttcttgtgcctgatgctcagaaaggagtaagcagggcttctatggcatcattgaaaaagagaaatatgaggatttgaggtttctctgcattgcccatttagttaaacccactagtaaaaggagggttgcaaatgctcttttaaaattctattaaagtcaggtaaatgtgaatatggtttgaagaatttcctgtcctggatgtttccagaaattaagaatggcagaagagaggcatcaaactagaagatgagaggagcttaaacctgctaagactgagagaatgtgatcatgtttggagcagctgagaagtcttgccctgttcagtaacccctttcatctcttcagttctacccactcaatgtttttcttctttcttgaatgacatctctgctaaagatccagcatacttcccttggatgaaaaatggggttgacacacagttcttagagtcacttgaagctatttcacaaccctgtccttgatcctgcaaggattttcatctttccaggttgcagacatatggaaaaatatctccagctgtttttactctcattgtccagacaaacagcacattttcaagtcatttcaattaactggaaacatcaatgcctttttttcacaaacaagaatttggacgagaaaataaagatgcagtctagtatactgaaaagagtactgtattgatgatcagaggcctgagttttgatactaaatctgcctctgtgaagtgaaatttacattaatctactatacatctattgtaagccccaaattttgcatttattatttcctgtgagggagttacttttatccttttggacatatatgaggacatgtataagtgtcattcagccagtcagtagtcaagttgagattctaacccgtgtattgctgaatccaaatttcatacactttgctttataatctgctacctcgtgatcattttgtctgtgcccaagggcaattaaacttaacagattatacaggaggtaaagtaaattatgttttcctgtgagtaatgagccataatctcttatttgatcatttgcattgttttacatattcctttcaacatttttgtgcctaagacaggaaaagagtaaacaaaaaaggggtgaagagcacaatctctgaagtcacactaccttagttttagttaagctgccactatttacccagctctgtaacactggatcagatttacttaacgtttctaagtgtcggtttgccactaaaaaaagaaaagagatgttgatattacttacttcataattttattgtgagattaaatgagatattgtacttaaaatacctggtagaaagcctggaacacagtgtctagaaattgtagctagtgataactttaattaaccaggggataaaattgagactcagaaataataggctgcttgcccaaggatactcagcaggtaaacagtaaagccatgtcttatatttatcttttgctactgaagtctctctcattcttctatcagttcttacaacctctcactgtacaattcaagtgtaaagtgattttatttgtatcatctttccagctctattctctctgttcccacaaacattttatgtaacatcttatcaagctaacaaaagttaatttatgcaacagagttctgctctggggaaagactgagctgattcagcacctggaatagtggcatgtttaacttgggtatggtccctggaagggattttttttttttttttttttttttttttttgctattgtttacttctcatctcttggagttaaaattgaagatttaacagcaagttctcactgtattattgatagcatgggtgactctgtacataggaagagttgagatctcattcaaaaggctacccacttatccttctacaaatattttcttagttcttcgttgattcctcaaattgaagaaaggcaaacattctaattctcaatttggcatcaggaaacctggattctattctccgattccactactcatcagcaatgtgaatagggacaacctcagcttttccatgtaaaatgggagtaatcatccaaatatgtggaaggtgactaatggttaatgcaggcacaactgatttttacaagtgttgcaaacatagtttagtacccaactttgggacgtagaaatccttaacaactattacattattgtctatcaaaactctggcatgggaaaaatcagatttttatatcttgttacattacatttgaattcagtaaacatttgataaatgaataaatgaataagtatagacaaggaccctcaatttcacatggtccattcttttgattttatagatctcaagttgtaatcacttcaattcaaaccttattgaaaagacacctaagttaaagtatattatatcaagaatgggggaagaaatgtcattaacaagaatagaatagaaattttggtctatttcaaatagctttgtcagtccacctttccatagggccctttgtaactttaccattaatgaagggagctagtcttttaaatagattggcattctctgtcaaataaataaaagctgttagagattaccttgcctatttagtaatgcagaaaataattcttgactaaatgacaagcagatcctgcttctcaccaagcaagcacacactactgaactgtgaaagtcaagagtttggttcatatcctcatttttaatcctatatcctgggaaatacaaacaccactgtaactttaaacacaaaggataaataggaagaaaatctagctttctgtgaaaccgtgagcaactggagcccagaagttacaaactttccctagtaactagccataagtctttgtatccaagaatatgcactgcactgtaaatcatgtggaaaaaggctaattgaagccaatagcctaactcagaaggaatgtaactcttatgatttgcatcatttgctcctagtaggactgactgaatgatcagaaaaagtagttcctgaaaatattcacttagatacaaagtatgatgaattgattaatcaaacagcaaggtctatgcatttattatggtagtgtctgaaacgataagcagtattcggtttttttgggctaacgtggttttaaagcattttccagtttaagagagaccttgaagttatctatgggtggcagcaatttcagctaaataggttgagtccatgaggggagatcctggaagattattttattaaagaatatcttactaagaaaaacacttcaggacctcctcagtgcttaaaagataaagtccaacttacataatatctaaagacttccataattgggcctcttcctacctctccagctttatctcctacttctccttaaagaaatcttaaactgcagcccattctaaactacttcaagtcactgaaatgcaccttaatttttcaaacctctgagcttttgtttggaatactctttctgactattacacacctacagatttatatatgtatatatatatataaatatatctgtatatatatttatacataagtatgatattaataaaaagaatagaaaaattagttattgagtgtttccagtaatccagaatagtcctgattttcccccctcaaaatgctttttttacaatacccaatattactaactaatcagtaccaaccaggcccgaccctttggcttctcaagatcagacaagatcgggcatgttaagggtggtatggccatagactcatattgcttcttctaagtcttctttcattatatttgatggcaaactataatctttcacattctctgggctgaggtcttgaaatcatctgtgatttctttattttgcactgcacattcaaattctttggcttaacttttaaaatatatcttaaatcccaacttcatatgatctccactgctatcacccttttacatgacaacatcatcatctctaatctagatgatggcataaaacctctaactcatcctccttccactgttatgcacctgtagtctctttttaacatagtagccaaggggacattattgaaacctaagttatatcttgtcattcctctgcttcacattctttatagctccccattttcactgcgtaaaagtcaaaattattacaatggcctataaggccctagttactctgggcccacctgcctattaaatttgtttgtcctcaccattcactgtgctctccctcactttttatcccctttttctggccataattgtcttcttgattttcttttttttttacatttatttatttattattatactttaagttttagggtacatgtgcaaaatgtgcaggttagttacataggtatacatgtgccatgctggtgcgctgcacccactaactcgtcatctagcattaggtatatctcccagtgctatccctcccgcctctccccaccccacaacagtccccagagtgtgatgttccccttcctgtgtccttgtgttttcattgttcaattcccacctatgagtgagaatatgcggtgtttggttttttgttcttgcgatagtttactgagaatgatgatttccattttcatccatgtccctacaaaggacatgaactcatcattttttatggctgcatagtattccatggtgtatatgtgacacattttcttaatccagtctatcattgttggacatttgggttggttccaatgtcttcttcattttcataaaacatgtcagttatgttttccttactttttaaaaattattttattacaattttttaatgtatttactttcaactaactcacatcatattttccttactgctttgtttgcttggaatgttcttccctcagatattttcactgtcgcctccctcctatgaaaaacgtttctgcacaagcattacctcctcagacaggccctgacccctatctaaaataatacatttcctccttcccattgctgtgttattgttcttcggagcctttatcactctctgacacaatagtacttttcgtatggcttcactgcccagccagaaaataaactccagaagggcaggggttctgtctttgccattatatttccggagaccagggtagtacctagcacataggaactgtgtgaaacatttactgaaaaagcagacaatttaacaagaagaagctcttttagtttcgtattagtctctaaagccacaatactgttatgatacgtcttgggaaggataaaaaaatattgtcgtcaatcacatgcctgcattcctgatatttttggatcatatgtagccagagttatccttgatgtctccttctccctcacttttccattcaatcaatcactacagtgcatcttttttttcccctccatcctacctcctagtataaaccactcatatttgttttacgcctgaaatgatttcagaacacaagtcttcaagtccccagtcttactcctccctcacagaaatgttcttccggcattgcagccggtataatccttataaaatataaatataatcaaatgttttctctgctgaaaaaacttaaatggtttccagtgctttcattataaacaccaaccttcttacagtagcatcaatgactcgctccgagtagcttttccattttaacttttaatcaatattcctcctgcactaaacattgtcagattttatcaaagcaacaatctgcctctgtccatggtattgctctagctggaactctttggattttctttctctagtttccttctccttcccataatatccagtccccatcttttcctattttctcacatagattgtaagcttttcttccaagatacttttcagactccttgctcaagattaggttccctccagtgcactccatatcaacttggtttttccttcataaaatgtattacatttaatttcatgtttacttgttttctcttccatctcttcttaccacccatccctgtattacaaccaacatttgtttaacttccctttctaatcacccccacccccgccaaaaaaaaacccttcaaagtattactaaatctatgtagtaattattaacccagagtgtctccaaactgaaacactatttttcttttgttcctttcctgctggtgccattcttcccattccaaggtgttaattataggaaacataaatgaggacatgttggatttgcgtatcatgttctgaatgacagaagcattaacatctttttttaaaaaaaccttgatattcataaactagatggttcatttcaggaagataagtgagtccccacttccttccatagacaaagctgcaggctttcatagaacattcctgatcagataagcatggccagatatagtattttcctggttcttaaattgcccagcagtttcttttggagcagaccatctgattggaatggttaaagaactgcggactgcactattaagcacttttaaatctactgtcagcaaattattatggtactctgtttcagtaaaatgatgctaacactgaagggcaaggctgacatttttccagatgcttggtctccagctatgtggaaatactgcattcacttgtatgttctccataaattctatgccttcgccttttggagatgtttacatttatttttgtacatatatttttcccagtgtctttcacagtaccaatacttccctagtctctgaaaattagagtcagaatggtgaaggaaccatttaaacgacatagctcttatttaatgtttaggctagaccttcatttaagctagactttgtgctacaggattgatgtatgccacttaatcttcataatccagaaggtgagcattgaccaacatccttcaccccacattgctcgtctaatttcaccacatatttttacatcccttcccccgaccatgttttaaacatatcagcaatacctcagggcgtttgcacctagtgttctctctttctggggtgtttttcctccatatatatccaggattcatttcttaacctgcttttaggtctctatttaaatgtcactcattagtaaggcattttctaccattccattaaaattgcaatactgaatcttctcccagataatagcacctaatttccctgctgttcattttttctattgcacttttcaccattaaagacactaaaagtatcactaatctatcttgtgtattgtctcttcctcccacttgatggtcacccaccatgaatgcagagatttttttgtcagtgtttgctgctacagcccagctcttggaacagtccctggaactcagtttgcactcaagaaatatttattgaatgaatgaatcaatgattattctaatttattgggtaaactgagattatgtactggtaaggtagtacggacaagattataggattaggaggtgtcagagctgtgatttgaacagctctttgtgcctcaaagctcaggcttttaaaaacttcctttaccactcttctcacaaaagcaaggctgaatacaacaaaagttttgacaactgcaagagctcatatcttctgtgttttttctcaattgaactctgaattctgagtgtgttactatagtaaccctatataccatctacaccacatcgatattctgagagactttcttcatcattcttaggttaatacactcttccttgtaagggattgctataatagtaatattttatattagtgcagatctttaaagtgtctagtgcatttttccaggcactatattatctttttaaaaaatctcataacaatttaatgaggattatattactgtcatcatcctgattttacagatgagaaaattgaggctaagaggttaaagaaattgcttatgtttgtaaagctaagaacaaggggacagctggaacttaaattcttgtctggtgtttaaaattctatgtttttttttttttctggtatgccatactgccttcagccttccttctacagaggtgttcatttttcttgggccaaatcattaatatggaggttttatattgaaagtgtcagaaagatgacattgtaatacctgtagccacagggcatttctacatcggggcagtggggtcacaatatgcctttttgagctgggcattttttgccactcaccatgtgaccttgatcaagttatataacttctcaatctgtatctcccaatattgttataaaaattagagaaagtctaattagcaaacagtaggtaatataaattagtaggtagtgaagagtcatagggtacaaactgttatctagagcttctgtatttgagaacaagaacaattttatcagtcatagctaatatttctatagttctttatagtcacagacactttcaaagacattttctctttgcagcatctcaacaaaacagtgtcaagtaagtttaattcccgtattacccacaaagaaatacattcatataggttaaataattcatgtaagttcattctaatatgaatcattcagttccactgctccaagctttgaacttgaagtagaatgaaagcaacatgagcttctcaatgatgcctctttcttcaacagggatgaataattatgcattatcctaaaaaatccccacatgttaaggtatggtgtaatacatccccagagaaatacaattttaaaacccagagggaaataacatttccggaaagatgttctcagatatctactgtaccaacagtttggaaatttctgaataggcatctaaaattagtttcatgtatacctatagatccttccctggttgaacactgtcatctttctttttttcaaggaaaacttatttttaagtcaagtaagtacattccaatgacaggaacactacactcgtattttcatgttttaatagttactagtcccccatttgctggttatctaagcagagaaccttatcatactcttcagtctatcaatatatcaatagctagtatttttcagatgggtctgtgccagccaccattgtagtacttaaatggattataggatctatgcccttattattctctcttataggtgaggaaactgaggcttgaaagaggtaacatgttaataatcacacagctgtttgttaggtttgagactgggatgtccatctatggcaaaataggcagtttctggttttctaagttattaaatatctgcattgttgaaagtattcctgaaaaataatttatgcttttaaatttaagtcactctgtctttctctcctcaattcttataacctttagcagaatcattattcagtaaaactttggattagtaaatgtcacattctgctctcccttccttaaggctgctctcaagccttgaaataattctaagagtacagaaagagggaaaagcaggtctggaaaactcacaaaaagttaacaaacttttgaaaactatgatatgtatatagaaaagcacaccaagaggaaccactctcctggcttccaacactccaggtcagttttcctgtttttaaatgttgtacaaatcgaatcagactataaggcctgtttgtgtccagatccttttgttcaacattaaatttgtaagatttattcatgctgtgaattggttgtaatttgttatttctcactgtggaatagtattttattttgtggatatcccaaaatgtattaatccatttcattgttggacatatgggttgtttccagtttgggctattttgctgcaataactattcttgtatatgtccttgggtgaccatatgtatgtatttctatatacctatatatctaggaatagaattgctgggcatgcttaggtgtagttttagtagatactgcccagtttcccaaagttgttatacccatttatattcctaataacaataaatgagaattccaattgcattgtaattttgtcagtacttacttattacctgcctttttcattttagccatactggtagtgtggtaattacattatagttttaacttgtacttcactgaatgacttacctagtggaacatatatgcttattgatcatttggttatactggcttgtaaagtacctatttaagaatttggcccttttatttattgtgctacctgttctttttgaaagcacaaagttttaaaaagtcaaatagttctataagattggctatagctccttgctcctattctattccagagtcaaacattttctttcccatctctataataacaatgataataataataataataataaataatatatttacattactatttctagagttttttcagttttagatgttacctattgacttcccaccatggaagatgaggagttcttttttcgaccgctcatccacagtgtgtgtggatgaacacacacacacacacacacacacacacgtgcgcacgcacccaaacacttcccatttctctattctgtatattagatcagtattcagtgtttaccttattatgtatatgtaagcaatatttataggtgagctatgaagttggctattattacttctttattacacaaatgtttgctttctctggatttaatgattacctaattttgttattgctgtttgttcagtttttcattcactcaatgttgggtcaacctcagattctctgctaataataatgtcctcccaatacatttacatgtatttgatattttataatgttaattccatgaaataaatttttccagaacattctgcccacttcattctatactggaagctctttctgtctacaacacaactgtttccatgaggttttttttcaacatcatctcttttttgttgttgaatctcctgttcctgaatcctttgtatttatccttttctggattatacccctatctttatagaacagattttcaattaacttcttgaggaagggtgcatagaaactaagttgttcaaatgttgcacatctgaaaatgtttttattcttcctttctacttaattgatagtttgaacgggtatagaattctaggttatataaaacatttttcatcagaatattgtaggattaagtgtgttgtcacattttttagtacaacttttgagaaacttaatattgtcctattcttgttaatttatataaactctacctttctctctctgagaaactgtggccgttttttcatcctcaggaaatttgatgatgatgtggctttgtgagcatctattgttaaatcagtgggctggagactttgaaaaacctttcaacttaaaaatccctggtttcatttctgggacttaaaaaaatgtcccctacatcttctctgttctttatttttggaactcttattatttgggtgtcaaacctttcagatttcttttctaattgtgttattacttctgccttacttttcatatttttctttttattattatttttttctttttgtggggtgatggaggagacatttcatcaacattatcttccaaattaattgagttattcattcaatgtagctaccctgtttcattattgctttctgaatgtttttgagacagggtctcaccctacccagtctggagtgcggtaatgcagtaatggctcactgcagccgggctcacgtgatcttctcacctcaacctctggagaaactgggactacatacaggtgcatgcatttttcccttatcttcaccttttcttaaacattcagtagtccttggttatctgctgatttttcagagtgccacttatgaaaagttgatttaaagctcagtttacctatgtgggatgctgatgtcaatgattttaggttcattcttttgaaccattcagatcttgtagggaagagtctttctgtttcctagaaatcaatcctataaattaattaaatttctggagcaattaaacttgattgctagcattctgagagtcaggtcggaagaataagacaaaagattgtaaaattcagtttgtaaatttttaattaatacccctgtctcagtatagtatttctgctctcaactatgttctgacctttgtggtaccctctgctgagactaaatctctagtgtttgctggggcaaaagaaaggcagtagcctggctggggtaaggaaacagctctgaggaatctaactgctttttaatctagcttccaattaattttcctattttagcttcactgttccccatagtttcagagatacttgatgccaccaattactgagtcctatgcaataagttgcttcttggctttctccactccaggctatgagtcattttctcctgtcttctaagtgagttatcattcatccacctcttttctagattccaaaattatgttacttttatcatttctcctgtgtgctttacccaagagggtttatatcctttataatttgtctttagtattatctcgttagagtttgaggggaaaagtaggggtaaatatgattatttaagccagtatctttaaccaaaagctagccccttagttctgaaactgtttctttcccatagataaaaagtcacaagaagtcctggtcattgtgataacttatatacaataataatataactgaccataaagatagtcatatgatataaaatgtcatccactttcaaagaaaaaaggttaatggaatgaatacaattttattttatactgcatgacatttactctttacaaaaatttatcaacagagactttctgcaaagatagacatttcccctttggaagtagagtatttatctaatttcaaagaccaatagagcattatttaagatattaaatgtttgaattattcttttaaatttgcaggatgttatgggaaattgggactataaactgccattccactaaagatagttaagtcagaatttttttttttttaagcaagagctatttcacatgaaattttatgtgaaatataatttcaagtgatttggacgtgagctttcaatggtttaaaatacgaccaatggaatgtaaataaggggaaatgggaaatggtaaagggaaatatagtgcataattggggttgaaggaccatcaagatgccacagagatgagctctgagatcagtcttatttaacaacttcattaatgatctggaaagagaattcaacaagttaattaaatctgcagatggtcctttgtggaagttacaaataccagggagaactgagaaatagtgtagaaagaccagggggtcaaaagctttgatagctgtgggcacagaagagcaaaattaaatttgggaagggtaattacaattaaatacactttgttcaatgaaaaaagtagttaaactgcaaacaacgctgaatagaaaacagtaaagctaaaaaaaattctgtggctgatgagcaatttatttagataagagcaaagctttctgactatagaaataaagttatttttaaataaaatgtactttataatgtatttgttctgtgcctaatagtcaaaaaacagggatttagtgacctgcatttggctagtgttaaaaagacaggaaagcattgctctaactctcagatgtgcttattttctagtacagtagatagattagaaactcatgaaaatactctaatatatcctgagattaagattgggaaatgatgggtagagcagtagagcatgaggggaacttttgaaagatgactgactatgaaatagttgacttccacttttaaatatgggtggttagtgttaacgtgctaggtggttgagaagattggcaggtacttttatatccttttctggtagtacctttgactatgggaagtcctctcaggtctgggtattggaagagcttctttaattttgaaaatgtgatcagtagttagaattctaccaaggcctgggggcagtagagcagactggatgaagttataatggtaattattagaaacggaaatcagatatacgcaagggcacacataggcaaaaggtcaatcacttactgagtatattgcctgtgccaggatggctccaagtacttcacataagttaactcctttacttcttacactcatcctataggattagacattattcttatctccaatttgctatttaaaaaatcctgaaacctagaaaatgtaagaaaattacataactttaagtgctaataagcacaggacagtaggattcaaacccagggagcctgcttctaagatttatatgtttattttccccagctatgttatagtatctctcatagaatattaccataaataatatatacagaactcatgtaaggtatatatacacataaatgtatacatatatatgtatgtatatagccctatatatgtgtgtatatatatggccgtgtgtgtgtgtgttccattctttagagttctaggggcttgtccaagacagactggacccagaggcatgttttatatgcagctcttattagcagaattgtccttgtatataaagtatgtgaacagaatttgttgtctacagtttccaaaaaaaacattatcttaaggaggtgtgtattgtatctgggttaattgatgatgggtctctggaagggagacacattagctaataaacacatagctgaaattacataatttcataatgtcagtctctactagtgtcactaagggtagaatcctgagtcatcatgttttaaaatttaaatattaacatcttcaagagttaacacttatgcatgctagaatattcagatattctataagcttagttaaggatatacattgaaaatctttatatttgtccacgagctacaagttctcctacccagaaggagccagaatcactagtttcttatatgtaggttaataggctaccaattgtagtgggactcagatagtatgtgattgtttagattgatgaggatatcttggagaggtatatacaagggatattaaatggatttgagagactgaaagtaaatttcacagttctatttgttaatagctagcatggacaaattacctatgaaaagtgtacagaaaaccattaagaaatagaaaaatgattaaaaaggacagctgtattggaaagcaacaagttaggaaggagaaatctagaagattaatactgagaagagctgcctggggtgactgacagctttagcctcaccatatctgccctctctttgaaactagtcagaatttctcaagcttctccaaatgagatcctgagttaagaagaattctgtgtttgtaataaggtgaggtggtttgaactgaaacttaatcacatttaggaaagtcaagtatcccttctgggagagatcaagcagattatgaaatgattttagagaactcataacaagtttcttctaacttttacatctatatttggccaaataaaacacatggaaagaaagtcctgttttggtccctggggcaaaagacttaagaaatatttctaacttctgtttaaatgattcagtttccaaggctcacttcacccactaaaatggcattggtgatcataaagaaatttcttcatgatacagtggaatcgcttctattattctagtaatagtaatttctctattatttactagtatacaggaaataacacaagttatgccacagagtgtagaaccttgagaaacattaaatattaaaagcataattctactttttgacatcagtggaaattacattggcctctctgaaaaaaactcctcgattgtgtctcaaagatggagcctgaaaaaaacaacaaaaaagcaacatcaatccaaaaaaaatcaaccaagtgtgagaatttattgattagaaaaataaaacaaacaaaaaaacaaaaaaagatcaacattagctgggatgacatgtaacctagagagaccaagtcaattcatgcagacttaaaatgtcaataccttcttcaattccagtagcaagtggttgcaacttctggctgaggcagttttcacttctatatacctggcaatggaacttccttcatcaaataaatgaatttttgccccaatgccttgtcatcaaagcatcaataattgagtaaaccataccctgtgaacttgctcatcacttacattgttacctttctcctaaagtaaaaaatctacagggcactaatctcgtaggacaggagctttgaaggcaagcattttctaattttccagtgccagcaactgaattcacccacatttatatgatttcttaattcattcacatataaaataatatgttgaagctcaggaaactcgtggcaaaaaatataaaagaatctatggttaatttagtgaataacaaatggtttcagaatgctagacacaagagcagacacaggttttatctcagcaagacagaagattgataaaggaaggactaaggaaatacaagatctggccacagggccatttatgaattgcagaacccacatgtattcgtttgtcacgtcaatggtttctgagtacttgccaagtacaaagataatttaaaacaagtgcatattaggagcattaggggagataagagaggcacataaataattattaatgcatgatttaaaagtgataaactctgtatgagaggtttagatctttggtagggttttagaaaaagtattgcttctgtttctgaggattggagaaaggatcaggaaaattgtcatgaatgaaaggcatgtgtacggaacattaaggaatgatttagacatatctaactcaaactggagaagtgacattccagacagagagaatgccataaaaaaaaaattgcagcatgagactgtacgtaacactgtggtaaagctgactaatttggtttgaaagctaggtgggattgtacttatttgtattaacatcagatgtagagggatgagttcctatcttttccctgatgattttaaggagtatatatgagaaaaatattaaatagtagcagagttgaggacattatcatctttctatcatgaaataatgtgtcaaaagtttcttcttaactatgtttgtagtaagtttttaatgtatcactttctttacaaaaagttctcttctttccagggctgtagcattttataagacacacgaggaatcatatagctgtaaagactatgctaactttttattgccatgcaaagtacatcaatgatttattgttctttaaataattagcatattaatatataacatgtgaagactgagcatcaggcatgaatagattcataattttttggtacctcttaaagcttccattgatttttgtcatttaaaaaattaatttaaaaagtagtatatttttattgtaaaaaatgggaaaatatggaaaagcaaaaaagaaaattaaaattactcagtctttatactaaaagaggaaatatgtatattactctatttacttccacctagtatttccgtgtacgtacacttctaaatttttgtcagtgaaaaatacatattgtattattttaagtcatataaaacacatataaattatatcacaaacatgtatctatattaaatattttataattacacaaataggttttatagccatgtgtgctctatcacattttaaatcatttaaaattataccttgatatggtttgaatgtttatgtttccctaaaatgtatgtgtttaaattttcaccctcaaagggatagtactagaagataaggcctctgggaagtgaataggtcacttttggatatgattagtgcctttctaaaaagacctttgaaattgtgacaactgcccttatattagaggcccaagggagacttcttttccttccaccatgtgaggttagagtgagaagacaaagctctcaccagataccgaatctgcttgaaccttgatcttggactcttctgtcgccagaattgtgagaaataagctacctagtctacgatattttgttatatcaggctaaatgaactaagatctacatattaaaaatagtatatttatatattatataaatttaaaatatgtatttgcaattaccaagaatcaacctgtattttttaactttgttaatgaatcataaaccatttttaatttatgaacgagattatactagtgaaaataaaggactttttggcttactcacctgagggtggtgtcctccactggcatgcccataggtggctttatagatgggcaccatagttccaagcatcattctctgaacgttggtacaaagtgtgtcccctgaggctctctgtatctttaaatgttcattaaaaaatatgacacgtattgttcctcctattctggcaatctgaaaaccttgtgtgattcactccgtcagctcttctgttgggtgattcataaatgtgcatgagtccagctttatagaaagtttctggagccatgggagtagacacttttgtcttggtgagaaaaaagatccaagagggagcataaattaggtttggaaagaatgaagtcaggaggaggatcaaagtagactcttcccaggcaaaaaagcaagggcccagataagacctcagagagtttgagtgaggagggcagttagaaggagcacaagatctcattagaacagagattctgttcctaccaatgatcagctggtctttacaatgtctggcagatgctcagtaaatggcctctgaacagaattgaattttaagttcctttgtataatgcttaaaaatctacttttgtttttacttcatattaatatcttcctgatttaaaaggttatttctattccattcctgcctcatgtggccatttccctatttctctttgcttccagttctttacacttttaagtgaatttaaagccagtcaatgattttcatagaactaattgaaactaacaattcccaggtaatccagttattcagtggcagttagtgacagtactcagaatggttgttacaatattcagatttgtcttttggtggtaagaacagccatgtctcttctgaagaaagaaaaaaaaaatattagacgagctcagcagatgtaacccactgtatctccaaacacttctcttgacgtttagctgcaaagggccaaggaaaataaagcattacaagggtggtaatggaatatggtaatggaatataaaatatcaatttaaggtcagttgtatatctacaagtagattcaactttgtgactgatgagtagggaggaagcaatgaattgggtgtttgggttcattactagtatctaggcattttgtcaagttgtgtcggtggttgacaatcgcttcagttgctatttaggtattgcaatgtgttagcttaaattaagtagccaagaaatgcataagatttaggaccagacacaggaacacctttgaattgttatttcaacattaatgtgtatcattaagcaactttcataacatgtttggttcttagcttcttcacctgtcaagttagggaatcattgctaaataattttttaaaatataaataaaaataatagccaaaatgtattgaacattatataccagatgcagatttaagtgctttcacatgtgtttgctgatttaagcatatattactaatttctccattttacagataagggaactaaaacaaagagagactaagtaatttaacccaagtttatatgggtggaatacggcagacctagggcttgaatttaagcaatctagctgcagagcctgtactctactgtcttttactgtgcaatacatctctcatttgtgaaagctatgataccgatgatggaaaataacggcgatgctgctgatggaagataatgatgatgttgataatggaagttgataagaacgctgatgttaactcaagaaaataacattactgacaccctgacctgggaaagtcgatttttcctcctagctactttaatgtagcattactaactagtttaggatctatagatgggatgtgtatgcaaatataaaagattatttctgtatactatgcattattggtgaactactctatgattgtataccactttaaaataacttttaattctgtttttcccttaattttcactcttcaagaaagtcaaccgtcacaaaaccatagtttgtgtcacagaatccttcccagaatctcagaattgaagatgaatattagatcctctctgatgcgtttcctaccccatccccactctcctcaaaagcttgttttcttatcaattcattctagtctgttgttgttgtttgcattctatgaaaagaattaactgtcacagaagcatccaattttattaaatgtttataatcatttcttattttctgatgaaatctgcctttttataattcagctattggtcctaggtctctattttagagccaattaggaaacgctatgtgacagcttctcaggaagtgaggaacattacatttattcccatttaacttccacttttgaatttgacccacaactccaggctgccagggtcataattctaccatcttgtatattcacgttctcctacctgtttaacgtaatcttgaaagttgataaacatgtgatgttctcaatgtctttacccatttcttgagcctagagaaactttcatttctgctctgcccaagccagactacattaaaaagataaatcagcatgcgcttatgtcttgtctgtgccacaaataaaagagaatttcagtttcacgaatacgtcaccctttggcataattcatcctatatgattgtactgaatttggctcttctccctctgtatgcccacctgcttcatagttagtgatccttgtccacagctcattgccagggtgccagggcacagcactaggcttagaaggcataggaggacagggaatggaagagaggagccagggaagggggatactctgatctggcctgtgtcagttacacagaaaataacacatttcatacaccagtgatggcagcaaagacaaatttcacagtatgtatttgaatgtcacagagctatagaaagaatgtggcaaagagaagcaccccatttaggctctattcctttcttgctactttaaattatacaaccctttctgtaatgttggctgttaaagctgaaataccacgtgctataaaacaatcttaatagaacatacaaagtgtcttttctatgaaaacataagattttttttattgaattatggtataagttcttcagcctaagttccttgggaagaaaaatatatatcttggtgatataagtctcctggaaaccataaagctatccaggtacaatgtaagaaacagataattaaaaggagcaattgggaagactttatttgttactttgagaaatatgaaatggcatttttctctaaattcttaaatgaaaatcgcttacttgacaaactaaagcccacgtgagaactgtgaagggcatttggtatttgtcctgcatcctactaacatcagcaatttagttaagttataacacgtttcctgtagtgacactagccaaaaagtgcaaactgacacaaaaatgaggcagggttggttcatcatctcagatctgctccaaggatcagtgagactgtatctggcaggtggaaacatgtatcactgaaacttaatggttagagaaagtaaggcagactcattagcatttctggcttaagctattcataggataagaaagcatgtttgaccttgcagtaggtaacatgaggaagcaccaggaatatgagtttcaagccaggcatcctggatatgaatcctgtctctgcctgccaatgactgtgatgtttgcaaactcatgtgatttttctgagcctaaggtatgaaatgagataataacctctactttacaaaattgtagtgaggagtaaatgcaacaatgtagatatagaactgtgcttgaacagagaatatttttaaatacagtttccacccctctcctttgatttaatttattaaaaacaggaaaagccgctttcatttaaatcttagaaaagtcttcaaatctggatatcagcatgaaatatttatagctggagtctcaaggaacagatgcacacttaggtaattcagcttgccttctagtccgtccttgcagttgtcaagaagcagccattgtaactcctggtttcgcatctaactttcctggcgtcaacccattttacaatttttatccagatgaagtttgacaattacactctagaatgattctactttgatctctttctatactttgagtacacccttttcctcacactcttctcaacttgggaaagaaagtaacctgaaattatcatctgtaggaaaacattgaagatttaaagcaagagacccacccataatatttgcgttttacagaggaaatttagagatgacaattttggcatgaaatgctggttttccaatggtgaaatttcaggcagtttcacaaatttatgctgtgtcagccattgcttgagtagccagatgtttttataaaatggccattcatcatcactccataaccagattgccaagtatgatcataaggaaagaaaagcagagttaagaaagaaaattagaactgtggagtattctaactaatgcttggtagaaatctagatccttttctttttttttttttttaaacaaaattcaccttttgttcaagaacaagtccttggtaccttagtctctaccattctattcgagtaaataagctttatctcctatgatgtgaaaggtagtttgaagtacagtccttaacctaagagaaagaaagatcttagtcttctattaggagcatatgaagcctattgaagtgtctgaacacttcccatttgctgctaaagtagccctgaaacagagctgaatattgccattctcttttaattgggtaaccttgcaaaggtgagagcagctaagagctagctgacctccttgatattggtcagtacctgaagaactgggctgtgactcttgtcaataactgtagggaagccacaaaaaccatcaagtaaaaggtagctgacctcctatggagggcactgtttgctgctgaggtggatgttacattgtataaaattgttttgaatgtacaggaaaagccacatactctattttcattatcttagattataaccctatgcagagcccctattttagagactggtaggaattcaatctttactgtattgaagggggttcttttctggagttttattaatatctgaggtctcatggggcacaaagcaattaagcatgtcatatagtctacctgtgtcagtgctgggaagctcatagaccaaaccttcagggactcttaaatctgaaggctttacaagtgacagaaatccaatccaacctatcttaaacaaaaatagtaactatttttcacattattgaaaagtcctggatagtagcctgatcttaggacacagctagataaaggtgctcaaacaacgttatgaccctgtctttcatatctggatgagtttcatgccccatggtgaaatgttggctgcctgccatcccaggcacccatccttacatcctggttcttctagtgaatataaaagacctctgtagctcttcaaaaaaaaaaaaaaatgtgcctttaattggctctcactgcactaattggattaaacagcagtaatagataattctgtatgaacaacaggaagtgaaggagagagcagtctttgatggaaagtcaagaatgttatcagaaaaaaaaggaagaatggatgttgggcatgcagaaacaacagcatctacctggacacagaaagtgggagtctttacaaagctgggatccccatttctgagtcctgtctcctgaagcacactatttagctatctccatcaattccagctctgtccttttttgggatgttaagaatgagcagctagagcgttccgtgacttatggactgtatcctcctctaacccttgatcaatgtggcggaaaatatctctgtcattcctgaacccccccccccgcaatcaaaaccactggatattccccccgccaccacgcacaccgattcataaattcaatctcattgttgaacttcagtctcacaaaacacatgtgacagtcaagcaactttgtgtctcaggcctgcactttagaaacagcctggctatttttggaagaagtaaagggggaaatataaggaagattgcaaacaatatctcagtacattcattttcctaccacatttgcctatacttatattttccttttactggacccacagtaggtcacacactcaaaatgaactggctgagtgattttattcttgctgtccttcagtcagttgcttttatatggaatttaggggcagactaatacagttcaaaggcattagaaggaactttagagtatgtggcccataagaaagcaattaaagtaagactgaattttctgatttaccttctccagttttgcttcatagatttctagattttgatttgggttcacctagtcctgatttctcaaaatacaagaaaactgaagcctaaagatattgtgacttgctcaaggagtaagaggaattataacttcccctttccaaagggcttactgtgatgctaggcactgtaaaatgatactttttgctactgaatcatcataataatcccatgtaacatagaaataataatcatgaaaattagaaattttaggcactcaacatgtaactaatatggtccagaactgggattaaaatttgttttacttgtacaacaaattgaagctggttatctgaagctcagcattactgctaggatctgtacctaggtctcctgaatatcagccctgggggctttcctcagtggtcccaaggggatcagactctcagtgtttttaatttctgcttctcagagaagtccccttactattcacttagggtgagatactaggacagattacctattctaggtcctccactcccacttcagcatagctgctctgtcttttcatatctgtaataaaggcaaggcaagtaagcctgtgtttgaagaaaggtttggggttaaaattctatgaagattcctagctttatgatctctaagggcacttttggttatggcttccgatggctgggtggttccacttgtagaccacctgggcccaccaagctctttttcaatcacataagccactttgatgcactaggttttgttgctgctccttggcttcattctttcctcttagctttgacactgtgcatttcaatgatggcttgttcagcatcccagcaatgacaaaaatgcatgactccaccaattttgtaaagaatataagagtattttggctttggttcatctgttttgcagttttgttttacctgttgtaaaaagaaacaggattccaattttttctgttgtgtttattatttcagatttgtcactgtgttctgtgctaacagaatacaaatggctgtgccctgaggtaactgaggtcaatggaaatgtttcctatgaagttaatacgagaaatcagattctgggccataagaaagttggccaaaacaaacagttctgttcttgtactatttccttctgtagcattttcattagctcctctgcagcatcaattatcacctcctaagcagatgactcaccagtctatattcttggaactaatcctttccaaactctagctccacatgctgctttaaaattgatttctcaatgtgttgaaagacccttgacctggtgaaagatggacacatcatctttcctcatcctacattaattccttctactaaaaatggccattattttccttcccccaacctttcctttctttgcaagcctgccccttgcaatatccaggaatggtgaacttttaactacattagtcctgatacctgggaagatgcttgctaggccagaatggacactggacacatgttggggaaactgaattctgatttccagggatttaaaaccacaattcatagactgagccaataaggttgtattggcccctccatttgtaagtccatacacagataggaacagagtggattccagacaaacaaaattcatagagaaacagaaataaaaactttgtaaaggaagctaatcttcaacaggagaagggagaagacaatgaaagagagagagagataaaaaatttctttatgattgtttagttcctaggcagattagcaatactgggctgaatgattttattcttgctgttcttcagtcacttgcttttatatagaatttagggggcagtcattgggcttgttgaaagttctgtacgtgtttttgattaatcatactgtctcttgaatttttaagtggtattttattctttacaaccaaattatccccaattgagggattgcttttcctgaattttccaataataataattaccagaagaagtagattactgaatgattattgtctcccagttatgatactacctagtgctttaccttaactttcaatctcaaaacataaaatgaaataaggattatattctttgtacaggtgatataatgcagttaagataaattgagcttcttgtccaaggtaatttagaactacatctaacttcagaattagacatttagccatcctacaaatgtatctcctatttctgttagtgctagtttttatcattcaggctcaaaagctgagtctctattcctatttatttttattgatacataataaagatttctggggtacatgtgatattctgacacatgcatacagtgtgtaataatcatatcagagtatttagggtatccctcacctcaaatatgtttcctatctttgtgtggagaatatttcaaaatcttctagttattttgaaatatacagtaaattattgttaactatagtcactctactgtgctgtgaaacaccagaacttattccttctacccaactgtatgtttatattcattaaccaacctctcttcaccctcctatccttcctagcctctgaaaactacttttatgaaatcaatgtttttagcttccacgtatgagtgagaatttgagtgaagctgtagtttaacttatttatgtttgattgttagtatccaataaattatctgaattctgtcttgaaatactatctttctggcaggtcatggtggctcatacctgtaatcccagcactttgggaggccaaagtgggcagatcacttgagcccaggagctcaagaccagcctgggcaacatggtgaaaccctgtctctaccaaaaataccaaagttagccaggcatgatggcgcatgcctgtagtcctaactactcaggaggctgaggtggaagtatcacttgagcctgggaggttgaggcttcagtaagccttgattgcacaactgcactccagcctgggcaccagagtgagaccctgtctcaaaaaacaaacaaacaaaaagaaatattatctttctaacattagctcacctctcagtacccctaggttatagtcatttggccagtctccctattgcctgtaaacacaactccttcaaatttagtatatgaattatttaccaagtttattccacagcccaactctagttacttaactctactccttataattattcaatgtctctctattacctaccaagaccagtaatatgtttttataccagccgtcaataccttatctagtatctctccaaattaccttttttttttttttacctcatctctcatccctctcacccacttcccttgccctctgatgaaacaaagttactaattatttcttcgaatagtcctcaaacattgctgcttctatggttttgtttctacagtatcctttatctaaaaaaaattttccttttctttgccaactgagatcctatcaactctctatggtccatttcaaatactctcatactccataaagtatttcctgattcttccagctgaatggcatctctttctccttggaacccctataatatgcttcttatatgtttctaatagagcttccctttcttttattgtgatatggagatttgtcagttgcacatagaggggtggcaagtgcttggtgtgtatatgattattgtgctcatggagagcagcatgagttgatcatagctctctttcttgagatcccaggtacttgcccagaatgcttcctcacttaacatgaagtcaaggaagccactcccaagtgattggagttaccatgcaaaatgaaattcaactggcattctcattatagtagctcccatctcataggagcttctaactactcccactcttcctaccagataccttgcctgggactcagcataactcttccattacagctgtagagagagttccagagtttttgctgagatcttcctgtctcctgattctccattttcttaggccagggcactgcttcagactacaaagaaaaggaggccaattgctttagggctttgagttcttttgctatagttttcctagaagctctacttacagacatatagatactggatcattaaaaattgcaattacctgaaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtctttgcccatgcctatgtccaaaaaagtgggcaaaggacatgaacagacacttctcagaagaagacatttatgcagccaaaaaacacatgaaaaaatgctcaccatcactggccatcagagaaatgcaaatcaaaaccacaatgagataccatctcacaccaattagaatggcaatcattaaaaagtcaggaaacaacaggtgctggagaggatgtggagaaataggaacacatttacactgttggtgggactgcaaactagttcaaccattgtggaagtcagtgtggcgattcctcagggatctagaactagaaataccatttgacccagccatcccattactgggcatatacccaaaggactataaatcatgctgctataaagaaacatgcacacgtatgtttattgcggcactattatcaatagcaaagacttggaaccaacccaaatgtccaacaatgatagattggattaagaaaatgtggcacatatacaccatggaatactatatagccataaaaaatgatgagttcatgtcctttgtagggacatggatgaaattggaaatcatcattctcagtaaactatcacaatgacaaaaaaccaaacactgcatgttctcactcataggtgggaattgaacaatgagaacacatggacacaggaaggggaacatcacactctgaggactgttgtggggttgggggagcggggagggatagcattaggagatatacctaatgctaaatgacgagttaatgggtgcagcacaccagtatggcacatgtatacatatgtaactatcctgcatattgtgcacatgtaccctaaaacttaaagtataataataataaaataaaaaataaataaaaattaaaaaataaaaattgcaattaccctgttaaagaacctaaaattcaggctatcacacctgttttaacgtgagtatagattttccgtctcgaaattataaggctattacattgacatcacatttattccccatataaactggtcagattttaccttaggtgagcagacactggtctagatgcaatctgtcgccttcttacagatcatagcttgacatttggaatactatattgtttgccactctctcacacacaaacatatgcatgacgatgagaaaacaaaaaatgaaagaatgcaagaaataattaatgaaaggcaggaagaaagagaaacaatacaaaaatgagtttaaatttttttaatttaggatattgtttcattaagattttatttatgttaaaaataattttcacaataatcacacatttcagaagaatatttgaaaaacaaaacaatcttgccttttcaatgttcttaactattttctgcattgcagtgttttcccccttcttttttaagtgggacattgtttttcctgacacagtggaaatgtaaattactttccctttttcactgttccatcatgtagacacaaaaaaacaaacctgtttgagagaccaagatgattaatgtctacagtgcatcaagtattcactacctgtgccattcatttcatttccactctactgtaaactgagaaacctttagttatttcgaaagtacattgccaactgagggaatacattctgagtaaatttcaagttccatcaggttttgcttaaaactctctgaggaggaaggcgagtagggaaagcagaggagagaagagaaaaagatggagaggagaggattgtttttccccatcttttatattttttattcttttttacatttccttttctgggctcctttccagcaccatattcacacaattcaataatttataacctaacataaatcagataccaaccacagttaaatgtgatttgttatatgtgtggatttctgtttatggtatctttattgagattttcagcaataagatgtaatatgtaatctctacctatttaaaagcttcctgctgtttgatcacaaaaatgatttgcgtctccttatctcagtggagagaatatttgatacaaggttgcctgccatgaagtctctgtggtgtagtgtgcctggtgaactgcctactctgcactggagcatacggcgtgtgccgtttctgtggaattagacgctatggctggtggctgataaatggcaatttaggtgtgaagggaattagcttaatataaactcagaatttcttcccccacccccaacagatggttcatatggtgatatcttctgaagagaatatagcctggccagtttgtttcccttaatataccagatgtgatagaagtagcaccaatttgggagtcagattccacaagttcaaatactggtaaccacacaattttgaatcataacctcaagggagatatagcacttttgactcctcattttcctcatctggaagtaaagaagtagtatctaattttcaaggttgggagaattaagtgagatacttataaagttctctagtgtaatgtccatcatagagtaggcattcaagaaaaaggaagtgttggaatcctgccatatatagaaagagaatgagagaaaacaccactttgtggtttcactggggctctgcaaacatgcctgtgggttttactttgttgtacagttctctggaaatcctgtgttgaaactacaacctggaggagtgtttgttttcatgcaatggcttaagtggtcacacctctatattaatgtgtgtctatcaataacaataatggcaataataataaataatacactctaacgaaaggctggaggagtaaaaatatttagtgggtgtttgtgtgaaaaagttatttgaggtctgcagttgcactgaaactacagtgagatgagtgagacccttacctcaggtaaaatctaagaggttgccaaaaaaactcagtgatcaagataaatgattttctaatgcagtatttttcaaaagagaaaattaatgcaagcatatctacaatggacaaatattactttttttaaaaagacgagattcaatgaggtatgattcaggtgagataaatgattcaggtgaggtgaatgattcagtagatttgattcagtagatcaaatcatggcacaactatgaggttcaatgaaggtgtgaataagtcagacagtgccttgttaggactttaagtgttggctgtgagatttttactgaaaagcagtttgatagaccttgctgaatgatttggaggtttgtactgatgacctttctcatcctgttgctttgtcaataatacatggtatcctagacttttgtgtgtgagttctgttcaccccaggccatagtaggagacataaatttgtgatgacagagtttgaagtacagtgctggcaagtttgcaataaagtatcaaatgtttaggcattctcaaattcaaggaaaatatcactctttgttttcaaaacagattaattgatggaaaaataataggatattttcctcatttagttattttctctgaaattatagttataaaaaattctgttagagatattttttcctgtttttaactcagtctggaaattagaaacatgataatgattttgtttggggtgaatttagcaaatttatagataggacataaatgattttgtaattaaataataggagctataatttataaatgcctactaaatgccaggcagtgaaccaagagttttcatccctatctgcttcaatactcagatgagcttcctaggatttgtcattttataggcaaagaaactgaaacttacagaaactgaattatgcaaaatcacccagttaataaatgacagaaccaagatttgaacccatgtttttctaatcatgatgtccatgcttagtgcattaagaccagagttagatgttgaacatttgtactttttgtttagagggaagtgtgtctacggaacatgaagtatcaggaagaaaatttacatcagtctcagagaagtttacctcctttgaagttttgggctgtgaaaattccagaaatagagaaatgagaataacctactataaactcagtggatagaatctaaccccttaagtataactcctggcctggggaagggagggtgacatggtggcatttgggtaaggcagaggcctgcagcttgccagctgcagaaagtctcatgagtcccatttgcaaccctcacattgcaacccttagccaaccagaggtatcccagggtatctgaagaaagcctccagttctgcagtcatcctgggaagtaattctggcccctgattatggcacactctctagtctcaacgacatgtatggaatgtggtgttaggtattccaacactttggctaataggaaattcatacagtagcaaaacatatgagaaactttattaaacaacaacaacaaaaaacccttgattgccaattcagaaggcacctgataccttttctgtggctcactgccacggttctcagtatcagtatcacgatgtgacagatgttcagccctgctgagtcatccagaattctgagggatgatggagatgcgagataaaccataacccaggatgtcaaatctggatggacaatctggacctcctcttatggtagttttgcaactgcatcgtggaaaaatgacactcaagggtgctgggggtgggggggagatatagtaaatgtgggcttcagcatctaccccattatccatcttagatgcttcactttcatggttctagaaataattttgaaaaaaaagtgtggctgctttgaaagacgagcttaaagaaatctctaatcaaatcctattccctcatcttactttcacaaaatctgatttccacagaggttctgtgccttgcctaaggcctcacatgggttactaagaatacggaaataggaacctagaccttctgacacctggcttcaggttctgtccttattttagcctgtgtctgtttgcacacctgttccaaggtggcccaactgcatggtcaccccttctcctcaaatcttacttgtatgtcatctgtgtggaatagcaaagcaatttctctgatgtagaaaaatatttttgagggtatggcaagatctcaacattaatttcaccccatgacctgtcacaatttgaatcaatccttccagaggtaaaatgcaggccatatttcatcagctgtcaggaggcagggggcatcagtggaagcatgtaaacaacattctggtttatattcctcatatagaggaaataatagaatgatcaagatttttttgttgttcacaatggtagtaaaatctttacagccctgcatttaatgacaggctggtatttctgaagccttacaacacaaactcacctagaattaaagactagggagaaaggaattcatgaacttgagctactgtgattattacccagaaaggctaattacatgtctaatgagcttgatacaggtgaaagatgtagtagaggttctctgctgctgggcctggtaagaggtctttggaaatgaaggtaattccaatatttttatggaagaagagtgggggagagggtgggtcaagaaagaaagaactgatggaactgatggtacttatagcaacatgatgtgctatgcagggtgttttggttttactcttttttattcaaacatacacacagcatttttggaagttaatggaagttgtgaataatatcttcaaaaatatttgcatatgtgtatatacattatgaacattttgagaatgagaaagggatttttagtgaccatagaaagtctcttcattgacttgtgggcattcctggatcacagcctaagagtcactgatacggcaaatggactctccctccggtgtactacctgtattcatgagggtttatattatacctgctaaaccattctcttctcttaagttcttcttgttttaataaaaagaaatcttcagattgttcataattataaaatataatgttttcttctgattatgattttcactgcatcatttgggtttctaagtacattttagggaaggggaatgcggctatgtgcaatgggcatttgataatcaaatctcctaatgtcagttgctttgggtaaggggaacccccagataatcccggaatagtttcaacctgtttcaatgcaggacttcccttcttcccaccttccctcctcaagcttctaataggcaactacatttactaggacaatttctatctcctttgctttgttcaacattagaatgaggcattaaagaataaagagatgcacccccctccctcccaaaaaaagcataagcaggaaaagaagacaactaaagagccacgataatccctgaggcacctcttgaattactcagttaaccataccaagtttatgctattcactcctgcagggctgttaaactacctgaaactagagtgagttggagctttgactgaggaagctgaacttgtctgagaaactcttatctctgaaagcacaaattgagcatcatttccttcaccttcccctgctcttgcacttagcaacttataaaagaaagaccagggccattagagaaagctgggtaactgtgcctttgcttgtcagccgtgtccagaggtgcacagcctgtggtgactaccttgaagccagttgccttggaggaaaactagtgatttaggcagggtagggtaaatgcctcttttccagacttaaaaggattgaatttctcagtatgaggttgataacaccagaccatctcatttttggcagtttgattgacaactttctcttcttgttgatctgtatgcatctagattaaaaatgtagtgatgatgccagtttatagatcattgtttcttgtgtttgtttgttttgcttatcattcatttcctttcatttcccccctattttttctatttttacaggaattgtcctggatagtaactgtcactgtggcgtctctttaattgatgacagctgagtacccaggctggggtttttaatcacttaatttgcaagagaggattacaccatgtttcccttccttttgcttaaacttaagaggttaagcaaaaggagaagggctgggggttttccattctctggcactggtgctagaaagcagaagcaggaaccaggtgtttgaaactcagggatgtatgccaaatgacactttaattgtcattaattaggttccattcatcagggactgttatttccatagtccttaaaattcagcatgttctccatcttcaagaggagttgggagaggacggagggaagcttcttgataaaacaacttttaatgctgtgtgcctgcaaagaaatgatgtctcttgcgacaattgaagtatgcattgttttggtctcctggaggccctgctgctgtaacactctaggaaggaaatatctttcttcagagagaaaatagaacgctacataaggtgttttcaagtgcttgatgattctgtgctgagagcaaagattgttgtctgttttcctacccacctcttgactgtaattgatctactttgctcagacttgggagtaatttaagaaaagacagagtttttaaaaatgatattcatagaagggtgatgtgctaaattaaatactaccttggatgggataatttaatgctgtaaccttgggtgaggctgcctccttaataattagtgaggagactggcttcataaatggtagcctgtaagggcattcatttccccttcaaagacatttagctcctgaacctgtgcttcctgcattaattagtcatcaactaaggaaaatgaggagaaagaaatggggaaatgttggccttcggttgcaaatatcttttccaaattctataaaacaagactagaattctttgaagaaagttgagatgacagataaatagattctctattttcactacttcctctttacttttaatctggaagatgttaatatggtgatttttaaaggatttccaaccactgctaaaacacatgcaaaaaacacatgtaacagcaattgggtcttcagaatcatacatctaatatgatggagctggtgacaggttattctaacagggaatggcactagaagcaacttatgggcagcttgacccatcttcatttgcagtgacacatatggaaaaattctaggtcctttgttttccttcaatatttagttgagtcaggaaaacaattgggtaaattgaattttatttaatttatatcctgtctcaagttcatgatgatgattaacctatgtaatcctcacaaatataagtttattttttttagtggatgagaaaactggaggagtacaaaattaaataatttgcccgaagtccacaactggtgtcagtggggacacaaaccaaggcagcatggctacaacttcatgcacctaaacagtataatatatactattaaatgtgtggacatgtataaaggacttagcacaggacctagaatgtattctgtgttatccgagtgtttgctgctgcttcttgttcttgctcttgtttgtctacctcttctcctctcccttttatttctaccttcttctttactttataataataattattgtcattttcattttgatagtgcagtataccatatcccagtttccattaatgaggtgctgcatttcttacctttttggtggtatttactcagaagttactaggaatctttttattcattattcaaagttgtttatatttttcatgtatttacagatttatgtattaaaaatgtttctgattttttttttcaattcagattcatcgtttaaggggtttccagatttaaagaaggatagcttgtttgtctctcaaacatgaccctgtgggtttttttcctttttactagtaaatcatctgtgatgtacctaatagagatgttatgaatcagaatgattttaccacataaagttgatatggtcaacatttaaaatgcaggaaagtagttaatagattagaaaagtttgattagtgatcttcagcagtagatgattgtcaaaagcaacttccttctcatccccattacctgagcctattctaactcttatatttgattttttactagggtcaggcctccctatgagtcccacttctaaggtgggtcctacttcactccctattagtcgcacctcacatcctttacccatggtgttttctttgaaaaacacaaaatgaaacaaaacaaaacaagtctatcttctccaaatcccatccagctcaacagtatctgcacctggggacttttcttctttttaatcaccattaatttagaggctcaccatgtcccaagcactatgcaaattctttacatacactggctaaatgaatcctcaaaatagtcctatgagctaggcgttattatttttatatatatgagaaatgcttttttcagctttaattagtcagttgaactttcacttattcaacaggggtttactgaacactggcttatgttatactctgtgggatgggttgctagaaatacagtactgagaaaaatagggtttctgcttctggggatggtggtagaagacatgaagctgtcgtgcagatgaatatgtttatgcttcagtaagttatttggatagaagctaagggagctgtggaagaatggcttttgaaaccaggtaggcaacatttcaggccttgatggctatatgatcttggtcaacttatctactgatttgccttagtagtagtaactatagtagtatctactactttgcctatgtagtcactgtaacaattgagggattaattaaaataaataaatcaaaatagaatgtgtagatgtaaatggaatttggggtggcagagttccattcatcaaactgcacatgtgtactgagcacatattagcacagtgctaattgctgttcaaaagttttgccttctcttttttatgggtcttttcctttcaggtctctaaaccaccacttattaatactttcccattgaagaaatatacttcccaccctgataacatcaagcttgcctaatgacttgctttggccaataaaatataagtagaagtaacttgtataatttctgataagaagctttaaagccattgcatagttcagctacctcctttttaaaaatctgtgccttgaagatagcgtgtccaaaatacagaccattccttatgtgtggatttcagagtgaagaggtttagagcacacttgcatccaatcttcatgagcacgtaaagtgaatgagaattatcattgtaaaaagcagagatgttgaggttgtttattactacagcatgactagcctaaaattatcgatgcataatcacaagagcagagagggagggtctctacgctcacccacttctgccacccccttaatgacacttgttcacatttgcctgtttcaggaagtctggatgagtgaagaagaaaattgggggctgtgttcctttggttacttacactgctctgtaatgcacgacctttgaccaagtctcttatacttgagagctagcatttcagcccaaagcataaaacagtggcatcaaatcctggtaaaggtaaaaattagtgagagaagtggggagctatgatgaaaaatcccaaactgatcttttatccttcaagaaaccgttgcaagttctgaaattgccatattaaattggaaaaaaaattctatcaactgtttcctcatcagttattatggaaaccgtcacatttttgtgtaataatgctagcctgcacattaggaaaaagaaacttctaagttgtagatagaagagacttttaggggtcacggaaatagagtccaatcagtcataaattcagcttttctcataaatctttacagcaactgttgtcatcaacggcatgtaccaaaattctctgaggaacatgacactcttctttgaatatttcttattactggtcccaaggagaaacagtttccactgtagcaattagcttaatgcactatttataatatgacttcaaaatataatctttcccaaccatttgagagaaaagccatcagctgtcacttcgatgaagagaaaggtgcaatattcaagtaaaagtacacatagaagatatcaagtatataaatttgaaatatgatagagaaattaattcatacggtttaggagaaatttgtctttcatgaagtacagatcatatcatgtcttttattcctgatacttatacaaagctcttttccactgccatgcatttgccatgctgttccaattatttttaatttctggtcacttattgacaatttgttataatcctatttttttattgcttgctgagttcatcttatctgcctctgtgttcccatattacacttgccatattaatacaatacttagaggtgcgtgtgggtgtgtgtgtgtgtacgtgtgtttgaatggatacaaaaacatattgcacacttggtccattcaagtgcatgttgaataaatcaatgaaatgcatgctattgaaaatgtagttattaagcttatctcaactttgtcgcataacaagtcattaagcctcatagtcttctacaaatgaaggtatatttgcaatattgcactactcacttaatagtacattaaatgagagaagacttaagttaaacatggtagattaaacaaatccacttacttttgcttcctaagtccccataaaaggaacaaaaatgatataaatgatagtaaaggagttgtaaaaatgatgtaaatgtacaaatatgaaaagaagaggaaaggaggtgatagtggctgaaaatggaaaatgcaaaacatgtcaataaatggaaactgacagtagattagagaaaaataaaagttaagtatctgcagagttactgagaaagaaacttggaaagacctgggaattggcaccataaaatacctccaaaaatgagatcaagtataggaacgaaaagaggaagacggcatgaaaatttctctgaagagtaattagactcccaggtcccctttcagacagaagctacatcttccctgtcatcagaagactggaggtttgctcttataaaaaattgtattagagtgggtccagatatggaagcaccagacacaacaaaaagcagggtgagagtatataaggaagtgtaagtgtaagacagtcttcaaaatggcagtatcccattccactcctttatttggcagtctggcacttttcaagagggtgattggaaaattcctccctgaggaaattgatgacttcaaaataaaagacccttaggtactagaatttgaatattcagcaacaaaataatcagtaaaggctacaagataaatgagacaaagcaatcaaaatggataaaagaaactcagaaaaagagagacaatgtagacagaagaaaatgccaaggaaaaggccgtagtatttgcagaaatgaaaacacattgtatttatgaaacaataacaggatgtcatgaaaagaagcattcaaaaaatacagaagaagatttgaagattagaaaaatatggtacacattagcatggtataaggtagtggaataggtagcaccaggaatctgcctcttcacctaaacaatgattacactggccaaatctttctgacgtaactattttgaaactctggagtctattccaaggcttgcagtgtccaggggaagccttgaacaataaaccacccttaattttagccaatttcagctcttatctggaggtagcaacccatcccctacccacctcaactctgtggcacatgcatgtgttcctggagcatattggatgaagcttgcaggagccatgctgggcaataaagatcctgtcctccagatatcagagatttgtgttcagattactatcgctgcttctgattttgcaggtagagatacaaaggcaggaagccattgttgtaagcccttctccaccaccccctcacgtccccaccccacagcattactgtaagctactccttctcccactaaaacaacttccaggagatttaaagagccagctttcacattgtgggagtcccacaagcagacgagagagaaaaaggagcagagagattatttaaagcaataatggccaaaaactccccaagtttgataaaagacatgaataaaactatatccacaaagcttaatgacctctaagtaagatgacctgacatacccaaactgagatacattataatcaaaccgtcaaaaccccaaaacaaagataatctggaaagcggcaagagagaagtgactcatcacatgtgaggaatcctcaacaagattatcagcagatttttcaccaaaactttggaggccattgtgtaggggcctgatatattcaaagtgctaaaagaaaaaaaagtaactgtcaaccaagaattcactgtctggaaaaaaccaaccttcataagtgaggaggaaattaagacatttacacatatgtgtgtgtgtgtgtgtgtgtgtgtgtgtacacacgcacgtgtatgtacacgtgcaagagagagagaagaagagagacaaagagagttcagtaccactagacctaccctgccctgcaggaaatcttaaaggaagtcttacatgatgaaataaaaatatactagaatgtaatgcaaaactccatgaagaaataaagatctcaataaaggtaaatatatgggcaattataaaagctagtattattgtaacaatttgtaactccattttttaattttacatgatttaagagactaatacataaaagaaaaactattataagctaaaaggtagtattataactttggttttagacataatacataattttattttacacaatttaagagactaatgaatttaacaagaacaattattagtatatttattaacacaatgcacaaagatgtaattgaaaaaagtgaggaggaagctgtaaataaaaaagtttttttatgttattggagtgaagctggtgtaaatttaactcagagtgctaaaagtttaggatgttaaatgtaatacttatagtaaccacaaagttgttgtagcatatacacaaaaagaaataagaagggaattaataccctaaactacaaaaagagtaactaaaacaaaacacagtaatatagaatatcagggacaaaaaaaattaaagtcatataggaaacaaataagagaatgaaagaaataagtcccttcttagcagtaattacattgaatgtaactagattaatctctccaatcaagagatagagatgggcagaatgggttttttaaacaaaacatgatccagctatgcactgtctacaagagactcattatagatccaaagataggttaaaagtgaaaatatggaaaaagatattccacgctcatagtaaaaaaaagtgaacatgggttgctatactaatataaaaaatagactctaagtttaaaaattttataaaaggtgcccaagcgcagtggctcacgcctgtaaacccagcactttgggaggccaaggtgggcggttcatgaggtcaagagatggagaccatcctcgccaacatggtgaaaccccatctccactaaaaatacaaaaaaaaaattagctgggtgtggtggtgtgcacctgtagtcccagctactcgggaggctgaggcaggagaatcgcttgaacccaggagatggaggttgcagtgagctgagattgcaccactgcattccagcctggcgacagagagagacttcataaaaaaaattataaaaggtaaagaaagatattatatgttaataaaagtttcaatataacatgaatatataataattacaaacatttaaacaataataaaaaacaaaaataaataaaacaaaagtgacagaattataagaagaaataggtatttctaaaatcatgattggagactttcataccccactctcagtaaaggataataccaccagaatgaagataagtaaggagagagacttgaataacacaataaacacattagacttaaaagacacgtgcacgacactttactcaacaacaaaagaatacacatttttctcaagtgcaaatgagatattctctaggatagaccatatattatgcccaaattaagtctcaacatttaaagagataaatgctatacagtgtatttttcccgtctacaacaggatgaagtcagaaatgaataccagaaggaaaactggaaaaattacaaattggtagaagataaacaggacgttttaaaataatcactggatcaaggaagaaatcacaagggagattagaaaatgcttagagatgaatgaaaacaaaagcataacacacccaaagttacagcatgtgctgaaagctagggggaaaatttagagctataaatttaatatttacacagaaaagtgcgaaagatctcaatccaacaacctaactttataacttcaggagctagaaagagtaactaaaccaaaggctagcaaaaggatgaaaataataaagattagagcaaaaataaaataaagaatagaaaagcaatagaaaaaatcaatgaaatcaaaagttgatttttcagaaagatcaacaaaattgacaaacatttagtaaattgactaagaaaaagatagagtaatcaaattactaaaatcagaattggaagtggggacattactaccaatttaatagaaataaagaggattataggagagtactgtatgccagcgggccaggcacggtgtctcacgcttgtaataccagcactttgggaggctgaggccggcggatcacttgaggtcaggagttcaagaccagcctggccaacatggtgaaaccccatctccactaaaaatacaagaattagccagatgtggtgtcaggcacctgttatcacagctacttgggaggctgaggcagaagaatcgcttgaacctgggagacagaggttgcagtgagctgagacctcaccactgaactccagcctgggcaacagagcaagactctatctcaaaaacaaacaaacaaaaaacagaaaacaaaaacaaaaaaatgagtacggtatgctatctaatttggtaatgaggacaaaatggacaattgctagaaacacaaaacttgcaaagactaaatcatgaagaattagaaaatctgaataaacctataacaaatgagatagaatcagtaatcaaaaatctcccaacaaagtaaagcactggacctgatggcttctctgatgaattctaccaaacatttacagaaataacatgacaaaatcaagcttttccaaaaaattgaaaagaagggataacttcttaacttgttctatgaggccaggagtactttgataccaaagccagaccaagccattacaagacaactacaaaccagtatcacttatgaatgttaatgcaaacatcctcaaaaaaatactagcaaaattaattcaaaagcctattaaaaggattatataacatgaccaagtgggatttattcctggaatacaagcatactacccaaagcaatctacggattcaaagcaaactcaatgactcaataaaatcccaatctacagattcaaagcaatcccaatgactcaacaaattcccaaagtcttttgttgcagaaagaaaagcctatcctaaaattcatatagaatttcaaggtactgtgaatagccaaaaaaaaatacagttccatacctaggtaggtatcaatcagttatgaaaatggttggaggctaatgttcttccccaaatgtcctcaaacctgtgactatattaccttccttagcaaaaataactttgaattaattcaggaccttgagatgagacagtttttctgaattatcagggtggacctaatgtaattttagggtcattataagtgagacacaagagcactggagtcagagaaaatgtgaacacagaagcaaaggtctgagtgatgcctttgctagaaagggtagtgaaccaaggaatgcaggcaggctttcaaagctggaaaaagcaaggaaaccaattgtgctatagagccccgagaagtatcacaggcctgccaatctattttagaattctgacctactgtaaggtgatagatttgtgttgtattaagtttgtagtaatttgctacaaaacaatagaaaactaatacaaagataaagatatttttgaggaacgttatttagagtttgtttgtgataatgttgggacatactagtagcagagaatttaaaaagaagtatcttcattttccaaacaagggagacaatagaaaatgttaaaaaattagaaaaatcaagaaacgagcagtataagaaagctgtttataaatgtggaggtaaatgccaagaaaatgtagctaaaagagtgaaatatgctggcttttagggactggaagtcagaagtgggaagatttgacatttttaaactctgtttatctattgtgtaggattagaaatacacaaaaagaaacaatgagattggagaggagaaaacccttttgtttactggtggaattcattcttccttttttaaatgattctactctataagtttttcactggacttgacacatattaatgttaaatatctgcttatgatattgtttcctgcactagtcccttagcttgacattcacagtacatgctcagtagcatgtggttggcacataatctactggggtttgttctgtgtctcattcatcattatatcccagaccctgatacaatacttgacatacaatatatagtggctgaataaatgaaattctggctgaaaaatgaatgaatgcataatcattattaggacttttatgagcatcataaatcacaggttaatttgagaaagaagatattttaaagactttcatgaaaagtgggtatttgaaatattcttgaggagacatactatgacaaatttcatatctctgcataggcacatacattctcttaccttcaaagcttcaatgtatattatgtaattatgcacacttttaagcaagctccttcctattgcattaggtaggttgattctacagctgaatcactgaattggttatctcagtcacaagtacaacatggtcaagacaaacatcaatagggtgtgtatcaggcagggtgcagtcagaaaaaaatgagctattgtaaatattatggtaataaggattttattataggaaattgatcttgtgcacgtatgggaggggcttggtcaatgaagatctggaagaggggtgtcagaagatccaagagaattacgacatagtccatctggagcactggcatggggtgaataatatggagcttatgggagaatctgaaattgcaagcacagaaggcttcaggagtggaactatgaagacgaagcctctagggtattcctgtgaaagctgttgcccccatgtaattaccacttcagtcagtccacagccaggcagctggtggtgcgtgggcctggagatgctgctgggcagtaggggcagcaggtggaaaacaaagtcagcatgaaacaggggagagtgaggacaagctgttaggcatctctgcattttttcatgtcgctatgtctcatcacaacagccttccaagaataagggttctgcatttctccaccttccaaatcttgcaaaacttcatttttgttttggcaactgtaacataaaacctaacagtaaaggggattctggactatgtaattctcaatctccatcaagttgatgtaacaaaatgtagcacagatgaggacagatgcacttctaacagggaaaggggaaagtctttgttgtatatttgctgaacaataatccagattttttacagcgaacttcaactttgaaaacttgggatattgctatctccctctaaacttcaatcatgaaaacctcagaactatttcactctaagggaatataacaattaaacatacatgaagatattcagctttctctgatatgtatagtaagtgctaaaaaatgttaaggctggacatggtggctcaaacctgtaatcctccaacacttagggagggagaggtgataagatagcttgaacccaggagtttgagacaccttgggcaacatagtgagaccccattctccacacacacaaacatacacacaaaaatgttggtttcttttcctgttgaatggcataattttataggtaaaagaaacccaagaagtaaaataggtcagtttctgactactgatctcagccactcctaacctaatagactttcagtcacacccaaaaactagtgccttgcagaaaaataaaagccactgcaacttcccagtaatgttctgaatacatagtttgcacaatactctgtgtgaggtgctctgtgagggatggcaggtttcactgatgagtctaacttggtttgtgctctcaagcagctgatcctgaagctgaatagacaaggctagtgtgtttgtgcctatgatcaaagacacactaaaagaaactgccccaaagttaaaataatatggatttttcagagaacacgtagggaatgtcaatcagctggctgtggacagattttctagttgaaacttatttaagagggaaggaagggagggttaatagagagctattaattatattctgaggtggagagagaacacaccaaggctaacatctgatggcctccattttcttagagttcttaagcagaataagcagagtgtggtcatctatgaaaagtaaaattaatcagcattagtacaaataattttctggaaaaggagtaaaacaaaagggttttctggtagccttcataactctgaaatcataaatttatttgagatagtgtcgataaagttattattgttacttttatttgagtaaaaggtttggatttggttattgactgatacacattccggggatattcatttcttccacttccctgcaactctcaatttattttttataaaatgtttcagattaatttgaaattattgtcttgctttactcaaaagaaaaacctcaacaaggttttcatttttatagcttatgacttagaatttgtttgtttgcttttctacaggaactataatgaccacctttcacaggtgacttgctgctgtttaggagaggcttggtgattatcatcagaaaagagccaaagaaggaagaaagagaattaaatgtgtctaattctcaaatgataaaatatagccctaaagctattaaagcacatgtattgttaggtgacctaggagttctggaaagtgtgaaaggcagcaacatcaagtgactttcttggttgtaataatctatggataatctaagaattatcacatcgaggtgtgcaggatccatttagcattgctaatggcattttgtatgtgggtagtaatggcctgatagccactttccttttgagcctccatattgcagtgtatgattcatagccaacacttgaggctttaaataatagaccttttcattttgattctctgatcctaaaattcctaatgacatagcatttttaaggcactaatgtgaattctacatttacattcacaggaaatgtttttaatttattcatgtaaaaaatggtttaatagtttgattgctttgttcactgaaatagtaattttaaaacacttgaaattaaactgaaaagtcaaaagtgttttaaaacatctctaagacaattatgtaaaactcatgggcttaaatattaaagtaacattgacaagttgggaggaatgaaatatgattcaaatgttttaactgattttcaatcaatcaagggcttgaacctgaatttcctattttagcttttaaactcattgggggcaaagtttgactttattaaaatctgtgtatgaatttggaagatattctattatagacagaagctatgttgggcaaaggggcttcaatcctgtcttggctgtaaacaccccaccttcaatgcagtgcatgacaaaaatatgacttggtatttcaagcaagtttgctgttccaaacccacacattctgagctgcatcagctttgaaattcaaatgccagatgatttggaaatcacttttgaggagaaaaatatattatggtgcattctcccttgcctggctggattgatgacaaagcctttacatatttacaggttaaaagaggcagtgagcaggaaagtcccttgtctataacataaattgacaaccttagtctctttgagatgtgggttcacaagagttcagagagcatttttttgccaggaacactaaaacctcagagggacatcagctctttaaaggcaggaaaggaccctagcacttatctactttaatcctttggtgtctctatgtaaaatggtataagaatagcctctaaatatcttagagggttgtggtgaagattaaataacaaagacaatttctatacggaacttgaaacatctcagatacttgttatatgttcacctctttcattcatttccacagatattagtcttcctttgtgtttagcagcaaataatgtgaatccataagcaagtacatggaaggccaaagatattaagctattggtattgcaaataaatgtaacacctgtctagctactctgtctgttaatctgacaacactcaatttacctttctaattaaaagcttacttaaaatctaccttttgatattttgtttgcacccctttggttattttatattttgacattttgaatatgttttaagttttatttattttggctaaagactctttctatatgattgtataatatatgtacaatttgtagcatcttctgaataacaaggatcctttgaaatcttataagcatcttttttctagtttatgtaaattggaaagctgagacactttagccattttatctaaaaatctctataccaaatctttaatttgttagtttagtttaatttttataattcagcactaagcaaactggctttagggaactattgtttgtttgtttgatgaagtgctcttgtaccacctcagatacgcatttaatcccctcaaatagaatcttggccttctgagatgtagtgcagggcctcttagatcataggaaatgattcgcagggtgagatggattcaccactcaggcttcaagcactttagacagccagaaatggtaagatagaaaacaccttgatctgtagcataatgcaacaggaatgttgcctaactccaggagtatgtttgtcccaactgcagcaatgtgttcgtatttgtgttttactaactgtcactatgtttttatgaccagccctcccctaccagaccaagcaactttagtatagctctcaaattcttttcatttctgtattctttataattatggtctagaatatagtagatattcaataaattttaaaacaagcaaatgattaggggaaaactgtacaaagaaaaaaaatctttgggtgacttcccaattcaaaacacgtctaacctaattttttgacattatggagctaatcatatcataatttatgatgatattgattcagaaggatgtttgagatacctgctttatttctgctgacatctacttggctgatttactcacttcctcccttctctcacttcatttatggtcccatttcaccttctcaaagaggtctgcactgatgatatatttaataactgtccctctacctcatcccagacacccacgatctgcaagacctttcctttattttcctttttacaaaaatccttttcctttccaaagttctatatcatctatttattgtcattattgtatactgattctctcttgctgtcagcttgtaaatttcactaaggtagatctgttaatttgttttgttcactaatatttcccaagtaccttgaataatgtctagcactttgtaggagctcaataaatgtttattgactatatgaatagaagacactcaaaagtcagctctaattgttaggtttctaagataggagttaaaattttgacattgtatgtagatttgccatgataaggttggaaagtaaggggtctagttttcacaaaattaatgtatccatacactaccattcagatctgctgcagttttcacagagttggaagtagtctccgtttgtgttggccccagtggttcatcccattccttgagtggccacgactgttttgctctttctcctttctgcctttaccattttgcttaacctgcttctacgcttttttttatgctcaactctgttgtgccttgtgctgttagctgtttctcaacaggagtaaagttaagcatgtatgtgcgctctgaattcaaactacttgagtttttatgttgaactcatctttactagctggatgtgtgattcagggctattttccttactgctctgcaactcaatgtactcagctagaaaattgggataatcttgcttcttctgtgtagaaatgtatgaatgaataagatcttatatgaggcaattataacagtgtatagcatatagcaaactctcaagattaaaatgaaagtcattttagttctggctcaagtggaccataaatttctttagagtaaggaccatccaggattcctttttttttctgtgtatcctagagaatataatagcacatactatacatatttactgattgattttttgacttttcagctgtttggtttgttttaatgacagtgaagacaaggtttttatgatgtccctaaagatagctatgaaaataaaaagcaaaatgaatatcacatactaagataatattagttcttattatactagcttttctttgtgaaacctgtagtgaaaatgcttgtcattattgggtcttcaagccattaatttattgattctccaccctaaacctcacaaaatttgactgaaatcctaacaaatgttaatgctcactagctaaaggaccccaggatacacttacagtcaaataaagttgagtttattacttcctgcaaaaagggatattgtacatttttgataatagtaggtactttgataagaaagttttggggtatggattgtcacgggattggatcttgtgttaagtgacctggggagattggaaggaaatagagatctattctgaatttggtaattttatgaggaagggataaatttatgaagtatcttaatatttgtttagttcacacataataattatacttatttatggtatatagagagatattttgatacatgtatacaatgtgtaatgatcaaatcagggtaattagcatatccatgatttcaaacattaatcatttgtgttgtgaacattcaaaattctgtcttctggctttttgaaaatatacactaaatgattgctaactgtattcagcctacagtggtacaacacactagaagttatttctcccatctagctgtaactttgcattcattaaccaacctctgcctatccttccctccctcttccctttcccagcctataatgaccataattttactctctgcttctatgaactcattcttttagctcccatatatgagtgagaacatgtgatgctaatctttccatacctgacttatctttccatgcctgacttatttcacttcatattaatattctctaggctcatccatattgccacaaatgacaggatttcattgttatggctaaatagtattccattgtgtatatatgccacattttctgtatccattcatctgctgatgggcatgtggggttattacgtaatggtggctattgtaaatagtgctgcaataaacatggggttgttggtatctctttgttataatgattttatttcctttggataaatacccagtattgggaatgctgggtcataggtagttttatttttagttttttgagaaatctacatgctgttttcaataatggctgtattaatttacatttgcaccaacagtgtgtatgagttcccttttctctgcaccgtcaacagtatacgttattttttgtgtttttgataacagccattctaactggggtatgatgagaccttattatggttttttgtttttattttggtgatgattagtgatgttgagcatgtttttatatgtctgatggaatttgtttttattttttgttgttgtttttgagacagagttacactcttgttgcccaggctggagtgcaatggcttgatctcggctcaccacaacctccacctcctaggttcaagtgattctcctgcctcagcctccgtagtagttgggattacatgcatgggccaccatgcccagctaattttgaacttttagtagagatggggtttctccatgttgatcaggctggtctcgaactcccggcctcaggtgacctgcccgcctcggcctcccaaagtgctgagattacagttgtgagccaccacgcccagcaggccatttgtatgtcttattttgaaacatgtttactcaaatcatttgcccattttttaatgggattatatggtctttgctgttgagacgtttgtggtccttgtatattctggatattaatctcttgtcaggttaagttttcaaatattttcttttattctacaggttgtgtcttcactctggtgattgttcctttgctatacaggagatttttttgattgatatagccccatttgcctatttttgtttttgttgcctgtacttctaaaatcttacccataaaatctgtaccaagaccaatgttctgaagcatttccttataattcttctagtaggttttatagtttcaggttttacatttaagtctttaattcatttttagttgatttttgcatatggtgagatatggggctctagtttcattgttcttgatgtggatattcagttttcctagctgcatttattgaacagggtgccctttacccaatatatattcttggtgtctttgtctaaaatcagatgattgttaatacatggatttatttctgggttctttattctgtttcattgatctatttttctatttttataataatactgcactgttttgtttactacagctttgtaatatactttgaagtcaggtagtgtgatgcctccaactttgttctttttgctcagcattgctttgactattgtcaagaaaccaaatgttttttggtcccatatgaattttaagattttttttctgctttcataaagaatgttattggtattttgatgggtattgcattgaatttgtagattgctttctgaaatatggttattttaataatattaactgtcctattccatttttttgtgtcctcttcaatttatttcatcaacattttgtagtttttattgcagaagtcttttacttccttggttacatttattcttagttattttaatttttgtagctgtatatttttgtatggaattttttaaaattatgcttttacctagttaattattggtgtatataaatactactaagatttgtgggttgattttctactctgtaactttaccgaatttgttgattacttctaagagggtttttttgtgggtttgtggggttttctatgtataagattatgtcatcagtaaagagggaattctgcttttccagtttccatgcactgtattttttttctctaggctattttctctggataggacttctggtcctatcttattcttatgataaataagagtggtgaaagtgggcattctatcttcttccagcaattagaggaaaggtttttttagcatttccacactcaggatgatactagttgtgggtttgtcatatatggattgtattgtgtttgtgcacattccttcagtagcactttgttgagttttttgtttgtttgtttgttttttaccatgaagagatgttagcttttattgttttttgttttttgttttttttttaccatgaagagatgttagcttttatcgttttttgttttttgttttttgtttttttttaccatgaagagatgttagcttttattgtatgctttttctgtatgaattgagatgattatatgatttttgttcttcattctgttgatgtgatgttcttcattctgttgatcacattattgatttgcataagttgaacccttcttgtattcttgggataaatcccatttgatcatggtgtattatatgttggtgtattgctgggtttggtttgctagtaatttgttgcatgttttgcatgtgttttcatcagaaatattggtctgtactttgtgtgtgtgtgtgtttgtgtgtgtgtgtatgtgtgtccatgtctgatgttggtataatggtaatgctggcttcatagaatgagttaagaaaaattcccttctcttcaatctttagaatagtataagaaaaattgtgttaattcattttttaaattttaatagaattcatagtaaagcaatcagtgccaggcatttctttttttaggagacttttattactgattcaatctcattatgtgttattggtaagttcagattttttctttctttctttcttatgtatttatttatttagacacggagtctcactctgttgccaggctagagtacagtggcatgatcctggctcactgcaacctctgcctcgggttcaagtgattctcctgcctcagcatcccaagtaggtgggactacaggtgtgcgccaccacgtccagctaatttttgtatttttggtagagatggggtttcaccatgttggtcaggatggtctcaaaatcttgacctcgtggtcagcccgcctcagcctcctgaagtgctgggattacaggcatgaaccactgtgctcagccttcttccttatttaatcttgttcagttacacatccaggaatatatatattccccataggttttctaatttgttggcatataggtgttcctaatagtctctaatgatcatttgtttttctatagtatcatttgtaatgtctcttatttcatttctgattttatttatttgggtcttctctctttttttcttagcttaactaatgatttgtcaaatttatcttttcaaaaacacaaattttcattttgtttatttttaaatatattttaagtatctatttagtttatttctgctctgatattcattatttttcctctacctattttgggtcagatttgttcttgcttttctggttccttgaggtgcattgctaggttatttgaaatctttcaacttttataaaatagacagttattgctattagtgctgctttttctgtgtcccattggttttggtatgttatgtttccatttttattgatttcaagaattttttttgcttcttaattttttcactgagccactagttgtttggaagcatattatttaatttccctttatttgcacagttttcagagttactctttcattgatttctagttttattccatgatgatctgagaaggtacttgatatgatttaaattttttaaaaattttaagtcttgttttatgacctaatatatggtctatcatgcataatattccatgtgctgatggaaagaatgtgtattctgtagcttttgggtaaaatgttctgcaaatatctgttaaggccttttgatctatagtgaagttttaattcaatatttcttggatgatttttcatctagatggtctgcccaatgatcaaagtggaatgttgaagtttctaactattgtattgggctctatctttctctttagttctaatgatatttgctttaaatatttatctgcatactccattcttcagttcatatatatttacagttgttatattctcttgctgaattgatcacattttcattgtataatgacttttttttgagatgaagtttcactcttgttacccaggctggagtgcaatggtgcgatctcggctcaccgcaacctccgcctcctgggttcaagtgattctcctgcctcagcctcttgagtagctggaattacaggcctgcaccaccacacctggctaattttgtatttttagtagagatggggtttctccatgttggtcactctggtctcgaactcccgacctcaattgatcccctcaccttggcctcccaaaatgctgggattacaggcatgggccactgtgcctggctgagcttcatctcttttcatgtttattgacatccagtttattttgtctgataaaattgttttttatgcatgattttgttttccatttgtatggtatatctctttctgtttcttccttttcagtctatacttacaagtgaagtgagtttcttgtaggcagcatatttgggtctttttttaaaatcagtttagctagtctatatcttttagttggaaaacttaaattatttgcattcaaggttgttagtgataggtgaaaagttacttctgtcctttcactagttggtttctgaagtgttttgtgtatgttttgttgctttatctcttaatgtttatttttctgatttgggtagtgagcaaaatttataaagttcgattcctttctctttcctatttgtgtatctaacagtgagttttatactttctgtgtgatttatgacggaaaatatcatcctttcaattccagatgcagattttcctttggcatttttctgtagtgccactctattgataataatttccctcagttttgctcatctggaatagagtttatttttcatttctgaaggatagctttactggtgcagtattcttacatgacagtttttttgtttgtttgtttctttgtttcagcactttgaatatattataccatcctctcctggtttctgctgaaaaatacattgttagtctgataggtattgttttctatgtgacttgatggccttcgttgctacttttttctctttgaatgttacagtttgaccgaactgtgactcagagagaactttttgttttgaaactacttggggattgttgagctttctgtatctgaatgtctatatctcttataggaattgggaaattttcaactgttatttcattaaataggttttttatgcctgttcacatttcttctccatcaaggactctcaaaatttgaatatttcttcacttgatcatattgcatatgtcatgcaggctttcttcatttctttatatagttattttttgtctgggttattttaaaatccctggctcaagttcagaatttctttcttctgcttgttttagactactggtaaggctgtcaattgtatttttattttcagacattgaattttacagttctgggatttctgtttttttctatgcctcaataattttgtgtgaggaagttatgactggttgatgcttccttttacttgttccactcaaatttttgttggtaacatcagtgataatgactggattcaaaggaagtcaaaaatgcatttttttgtcctaatataccataggcatgtgaggttgactcatgagaggcaagccacaatgggtgaaattaaaacttagaggtaatcccatcaggtaaagcttagagttgaggtaggacacagaccaaactgcaggtaatagaggtgtgacataaaaggtgaaggtgggtgtttgagaaaacaggaacaatccacaagcagaatactaggctatagacaagtcaactaaaaataactagacctaagagtcagagaaatactaggacacagaaacagaaagtcagtgaatatttacacaggtagtaagatgctaaccaaacttccagtcttcagttatacagatagaatccaaatcttggatgttataaagcacagagaaggacaagacagattttaatctagactgtacccagagaacaaggaaaatgcagggccaagaactgggtgagttggttctgggcattataaaatatttaatgtcttctgattatgcagaagcagattaatctcggatcactgactggaacagtgtctacagatgggagtcatatggcaagagcaaaggcaggtgaactggcttagagggtcaaggataataggtcaagctgtcactgtgatgacttgatcagcattaaatggattaaagcatacaaaattaattcatgacttcagagcctaggcttctgcttttgggatcatttcttactaatacagtgccttcctgtattagtaagtaatacagccaagtcaatgagcatcccagcttcacgccatgtttcaagtttagggttttagatgttgagtgtgatccgcatagagttttcatctatttaattctttaaggaagtacaaattttactagatcttatcttccttctggaatttacctgagaacactcattgatggccatttctagcaccatttttttccaaactcttactatattacattgcttagctgcctcactatctaccaactaataaaatatttagatcacaaagccagacattcttgcagataaagaaaataatgagaaatattacctgccttttgggagcttttattctaccaaggaaaggcatgactaaaataaaggagaataccataaaccatattatctactattacatacagaaaaaccaatatttggccaaggttaatacaaagttaattcatagaattccaggatcagggttctgaatcacaatcttaggcaactgaaaaaaagcttcttatagtagatttacctaaactaacacctgaggaatgaataggcactaactgagtaaagaaggtgattgggtcaatgctctaagttattttaaacatcagcctactttctgtctttattgtagtaagtaaacaaaagtaagttttttttttttgatgacttagggtcagagcaaataactcaaaggtggacttacatcatagcaacctaaaggtatttttattttagttagttaattaaagtatttatctgcatttaaaagtatttatttaggtgatgataaaagtaacacagcaatattttctgggtaaatttatattccgtgaagtcaggctcttgtcaattaaattttcactatatccaagaaagaaacaatgtcaaaataaatttagtgcaggcttatcaatcagtttagccaaggcattaatataacatcatagtgaagatgtactacctactgaaggagcgttgttagtgtctggaaaaaatgggtatgaaaacatttattaattcactggtgagatgtcttggaagctgaagaattcgtgtgctaagaaggaggcagtgacaatcagcacccagtgccacatagtcaaggagaatggggaggaataaaaggccttggtattgggtaggaacaaagatattaattccatttgtgagagtactttttgcagagtgctagaatgccatgattgcaaacctgcctgagaaaagtctgcaacttttatttattgcttatagaccagaattatattaaagacttttacctctaacaactacatttacctgagtatgttattgaatatctgtaaaacgtatgaaaagaaagaaatgtaggtgttatttatatttagttcacaattctacagagcctgctgtgtttttgcaaatgtttgaaactcctttattattaaacctctttaatcttacctcctacatctcaactactgggatcatttctgacaccaacacagaactggggctattctccagaacacaatttgattctccattccaaactttggctgtctttatttcttctatctcaaatgtcctccttgttttgcctttttaaaaagtgtcaacctttgacatcatttctatttataatattttttcaggataattctgaacagccatatattctttactctgaggctgtgacgtgtgtgtgtgtgtgtgtgtgtgtgtgtgtgtgtgtgtgtgtgtgtgtgtgttctatgatatggtatgttccgaactgtcttttgatgggttttatcttcccacttgtattgcacagttctattgtgtagggatcatggcttgtactactttgtacaatattttcacaatattctgtgctaatattatatgcataatcattaaaggctgtatgatattgtaacactttcattagaaagatctagattttaaacaaaactctcaagctatggttttctagctctaaaatgcaggtaaaggtacctgcttcttagggtggcaatgaaaaattgaaaaaaatgtatgttgagagtttgacactttaatttatttataaatgttaattatctttctttataaattgttgggttgataaggtctgacatcagtaggtagtatatcttcactatggtgttatattaaatgccttggctaaacagataatcctgtaccaaatttattttgaccttgtttctttcatggataaggtaaaaatttgattaacaagagcctgacttcatggaatatatatttacccaagaaatattgatatgttacttttatcatcctccagatagatacttttaaatgcagcaaaataacttaatcaaaataactaactaaaataaaaatacttataggttcctatgatgtaagtccacctttgagttctttactctgatcctaagtcatcaaaaaatattaacttttgtttatttagtacaatagagaaatatagtagactgatgtttaaaataatttacagcatttacctaatcaccttctttactcagttaatgcctattcatttctcaggtgtcagtttaggtaaatctattgttaagaagtagatttacctaagattagcaacctcagttgcctaagattgtgattcagaaccctgctcctggaattctatatatcaaccttgtgttaactttggccaaatattggtttgtgtgtatgttaaacggtagaaaatacggcttatggttacgtggtctctgttcatctcaaccactgttaattttccaccacctggcactgcaaattcttcagaggagacacccaagaaatacttgtggatctaaaggataggtcagcaggaaggaagccagactaaattaaccataattaaataataaattcaattattcaaggtagtttacttgtatcaagtatttcaattaaatttagggggcatttagatatagtcaataaaatattcaacatattaagttatttcacttatgttacttgagcacttcttatgtgcatggaactttgctaggttctgtagatgcagctcacattttcagagatatataataaaagtatgctgtcagcacaggaatgaaagagccactatctaatgaagactggaattggagctgaagcactacttaacaataatacagcaccattttggagagtttacctaagtgaggggcaaggccaaaagtgtaaacacaatgaatatgcatcatgacattaacaatttgagaccctgagatggaaattgggtgcaattagctttactattccttgtaaatggaaatgtttgctatctttccttttttttttttttttttttttttgcattcattctacattccctattttattccatgttttgctgctataacagaatactacatacagggtaatttacaaaaaaaggacatttatttggctcacagttctggaggctgagaagtccaagatccaagattgacgggacatatccagtgagggttttcttgctgtgtcttaacatagtaaaagagcaagcaagcttgtaggtcaaagggagaaaaaaaagttagaccaaactcatcgttttatgaggagcccaatttctgaataaccaaccattcctgtgattatggcaaattttcattcaggagggcagaactctcatgacctagtcaactcttgaagatcccacctctgttgcattgaggattagtttccaacacatgaactttaggtggatttatttaaaccatagcactttctttgtgtgcactgactataagttaagtagactggctaaggcttgaatgattttaaatttgtatattattgaatgagtgcaggatgtttagataaagagcttctggtgagaaaaaaaaataatatccataaaattgaggctactttgtctttgcttttatttttttttcaaaatggaaatgggagtttattgtttttattatttcctttaaaatggaagtaggttggctgttgggctcatgcctgtaatcccagcactttgcgatgctgaggcaggtggatcacctgaggtcaggagttcgagatcagcctgaccacttgggtgtggtggtatgtgtgcctgtagtcccagctactcgggaggctgagacaggagaattacttgaacccaggaggcagaggttgcagtaagacgagattacaccctgcactctactgcactctagcctggagacagagcgagactctgtctcaaagaaaaagaaaaaaaaaagaaaagtaggttaattttttttctgattataaaatatgctacagtttcattataaaacaataagatactattacattataagaaggaaaacaataatcactttttccactaactagagataattcaagttaacagtttatatatataactaagacattttctctctgtatgtatgtatacaaactcctctcaatattcttccagtgtgtatacattgacaccacattttaaaattaaaaatgagattatactctaaagagttttaacatttttcacttaacagggtattatgaatgtatattttagacaatagacctacatttgtcattatcctaggcagtgtctcactggtgaacacagaaggataattgggctgattaccactttaagaagaactgccatgatcaaataatgatcaaagatgaaatacatatatttcatctttgcacatttattgactattctcaggtacaatttctggaagtgaaattatttcttgatatgcacaagtttaagggtataattatacatagcaaaactgtttttctcaggatttatacttactgatattcctacccagcctgtttgaacacattatcaactttggatattagcattattttgagtctttgctaatagtacaattgaaattagattagaaattatttttcctggctataaaataatccatcttattgatttttttaaaacatttagtttttgtggatacatagtagggatatatacttacggggtatatggaatattttgattcagacatacaatgtgtgataatcacaccaggataaatggagtattcatcatctcaagcatttatcctttttgttacaaattatccaattatactcttctagttattttaaaatgtacaattattattgattatactcaccctgttgtgctatccagtactagctcttatttgttctttctattatctgtaccttttccctcccttcctgtcttccttttagtgtatgtgattttctctggtagtgtgttttaatttattgctttttaattttaggtatacattgtacatttttagatttgagattaccatgaggtttacaaataataccttataacccattattttaaactgatgacaacttaacactgattacataaagaaacaagcaaaaataaaactaataaatgtctatactttgtctccccattttttaacgtcttattgtttgtattcatatcttattgtactgtctatgtcttctacaaaaactgttctagttattattttataggttcatgtctttatcttttaacttaaaatattagtagtttacacaccacaatagcagtgttataatatcctgtgttttccctgtacttactgctataccagtgagttggttttttttgtttgttttgttttgttttttgtttttgttcttgtttttgtttttgtttttttgggtttttttgagatggaatttcgctcttgctgcccaggctggagtgcaatagcgtgatctcggctcaccacaacctccgcctcccaggttcaagcaattttcctgcttcagcctcccgagtagctgggattacaggcatgcaccaccatgcctggctaattttgtatttttagtatttttagtagatgtgtgttttctccatgttgaggctggtctcgaactcctgacctcaggtgatccacccaccttggcctctgaaagcactgggattataggcgtgagccacagcgcccggcctataccagtgagttctgtacctttaggtgatttcatattgcttattaatatccttttctttcagactgaagtactccctttagcatttcttgtaggacaggtctggtgttgctggtgttttcagcttttgctgtctggaaaacatttatttttccttcatgtttaaaggatatttttgcaggatatactattctaagataaaagtgtcttgttgttttcttcagcactttaaatatgttatgatactttctcctgaatagatttgggaatttctctgttattatctctttgaataaacattctacccctattaatctctctacttcatctttatgtccaatgactcttagatttgcccttttgagactattttctagatcttgtatacttttttctttttaattttttttctttagtctcctctgagtgtgtattttcaaacagcctgtcttcaagctaattctttcttctgcttgaccaattctgctattaagagactctgatgcattcttcagtatgttaattgcatttttcaactccagaatttctgcttgattttttaaaattatttcaatttatttgtttactttatatgattctgaatactttctctgtgttatcctgaatttctttgaatttcctcaaaacaggtattttgaattttctgtcagaaagttcacatatctctgtctctctgggatttttccctggtgccttattcagttcttttggtgaagttatgttttcctggaccattttatgctgtgtgtgttcatcagtgtctagtcatagaagagttaggtacttactgtagtcttcacagtctgggcttgttactacccatcctttttgggaaggcttttgaagtattcacaaggccttgggtattataatctaagttttttgtcaatgtagccatatctgcattagggatcaccccaagtccagtaatgctgtagttcttgtagactcacaaaggaaccacttagttctcttcccttactttctccccacaaaacagggtctgctgagctgactggagctgagttaggggtagccagcaccactgggacttcactgggtcatacctgaagccagcacagcactgggtcttgcccaaggctcactgtaaccactactgggctaccacctatgttggttcaaagccttggggctccacaatcagcacattgtgaggccagccagtcttgttccttcctttcagggtgatgagttctaccatgtcccagcttggtccagagatgccgtctgggagccagggcccagagtcagaaaccccagaattctacttgttgctctattctactgcgtttaagctgaccctgaaaccacaagacagagtttttcctattctttcctcctgtttacccaggcagaagtgtctcttcccatgtctgccaccaatacaggcccacaagtagtattggctgagtactgctgatgctcacttaagacccaagggctcttcagtcagcttatggtgaatactgctatgcctgggattcacccttcagagcagtgggctcccctctggcccagggaatgtccggaaatgtcatcccagagccaaggactggaattggggaaccctagagccccttttgctcttttccactgtggctgagctttttcctaagcttcaggacaaagtcccctttattcttccctcaccttttctcaagcagaaagggtttctctctgtagccactatagctgtgtatgtgctgagtcatacctgaagccagcatgtctcagaatctcactcaaggcccatagcatgtactacctggttacttctgctgattattcagggccatgggctcttaaatcagcaggtgatgaataatgccaggactgggtccacctggaatagggcctacacaactctgcccaatgccctatcctactgaggctgagctggtatccaaattgcaagacaaagtcgacttttctcttccctctcctctcctctagtagaaggaagagatctctttcagagctacgagttacattgcctgtggttgggggaagggtgatgcaagaaaaccccttagccaccctggcttgtgtcttacttgcctggcttgtatcttacttgggaggttgcataccccccaagtcctctggctgtgagtccattacaacactaggacttgcccaggagtttcagtccttgtggcctagacagcacatcaagtatatttaggaccccagagcactgtagcctgcagtgccagtgcttcccagttctgaccactgcaatgagcatttcttctttggctgggctaatctaaatgctctttccatgggtgccatctgagttctgcccagtgttggcagcactgaattctcacaatcgcttttctctccttctcccaaacgcacagattctctctgaaccacgtagccactgccagggagttgatgagtggaggcattagcaattcaaaactgtcttttctaccctcttcagtgcctctttcaacagtactaagttaaaatcaggtactgtgatttctcacttgctttttggttcttatgcaggtgtttttttgtgtgtgggtagttgtcaaatttggtgttcctgtggggaggactatcagtggagacttctattcagccatcttactgcaaccctctcctgatatcttactgatattaaaatttttttatgctactgctgattgcttttcctcatattttctttgtgttttcttcacattttgttctacccagtgattctgtatattttcaacttgctaactacgttaaaattatatcttaagagtttctcattaataaaattaatttttaattattaagtgctgcataatatagattaaatacaggtacaaagttcacctaagtaaacacacatgtggtgtacatatataatatttttagcactttggttaggtctaactgacatagaaaaactgtacccatttcaggtttacaatttgataagtttttatgtgggtatgcacccatgaaaccatcagcacaatcacgatgatgaaaatatcaagcaatcctaaaatttcctcatccatttttataatttgctcgcccactcttccctgtcacttccaaatgacaaacactgatttcctttttctcactacactattttatagtattatataaatggaatcttacaaagtatactcctattttatcagacatttttcatttagaataattattctagattgtatatgttttgcttctatcgatagcttattactttttaataccaaatagtattccattgtatggctatatcaatttgtcaaaatattcacctctaaatagacatttgttgtttccagtttttgtccattactaataaatctgctacgagtattaataactgtttatattgacatgtgcttttattccctctcttgggtacccagtagtgaaatggctacatcatgtatatggcaggtgaatatttaacttttaaaggagcttccaaactgttttcgaaattgattacactattttgcattcccaccagcagtgtatgagttccatttcctccttatctatgtcaacctggggtacagtcagtctttgtaattttagctgttctaagagatacctagtaagatctcattttttgtttgtggctgaaatctacacttttctaatggccaataatgtttgacattcttccatatgcttatttgccatccatatgtctaatattataaagttcctttgcaactcttctcattgttataaaaatggagttgttttctttttattgacttttgagaggttattatagattttgataaaattctgatatttgacatatgaaaatatctgcagattttgtagctttgtggcttgtctttttatttttaacagtttctttgaagagcagaagttttaattttgataaagctatttttattcttttatagattatgtttttgtgttgtatctaagaaatgtttgaccaatccacaatcatgatgagtttctccagtgttttgccttagaaattttagttttaggtttaatgtttaagtctatgattcattttgagttcatttttgcagctggggaaagatatagatcaaagatgttttattgttctgttgcatgtggctaccacttgttctaccaagatttgttgagaagaccaacctttctctattgaactgcctttgcacccttgtcaaacatcacttgtccctatataagtaaatctatttctggattattattttctgttgatctgtttgttcatctttaaactagtaccacatgagtgtatcacagtaggttgataaccttggaataaggtagagttagccctctttgtttttcttgttaaaaattatttcattcttttgaaagttatcaaaacaaattcctagcttgcctagttggtgacctgttaacactaatgaaaatggctagtaatgatgcagctttaggttacttctgaaagattagtagaaaagtagaaatttattgtcattttattattgttcattcatttttacaaaataaaattcatccttccaaataaactcttttaatctgatagcaaaactcagaaagaactgagccatctgtgtcattctcttttttattataatgtcattgtaatcactctggaaatatgtgtgggggattttcaataaattttctgcaaagtcttaaacagcggaaaacagacaacaaaacaatttaaaaggaaagccttctagaatcaggctgctgtagtgtattttgaaaatgtacacacagtttgaagactgatatttatagctgcagctagagttgtgatttatgctgctgaggtataacgttgtataattgatacgccatatgatgatactaattgcaatctggatgaaaattagaaatgatggaatcatgtcttagaaatcttaacaactttgaaagtacaatttaaaaatagaaaatatactgttgcacaaagttattgtacatacagatttcttcctgaaacatcaccacgttcatttgaaatgtatatgatgaatttggaagaaagccgaatctggacagacaggaaaggaagggtggaactgcatacagtatgactcacttctacctctattattgctaataaaatattttgaatagtccctttcttaacattaatataatatttttttctgtttttttaatgagtatatattgcttactgaaatgcatacattttattaaataactgcacatatatttttagaaagaaatggaggggcaggccgggtgcggtggctcacgcctgtaatcccagcactttgggaggccgaggcgggcggatcatgaggtcaggagatggagaccatcctggctaacacggtgaaaccccgtctctactaaaaatacaaaaaagccgggtgtgatggtgggcgcctgtagtcccagctactcaggaggctgaggcaggagaacggcgtgaacccggcaggctgagcttgcagtaagccgagatcgcgccgctgcactccagcctgggcgacagagatagactccgtctaaaaaaaaaaaaaaaaagaaaaaaaaaagaaaaaagaaaaagaaaaaagaaattgagaggcaaggacagaggagaggttttgtgccacacattgtgttaagcacttcattaggctcttctgatttaatcttttgaataacatagcagggctgatgtgttgtttgcagattatggacctgagactgggattggttcagcaattcagaaaactattaagtgttagatttagtctcagaactttacaattccaaaacctgggttttttcctggagacaattatccaaatatatggagtattataaaatacctggagccagattacaaggaggcttttcttctgaggctgcattcaaataattaatttcataatttcatttatgttcagtcccagaaagaaatgaaaaaggttcctgagaaatagaatcaggaatttacattttaaattatatttattaaatgtagactgattaatgtaatataatgattaaatgtagactgaaagagagtgacacatattttgatttaacctgacaaatgctaaaatgtttggaaccaatggaggcttcagagactgcttttcttccctatgaaataaaattattcttaaaagttacttaattacccaagtttggttggtcatggcgagacaatggtcaaagaactttgacttatttagcttaaacaggagggagggagggaagaagagatggaaggatgaacctgggaatctagtacatcattaaaattggaatggctttgtggtgtgtatgtgtgtttaagaaataaggcaacacaatcaaaatattgttttaaatttcgttcagtactagttttagacctgaactattctggggaacactttcgcagtctcacaaataatttagtgcctttaaattattttggcatatgaaagttaattattgtcagaaaagaaaagagaaggagagaggaaggaaacattgattgtggtacctgttatcttagagattttcacatataaaatctcacctcacaatatctctcaggtgagaaatttctttttttgaaagatgaaaaatatcaaagcatacaaactcattatcattcactgtctggtgtctaatgtcttgaaaagcatcctttcatgtattttgcccaggtgttttggttgtggtaggtgggtaaaacatgtcccattactttcttttgataagaagttgaagttttctattttttccctgaatgacttttgtagctatattctttcaaggagtttgttcacttgatcaatgttgtttaatttattgacatacagttttttattatattccctgattattcattttatgtgtctgaaatatgtagttgtaatctgtgtgctctttcttttcttcttataattctgtctagaagtttattaattttatggacattttcaagggagcagattttgaaatcattgatttttgtctattggttattcatttcctatattattgactgctaatcttatctttactatttccttcctacagtgtactttgtgtataagtttttcttctttttaaagctccttaaggtagtagcttagatcattgattaaaatatttcttttttactatattagcactcagtactataaattaccttttaatcactggtctcacaatatcccacagatgtttgtattttatatctttatttttatttaatttgaacaaattttataattttacttgtagctttctcttttattagtgaattatattgtaggatttaaaaatttcttaatatttggaaatattccagttatagttctatttttaattttcattttaatttgcttttgtcatagaacattctctgtatgatttaaatcatttaatatttactgaaaattgtttacatgcacctcaagaaaatttttggaggaagattttctaaatgtcaataaggatattttggtcaatagtgttgttcaagtcttccatattattgctcatttattttctacttgctctaacaactgctgatagaacagtcttaaaatatcctactataattgtagatttgtccatttcttctttaggttttatcagttattgcttcacatactttgaatctttgttatgtacatgtgcatttaggatttttatgacttctttattaattgacctctgataattatctaatacccattcctattccttgtcctgaagtctactttgatattactaaagttactctagccttactttcattactgtatgcatggtatatcttttcacatctagcctctctgctatttttagtatacattttatgtctccatatctttaaacttcgtgtctttgtatttacatggcttacttaaatggcatgtaattaggtcttgtttttttttcttttattccatctcacaatctaggccttttaattggaatggttaggctatttgcatttaataaaattatttatatagttgggtttaaatctaccttattgctgcttaaattttatttacaccatctgttcttcatttctttttcccttttttcccaccttctttagagttgtattttatgattccattttatcttcactattagcttgttagctataactcttttgtgttttctttcccttttttttttttttagattttgtgccagggtttacaatacacatctttagctacctacaaataacattaaactgttttagatttagtgtaagaacttgatcataggttcttttttttttattattatactttactttactttaagttttagggtacatgtgcacattgtgcaggttagttacatatgtatacatgtgccatgctggtgcgctgcacccactaacttgtcatctagcattaggtatatctcccaatgctatccttcccccctccccccaccccaccacagtccccagagggtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatatgccacattttcttaatccagtctatcattgttggacatttgggttggttccaagtctttgctattgtgaataatgccgcaataaacatacgtgtgcatgtggctttatagcagcatgatttataggttctttataaaacagtaaatttatctttcccccattctagcctctctgctgtttttctcatatatttcatttctccatatcttataaactctaacatatattattagttttattttaaatacaagattatcttttaaaagttaaaaatgaaaaagaatacatctcttagctagggctgctgtaacaaaataccatagactgagtggtttaaatgacagacatttatttgtcacaattctagaggctggaaagtccaagatcaagtttaaggcagatttgattactgtaaaggccccattcctcagctgcagcgggtttccttctttctgtgtcctcatatgatagagaaatagctctggtcattgttcctcttcttaaagggacactaatttcaccatggggtcttcaccttcgtgacatcatctaaacctagttacttcccaacaaccccatcttctaataccatcacaatgggagttaaggcttcaacacatgaatttgggagaacacagatatttagtccataacagtgtgttttgtatttactcacatatttactatttctagaactctttaatctttttgtcgtagatccaaatttattctgtgtgaagaacttccataaactttcagtgttctttaagtgtgttgatgactaattttcttagcttttgtttgcttgcaaaggtctttattacacatttcttatgaaaatatattctcactggatgtcaaattatagttttacagtttttctttcagtagtttaaaattttctctcacctttcttgtttaaatattttctatggagaatatcatagtcatttgatcacattttacataatgtgacttttttttatctggtggctatttccttttttttttcttttattctttttttttttttttttaatgagagagagagagacacggccttacctgtcatctaagctggagtgtgttggcatggtcatgactcactgcagccttgaactcctgggagcaagtgatcctcctgcttcagcctcccaagtagctgggactacaggtgcatgtcaccacacttggttaatttttaaaatgtttttgtatagacagagtttagctatgtttctcaggctggtcttgaactcctgggcttaagcaaccctcccaccttggcttcccaaagtttggaattataggcgaggacaaccatgcccagcaaactttttgagattattttgttaatccctggttttcatccattttgattaagatgtgctttgttagggttttctttatggtcttcctcttggaatttgttgagtttcttaggtatatgatgttatggttttgctcatctttggaaagatgccagccataatttagctattgtttcttcaaatgagttgttttttgacccccttttactttttcttttcttttcttactttcttctttcttttctttttttttttttaagttttgttttgtttttgaggtggagtctcgctttgtcgcccatgctggagtgcagtggcatgatctcggctcactacaacctctgcctcccaggtccagcatttctcctgtctcagcctcccgagtgagtagctgggactacaggcacgtgccaccaagcctggctaattatttgtattttttatacagacagggttttgccatgttggctagtctggtctcgaactcctggcctcaggtgatccacctgcctcagcctcccaaagtgctgggattacaggcgatgcctggcccttttactctttcttcttttgcttgggactcaaattatttgtatgttgtattgcttgatattattctatatgtttctgagacttcatttttccctctctttgcttcattgtggtcagattctattgctgtgtctgcactttcactgatctgtcatctgaactgcctaatttcctgcttgggttttcatccattacagagaatataagcagtatgctgtacaaaactgcacgatgtacttcctcatttctcatctcttagggatcactatcatacactgtctgttttctatagcctaaaacagttattttataaattgttggggattttattatttttttgtttagtgaaaaagtatttttttttggatggaatggaaatatttcctcagtagattttgataatagtttcattatattgatcttctgttataatttctaacattcatctttctcaacaaatatttattgagaatctattatgctaggctttaaagaacttgtcctcaaggagccagcctactatacagattaaaaaatactacgaaataaggcagggcttgtagcagaaatgttgaaagggtgcaggtggagaccaaagagaaacatggtggtaatttcaacagaaatatatgtgatgcagacagagatgaacaactattttccatgagatggtgtaaccagaccaaaaaagagaagtttataaatgaggtgttttttttctaagatacaaacacttttaatttgatatgttgatttcagaaagctgagataaattctatatcccttaagaaattccctggaaatacacacacacacacaccaccctgacataatacttccattaaaggtttggcaatatagctgaggaaaatgtgtaaataaataaatttaaagaagtcttctagaactgagtaggaagggatatgtaagtgttgaatttcaagcacagcagaaagaatggccagttctacctgagcaagcaggaaatcttgattagaatattgttcatgtttctgattctaaaaatttaatagttcttggctgggtgggttggtgaaatgtgtggtgttgatggaatattatgggaaaacaaaatgaaaagtcgtagagacatgagtcaggtttctgtgctttgtaatctagaagaaaagttaaatggaaagaattcagagtgttgtggagataagaggtgttgttagagataggactgaaaagtttgcaagaattttttgtgaggtattaaacattattttgtgagattttattgactgttcattaagaacagtgaggtaaatgcattacttctagatttctttctgaaacacaggcagagatagcagtgctcttcaccaaaattgtcaatactagagtagaaggcttggtgggtatggagtaaatttaatttcagaatttttaggcctttaattcctgagaatatccacttagagaaatccagtggacattttacataatttgctacggtttatggaagaagttgtactaaaatagagtttggagatttatcaaccacaggttgttgccaaagtcattaatgcagattaaataatccagaagaaatgtgagaaggaataaaagatggaatactaagtagccttggggaaaaaataaagaagactgagaaaaacaaaaagaaaattgtcataggagccaaagaaagtgagaatttctagaaatatttaacagtgatacatacataaaggtaatgtgtggaaaatgacaagaagaatctgctgggctttgtagttagaaggtcagaggtgacatttgataagtggcgaggtaaaagactaattgagatgacaataggaagatcaggtgatggagaccaaggccaaagactaatcactctccaggaaatctggctgtgaagagaagaaggataagatggtatccgaagagagacactgggagaaaattattgtttttagtaggtaaaacacttaaatatatttttagcctccttgtaagaaccagtagagagggaagagttgaaaatttagcaggaaatattgttaatgacagtgtagatatggtaagactatctctttcatacacagctagtgggtgtataaattggtataatctttctgaaaagcaatttgataatgtgtgtaaagagcctgaaaaatatagtgtttgaccctgtaagtctacatatagaattccaccctgtagatataatcagagatgtagataaagatttatgtacaaagataataatcacagaatcatttataataaggaaaaaaggaaacaatctttatgctgaacaaagaaggcacaattaaataaattatggtgtattcacagagtagtcacaaccattgtaaatgttattttcaaagaaagactttcaaattattggagaaaatgttcttgtaatatattttgagtgaaaaaatgagaaacaaaaaagctgaatgcagagtgtaatctaaatgttgaaaactaaaaaataaagatttaaagaaaagatacagaaattagtagaagaacattagaaaactgagcaatgcctcagccttgacttaagggttctagataactacagtgatcgaagggttagttttaggtgcagtatcatctctacctaaatgaatgaagaaatggaaggatatttgtagatatggggaaaggaatgaagagaatttttttctgttaaatgaacagcaaatccttcatcaccatcaccatcatcattttcaggaactcacaatattaatatttagagataattttgtgtcagtttttattccatgtttttaataatcacagtattttagataagcaaaccaaggcacagcaaagaagaaccatactcaaagttttacacactctagaaaatggtggatgtgagattcatacccaattcacagtccagtcgtgagccttctgctgagagaggagtggagcaacattgggaaggagggacttaaaatgtatagggtagtcactgtggggacattgaggggacttgaccagaaacaggatgaaagagttggtttaatggtactgagggtcttattaacattacttacttgtaggtccaccagttcacaaaaccatgtgctataaatgaagtaacctgccatggttcaggagaaaaaaagagagagggttacattaatgaaaagttacagtgtgttcactagcaaaaaaaaaaaaagtaggatttgaaaactttgaagatgttggcaataaatgaagctgaatggatctaagtttaatatggaacattgggtttttgttttatagggaggtgaagtaaaggataaaaaaaagaatagagggaggaactgcagtacttgctgggtcaggggcatagtgagaaggactgaattggaaagttgatacaatctgttgtcctggaagagattgaggactttgatgttatatatatggtcagatagtaagatgagctatctaaacatctgtgaaaaaatgaatgactaaatcattcctatgatgacagaaaccagaagcagaggaagactgtgaagcatgtttcaaattgcttagtagatgaaaatgaagatcttcttcatctagaaaatctctaaatgatgaaaatgtgaggtagaggagaggtggtaaagtgggatgacttcaacttcaaaggatgaaagggctttgtatgcagaccaatgaactaaagatctacaatcagcaaagggcacagggataatggccatggactttatgacattggagtatagagagaaggattttcttggagaagaagcaggttatattcttatgttcagaacattgtctgatgcacagttaatgctgaatgcccacttatctaacctcatagacaaataaaaggctttattaatgtggccagagcaggagatagagggattctgtgaagaggtggaggatgtgatgggataggggttgtttactttggaacataggttgcagagagtataatggaaagtatttgtaaagaagaccagaaatggacaaaagaacatgatgggaaaatgcacagaaaaaaaataaatggacaagcatcaggtaaatgtttgttgattggaagaactagtgttcagtccagtgaatgagagtgacaggaataaaggatatgactcataatgactatcctaaggtgccctgggacagagctaactaagccctaagcagtctgagaaccctagcaatgttaagagcctgcagccttttctcagcactcaaattgcaaaacatggaaaaagctttatgatgacttttgaagctaattctgccttggttattggaggtgattagctgccacttgccaaagaatcgttggcttgaggtagctatggtgccaggtttcttttctgacatgaattgggtataataaagcagcttggtgtgggggaactactcttaaatagtactccttataaatgcgagagcattgattttaagaataaactggggataaatttggctattttctccaattcttagccctccatggtgtagaggtaggcatctggttgctagaatcctaaagtctcaagttctgtaactagcctatttctattttctgctccaataacttagtaaggccattgaggtggtacaccgtctcttcattagcttgcatgtcagtgagatgtatataaaaatctgaaaatatatattagttctgaggcaaataggtgaacgagataaatcactggggaaaggaaacacccctagctccctcacattgtgattggggtaatataattttctacaggaagaattattgacatgtagtgaaatgtgagatcaatatctgttatttactgaataaatttactagagtcattggtaaacatcttcagtaataaattccccaaattcttggatggatttgtgttttaattaacattcttagctggaaattagaggcagatgggaaggggtgttaataattccataattgataacaatcacttatgaaacagagaagcaactcatagctcactaattatttcagagagtaaaacactccaaattgttaggagaagcgctcagtgatacaagaagtcagtgaatgaggactgggtagaggcaacagccctgggtttgaattttggacccaccacttattagtagtttctaccttgtttctacctcaaggagcagggacaacctattttataagaaaggttctgagcagttcgatattaagaaatcattttgattgactttaacctagcatttcctaacatgctttatgccaggtctttctcccctataaaaaatattaatcccttaagaaattagagtgctgtagaaaactttaggaaacattaacagaaggtctccaaattcccctcccattgttggtcggtcagaattagcaatagcagctgatttttattaagtgctcactatgagttaagttctgtactatagactttaactataaaatctcccttaattcttacaacaactttgaaggccagtattatcatcaacaccattttgaagttaaggaaatgaaggcacagagagtttaagcatcttgcctaagctcacaaggctaagaagcagtggaagatgctgtaaagacaggcagtctggctccacagccagtttctgtagtcacaatgctaactattctagggtttaatcagctagtgtggttcagtgaataccaaatggaaagtaaagacctggaaactacaaaacagcccccatggagtggcatattccaaaggtccaggagccaatgtggaagccagggaatagagttaggaaaccaaagaagcagagccaaatgcaagagcagtgatccgaaaataaactgggagaagtctgaagcatttttctagactgctggatactgtctgtggcttgcttttatctctcattcatggtcttgtgtgtaggtaagcctgctgagtttaaaagaccaataataggatggaccttttggtttaaatgggaaattttcattaaatcaagacatggaaatctattcaaactgtagtctcatacaactagaattaaataaagaagagcatactaggccaaataaatataactaggaaggcagcagacattgctacatttcatttgaaattttaaaattcttatatgtcaagggatatactaactacttcatcatggataccaatgggcagtgcttgctccttagcttagcccaagtagcttttaaatgcaatgtcctattttagcaggatttatggttttgggagtttaaggtaggatggttaaaatagattgttttctttcccccctctacaatgtggcattttctttagggttaagaagtctcccctattgggaggtgggaaccatatgatgttaagcaatgggtttatattttattaaacagaggaaactgtattatctagagaggatatttggatgggaaggcaagccactgtgaaatccatcaccccattttttctccagggttgatttactggcctcatacaggtttctctttgaacccttgttcatcctgcagctccaggatatgggtttctcagtcggaggtgatgacttctgagagtcaaggaggtctattttgctcacaggtttccaagagtctaacgtagaaaaataagcaattgtgcatatttcctgagtccaaaacttgttcaaattttgagtagtctgctggatgcctctcctcttctcctatctccatagaaaaataaattctcaaaagttgccagaagcacctgtgtttgactgtaatggcagtttggataccatttaagcaggacttgtcaaggcaaaaggaacaccaagaaaaaaatgtggccaggaaagcatcgtagtttcaaaataggttccttgaaatattcattaagaataaatttgctgaatcattctctaaaacctatcaaaaatacctaaattttaccacagagactggatccaggagcctctcctctgtcttctgagttatggtgtctctatccagtggtgagactagattagcaatatgccaaaagaggaaaatctgttctcttgtctgggtgattgttggctcccacctccagcactttgtaaaattagagaggtgagctgtcttagatctagtttaaagtatctggtggtgtttggagagttggccatctgatggtttcaatttaaatgaatttatttgtgcaaattaatattcgaccatattgaactatagcctcacctcaggctgcctcatcaatcagggtcaaagaatatgcagatgattgtgggaccactcaatctgtgtttctcagctctagactccttatttaaatctaaaagtatatttgctgttcttcagggactgaattcctagctcatggacaactttgcaaaggttccttgtttccaaaccagatttgtcttctctctgtagtttgacagagtatcccctaataagatttctgcattcctaagctaaaggataagaactacatctgtcactgagagggtacctaatcaagacctcatctggtgtatctggttacctgttttatctattgctgtataacaaaccactcactacttagtggcataagacaatgaccctagaattacgttcacagctcttcgggtaaagaattcagacaaggccaactagaggtggcttgtctcttttccatgagatctagggactcagatggaaagactccagctggaagactctaacctggatgtgacttgaatggctgaagctggaatcctcggaagacttttttactaacacatctgaaaactgggctgggatgatttaagcgctgggctcagctgacactctggaacagagcaaatatccatggtatcctcatgtcatttgggcttcctcaaagcatggtcgcctaagggtatttgaatttattacctggtgggcagggctccaaattcaaatgttccagtgaacaaggtggaagctgtgtggcctttatgacctagctttggaaatcaaatatactcacttctaaccatatttaaacggtcaatgtggtcacagcctgcccagactcaatagtggataaaatatactcccctctttttctggaaagtgtcaaaaaattgtggctatgtttttaaactgccacatttactaacacatttcacaaagtaattaaactacctttttaacaggtcccaatatgtttccaaatatatattgcttctttagtacaatctactttttacttagacaactattctatgaatatgtccgtggcaaaaaaaaaaaaaaaaaaattcagagtaatagcatagagccagttgaggaggctcaggaaataacagtctgtagttattcttttctttggacacaaaatgacattactgagtttcattatctatcttgatcacttaaattctgtgggaaataaatttcatgaggaaaaaatagtttttttgtatctaaaaatgttcaccacaaaatgttggggaccactggaccactttataaaagattattaaatatggatgttgaggctggctgcattgagaccctgccaagtcccatgttaagctagttgtgtccctttaactactagagtggtttcaccatgacctaagttcttcatagacttgcaaaatctgaaattcattattagtcaccatactcttttagtgatgagatcacattagtatcaggagactaatgtataaaccagacaccagtttaataatttatatgaagaaatatgacgttttagaaatactgccattcactggccttcacagtcattttctggaagcactctgctgaaaaagcagataatacttagaaagctatttggtaaatattgcacaaaactttgaaaggcaggtatgatgttatcttgtatacccaatgcctagtagagagtctgatacaatgaggctcccagtaaatgtttggtgagtacacgaaggaataccttggaaagagaccttagggaggatgtaatctgatggtattcaaatatccttaagattcttgaggaggtgatataggggccatcacagaaagcagtgggcaggaagaagcaggggccctagagttgctctccttttatctatttcagatattagactcttaataatatttaaattgggaaaggaattatgatacaaagtattggcagctaaaaataaattatgagctttgcacaaagtcacccaattagtaagagactaacctagaactcaaataggaagcttcttgttttcagctctgggctctttttactatgcaacctgctaataattcactgggagcttggcccctaatttggtgtgaagttctctaatctatttcctgacaatagcatttggcatctttccagaatttactatagcattttcattttctttctgagaagcaacacatggcatatcaatcgtcaccttataaaattctttctgccctagtttttttctctttctctcagaccctcattcattcacctttttaaaaattattattccttgggcaacctcacagacaagttattttctgaagagaaaaggaccaaggaggatgtagtggataagtacacaataaaatccaggcaaaagctcattctaaaacacattttcctgaaagcattgttatcactgctattgttcataccattccattcattcccttgagctgccatctcctgctgatgctttaaagaggtcagaataaccctggtaacttacttgaacattaaaaaaatctaagccatagcaccagagaagtatttcttatgcgtcttcagctggctgtgcaattgaccttgccttgaagctatacacactacctttctaactgcagtcaactgtagggatccaagacatgaagagagccagagatgcaaagcgctcttagaatcctgaaacatagccttctcattttatacatgaaggaactgaaacctagagagggggaggaatttgctgaaggccacatagctaattagtggcagagaattgtgtctcctgactccaagtttaagactctattagcaatagccgacttatttttccttccagcacaatgcattgccctctacctgaagccctggtgacagggcagtctttcagcattgcggaggactagtgaggtctggcgactagacatggcaccctactagctggattcataagggataggtctagagggacatacaggtcgagtgggcatcagtcaggacaaggaaacagctaccagcacaaggagcagagttctctggctaagccagcagtctgtcactccaactctttcttgtgacagatgactggggcattagcagtgtgctcacccagagagaaacaaggtgggagcagatggtaggaagtgcaaacaggtatttccattgtgctcagtggaaagagatgagcaatgaatcctactctggagcaatagttttaaaactttttttaaaaaatagcaaaagcttttatttttccagacaaaatcttgcctgggaccccagtgcataaaatggataaaagcagagtgcctcttgttgaatttgagtatagaataaaatgttctctgaggctccaatcaacagagtttgggtactaatgacagcaggagaacctcccactaggagaagttttggaaagctatggttgtagtgactagtgggggtacaattgtcatttagtggacagtggccagggatgtcaggtatgctgcaatgtgaaggatggtcctagatgcctagatgttgaagacttgtcccgtatctcatatgacggatatgaatatctccccagacattcatgtcagtgaaaaagaaatttgtaaaaatctgagtctagaacccaactctattttatatgtgacatggagtattaatttcacagttttgatatacactgtattttccagacatgcaacaactgggataattgaaggaagagtagactttggttattgttgttgttaggagcttcatcaggacttgtttaccaagagagagaacaaaaaggttaaaagcaaggattctggagtcaggcagcctggctttgaattgcagatcccatacttactaactgtgtatgacttaagacaaggtactcagccactctgtgtctcagtttcctcagctgtaaattggagatagcaatagtacctatctcaaaattttatgggaactcaatgagtcaataatgttttacctaggaaaattatacactgctgacagtgctacttgtgttatttgtggctctaatacaattatatatttattgtcctgcagttgcaggagttgcattcctggtcattacaatatagacatggaagtgcatatttatgtctttaaaaatatcaactgtaagaaaaagtgttggcactatgtcagtttaatgttgtcctattgacttaaatctaaacttgccaagggtaagaatctaactgctttattatgtttttttaaggtagccatgctcagccttttacatactgagtatgcattattttaatataaattcatttccttatatagtttatatttaaggtttatgatgatttttcaagattatgtatataggaagtttatattaaaatgttgtttcagggtgctaaagaaggtattacaaagtgctcgtaacagggagcatggggtgtgattagatggtgaaccgctgcaataggtgaatgagaatcccttggaactcctgaatttgtgggtgatgaaagcatagttgctctgggaaaagctgagaagaaacaagaattttctacaacctactctatttttctctaagaccccttgcaagctttagggcttcagtaaatatggctttgggactgagattctcaaaatatatctgaaccccctcagtgagcttcttagtagactaagaataaaatgactaacaatggaaatattctcagttgcataaaaggccatttgtaattaatgtattaaaatattaaggattactaatatctggcattttaattataaaattcaccaattctcttcaagtttattgaagattcagtttattattccacaggatattttgctaccatcaatggtctggccatgttgaaaaactcagctgacacagacaaaattcttagaatttattcttagaatttggggaaaggatgctttgttacccaaacattaaaagtgttttaagttgcttatggcttttaattactgttattttctattcttaattatgcatccttagttatattaatatcagttttgtttcttgtgcgattgttttctgcctaacgttatgtaatgattctcatttttaatagtattattttgagccaataagttggcaataaaaagactttaaaattattgcattcccattacagtgtgaattatctgtacctctattgttaaaaaaaggtatgagcatgccttgcccaatctccaatttgcttctacagtggcaaatttttgtttgtcatttcaataacaagttattatctgactggaaagtgaaaaaaaatgaagtgggttaggtagaacctatgaccatacctaaagggatcaagattgataaaattcgaaagccctctttagctcagaagttacacctgggaagtggatggggtgtagaggagccaggagccatgatgccttgtaggtaagataaaggaggcatatgttcacccagagacaggttctttattgcctttcatctgaaagcaggtttgcagaacacagtagacaggccacacttaagaatgagccaaggttctcctgaggaactctgcctagcatgacagggaagaggcgagtcagatctgaaatagtgctactctgcctttagacacttgagatatttttctgttggaaattctgggtgttttttttgtttgttttttgttttgttttgttttgttttgccagattcaattcatccatgagcaagaagaacagacatatccttgaaatgccaaggacctctatcctaatagagataggaagacagatccatcagattatttttaaaaatatgaaaatttcaggggcctgcctactttctatgaaaacacatgcatttgtttttcaggactaacataacatctaagtagagtaggacgactgaaagaccaaatcccttgcaatcacaagaccattctagttttgagggacttttttgttttgttttgcttctctggtggattttgtatgagccctagaagtgaataagactgggctgatctccacttgcaagaaaaagtcttgcaggagtacccatccccacctaaacagaaagttctatagcctcagtggaaaattgctcttgggttttcttccagccttagaatttcataatttcaggggaagtcagagagatttttactagcccagttctgctctctataattgtctttgccatagctctttgcagttttggacatagcctatcaaaatggacttccttttttcttctccttcacttgcatttaattaaactcattgaattaataggaattaaagaccatctatatgccacaaattttgctaagtttagggaggcaaagataaggaatgtgatttcaaattgctcaaagtccaggaaaaggtataggcaaatgcaacaatggtgataattcaatagaagcgtattatgtttgagataagcaagggatgctatggagtcgagggtggtgggttgtagtatcttgaatccacaacattgtacaagtataagtagcactacgtgtttagaaagagattaaatctctatttgtgtactttcagattgctagctttttccccttgttaaattggattgggacacaccaaatgcaaatgttactgctgatgacacttactattttttctttggattctttctctgaaaagtataatgaagaatgaaacttgattaatgatatccaagcttcaatagtaattaacaattactctatgccaggtacttatatatgtagttttctttatgaactcatttaattcttaccactaccttacgaggtgtaggtattctcaaagaattgaggtaaagatatatgcagaaacatgatcaaggttgcaaaattggtacaaagtaatcatgctaagagctcaaactttcttcagaaaatgtatctaaaattcaaatacttttctaattaaaaacatcaatggctccctttgcttagactcgagagagcaaagtctgatatccttagtgtaacattttaggttctctatgatctggtccttacctcttatccaatatcatttcttgccttctcttaccttaaatttgtatttcaccattcaaacatgtttcccaatatactttttcaaaacatttttgtcttcatcattttaaatgcctgatatgtacatgttcccctgctctttgcaaacttagctccaacattaatcacctcttctagaacatttccctgatagctccaagccactgatggtgcctcttctgtatgttcacttggtagtctgtgcatatctgcaaccagagcttaccacattgcactgacattcatgtgtttctctcctgtattaagctgtgaacacctcaaggacagaagccatgccttagtcatcttgatattgccagcatctagcagagtagaacctcaggacatatttgctgcaagttcctgattcataggatgcactgtgcagcagtttggaactcagttctagagctcaggtcctgcactagcatttactgccatgtcctctggacaaaggatttaaactctctgagaatcaattttctcatttgtaaaatggtaaaaatagtggtatcttcaccatggttgttgggtaaacacaacaatggatataaaatagttaataagctattttttacataatagtcacttataaatattgtcatcaatccttatcatcatattttgaaagcattatactcaatccttttaagaccacagcatgtctgcttaaggctgcaaaagccttcaaaggacttctttccagatttatccctttgccattttttagggtttgtcaatccttgtggtcataaaacgacaagaagaaatggtcccatacatgaatcatattgttttccactcactcttttgccctcttttcagcagtctttctctatttggaaaaaaaaataggcttggaaataaagtgaggaggttaagaaaaagtagcttggaggatgggaataaaatttagcccaagataaaattattaggcttgccacattttctgtcttgaccactagaacatgctttaataaaactatttagaaatatgttcttttctgattcatcctaacaagccatcttttctagctgatgaactggaaatttttgtaaataaatgtcagcagcatgatattttctttaaatgatagagactttaaataactgaaaatagtttcaaagattaagtgaattatataacaatataattataaaagctaacatttattgtttgtttactgtgataagcactttaaatttcttaccccatttagtaattataacaattcagtgatgaagtagtgccacttctatttccattaaagaaatgaagaaagtaaggcttggagagtttaggacttgtccaaggtcaaaagacataaagatgcaaacatgagatactaaataagttctgttgactcctaagttcatgctctttatcaattcactgaacaaatacatgcacatacagacatgcttattatgcatacatgcatgcatacacatgtgaaaagccagtatattttggcttctaattgtgtacagaaagctgcaactgatatataaaaatgaaattatttgtttcacattacatattgactctgatcaacaaataaaaaagaaacaaggtacagtacattattttagcctgtttctgaagatcatgaagttcaattgagttcaatttcaggagggactttagtattagagtcaatatggagcaagaatggcatttttctttttcctggtgacctttgagctgtctaagctcccagaagaaagacacaagatttgctttctgttttgttttgtttgtttgtttgtttgtttgtttgttttaaacttctctacccagctgtggctcactgttcagcaaatacctccagtctctggaaaaattaaattcattcttcttttctaatgagcaaaccctcctctgcctccagctcagttcatcatttgtttgattgtacatccagatacccgagatgctgtttgcttgctttctcttaacctgagttgttgaactttaaagatttggagcactacaacattattttaactcatgccactaagcacattactcattctattgttattgagtcatgaatcactccctggcctttacccgctaccaggtttgcagttaactactgagagcatgttctaagatgcctcttggaaaataaaacctttttctacttgttacgtgtcttgttatctcattatgctgagggagaaagaaggattagtctaatatttgaatcaaatcaagtaggctagtatgaaaatactaattagggagcaattcctagaaaaaaactacatacttatttttttcttttctttccttggccagcctgggaaatctatgctgttgatatctgctgagatgacacaagtgtctaggtagaaacaatcaaataggaaatgttcctaataattcactcactcgtccccttccctccccttgccttcccttcccttccctttccttcccttcctcttctttccttccttctttccttctatttaagccatctatgtgattatcagttattggatgcctaccataggtaaaacattatttaaagtgcccagatttagagaatggagacacaaagattaatcatacctagtctctacctcaagctatttttataatattaggggagagaaaacaggaaagtaggaactaaaatccaaggtgggaagtgctcagtgctataaaagatgcacagataagcctatagaagatcagaaaatatattcttcctgctagagaatcagggaagcttcatgactgtagcagcatttgtactccacctttaaaaagataggagtgttggaggggtgagggcaacattccaggtagaagaatgcagaggcaaataaagatgagaaatcttgtgtttctgtcatttcctttatttcctctacaagcctctggatctctaggccagcaacccttaaacctcttgagattcttttttcatctattttcccaaatcaaactcatttgttctgtattgaatggatcttaaccaccatctaggtgaacaactggccaatctattgatttgtccacacacaaaaatgtcattcttatattatttcattcatttaagattacctgttcatattttaacgaggagtttctaagaagtgaccctaattctacacagacaatttcaatgatgagggcacctgtttttgtttgagggaaggaagggatacttcaaatattccctcagaacagagataactgtccccatagctaacttggcattcccttagtgaaatgttactgggcacaataaaatctaggtaggatcaagctattgtgggcaagataatttgtatgcgatcagttcagttttttggaagatgaataatataggaggaaattctaaggcttacgtgggacaccccgtagtatattgcaatattggagtcacaccagggaattgcataactccactacctctctgtgttaaagagaacaaaatatccgttaaaatttccacaagtctttaggttccaacagattcatgcttcaaggtgtctgttcagataatctaaaataatgtactactttaccataagaggaataagagaaggaaaagttaatatttcctaagtactgttacgtacgaggtactatttctaagatatttctcctgcacaaaactgtcttctggtttatcatttcactgacactaagatgtgatctcaatctgggcctatgagattctgcataatctgacctctgcttgctttcctctttcccctcatctcctgtgactgtcctcattccttaaattattttactcacattaactttctttacttaaaataacacctttattccttcctcaaagtttttggatttcccgtattttctgattggggaattcatcccccagagagccctgtggttctcactctcttttaatagagtcttcactcagagagcccttcccttattacctggtttaatgtagatctcccaccactgattttagctgtctgtgttccctttataagataaaaatcaagagaacagggacttttatcttgcttgctgctgaattcccaaagccaagaacaatattcagcacatagtaggcatttaataaatatttattaaaatagaggaaaatattgttatctccattttacagaggagcatattatattcaagagaggttgaaaatttatgcaaggttgccagtctaataactgaagcagctgaggatttgtacccctgtccctttcactgcaccaaaattactttgaagagcatgctctagtaaatgcttcccttgtattgtagagagttttacataagcacaatctttttttccacaatgcctctgttataattaggtatttgtttttctcacttcccatttcagtaaaacctaatctgtgttgtcatcttctgtagactaattgcagggagtctactacacatagtaatcattaatgcataaaatatactaactttaactggtataaataatactagcaatggttctctgtctttctgtctgtctctctcttcctagttatttgaccaagcttttgttgcatcgcttatcttagttcaatgcgtatcagaactggaaggcatcttagagagagacccagagtggaaagggatcctttcaatgtcacataaatccctatagtgagtctccatactctttctgatattttcatcagccttatatcctgcatatgcgaaaaacaaaaggaaaaaaaagctaaaagcaaaatctaacttaatgccctaaatttttcctttgccttatgttaacattggttataacacaacttccatgaaagaacttttatttattttatctatgctttttttaattatgtggaggcatgacagagctttatctcagtgtcattttaattggaagtattgatgtctgaagttgcaccctgctgagaaaatgttatttatgtgccacatgtccccagcctaaacggttctgtagtatattgtaatgttgttcatagctcttgttttcctttccactcctataggaggattaaacagccacattccttgtcacataacttatagtgccccctgtaggcatcattgtcaggactggccatgtgacttgctctggccaatcccctatgagtgaacaagatataggttgcatccaaaaaggagctttgagtttgattcctccctgcttcaagaagcagtgcattgtacaaaggggctgctctctcatcgtgaggttatgaatgggtcatgtagagcagatttacagtggatctggagcaaagaatgagattacttgaagccttcacataatatgtgcaagaacaaatgttttgttgttactggtgaaatccattgaaaaatgttggatttgtttgttagcatagcaaaagttgagtagttgataagacagctttttgtaagtggaaatgtctaagctgtggcttgtagctgtttggtatgattttgggtagaatccagaatttcatactggatagaagccaggattcagtgacctcttacggatcttcaactttgagattttatgattctttgctttactttcttagtacttctattactcaagtatttatgaaatttattcaaatgataccttaaaatcctgatacattcatgacatcatctgagttgtacatgtacagttaattactcataatttttcttcaattgaactctacctttgtacttaaattaacttacttaaccaggatacttgttatcattaccaaaaaatagaaaaccaatatcatttgcattaaacagaaggttattctgtaaaaatatatatactatagaaaataaacttattaattttagctgtgcctgatttattcctattaatatgggcctttctcattgtctttcttaacaaggattattaagaagtgttagagaactgagatattctcttcattaccagaaagatgaaaaggaaaatcaatagagggtagcatactcactgaatgatttggcactgctcaatctgtgcctgtcctttcatggacctctagaaagacacaccagaaaatagactggatggagtacaaggaatgtcacttctctaaaagataattatctttttatgataatatgttgatatcatgggcactgactttgattttaaaaatgatagagaaatggagcaagatagccgaatagaagcctccaccaataatcatccctgcaagaatagcaaattgaacaaaaggaggaaccttcataagaaccaaaaatcactgtgagtgatcacagtacctagttttaacttcatattactgaaaaaggcactgaaagaggaagagtgtaggaaagacagtcttgaattgctaatgccacccgtccctcatccccaggtggtagcggcatagtgcaaagagagaatttgaatgtacttagggaagggagagcacaatgattgtgggactttgcactaaaacacagtgctgccctgtcacagcagcaggcaacactaggcagaacacagctggtgttcatggagggaacacttggtgcagctctagcgagaggggaaacgtccatcccagcagtcagaacctgagttctggcaaggctccccaccacaggctaaagatctctggtgtcctaaataaacttgaaatgcaatctaggctacaaggactgcaattccagggcaacttcttgtgctttgctaggctcagagcaagtggactagtgggacatgtgatgtagtgagacaccagcttggtggccaagggagtgcttgcaccacccctcccccaagcccagacagtacaactcacagctccaggagagactctttgcctttgcttgaggaaaggagagggaaaggtaaagaggactttgccttgtaatgtggatactggttcagccacagtaagatagggcaccaagcagagtcctgatgcccacattccagctcctgggagcttagcacagagagagagagagactcaatttatttgggacaaagtaagggaagagaataagagtctctgccttataattcaggaaattttttcagatcttatccaaggcaagcaaggtggtacctctatgaatctgcaagagccatagcattactgggtttagagtgcctaccattgcaaatataggtgcagttaccaaaaacttagaccacaacaccccagtcccttcaaatacctggaaagccttctcaggaaggatgggtacaaataagcctaaactatgaagaatataataaatacctaactctgcccaaaaacaatgaacatccacaagcatcaagactatccaggaaaacatgacctcaccacacaaactaagtaaggcaccaggaacaaatcctaagatacgtgacctttcagatagagatttcaaaatagctgttttgaggaaactcagtgaaattcaagataatacagagagtgaattaagattcctatcagataaattatataaataaaaattataataaagttatttataataataaataaattataataaataaaattataaaaattataagaaattataataaaaagaagcagaaattctggagttgaaaaatgtaattgacatatagaaaaatgcatctgtattagtccattttcacactgctataaagatactaccagaaaatgggtaacttataaaagaaagaggtttaattgactcagttcctcattgctggggaggccccaggaaaattctaagcatggtggaaggtgaaggaaaagcaagcactttcttcacaaggtggcaggagaaagagtgcagggaaaactgccacttttaaaccatcagatctcctgataaatccctcactatcaagagaacagcatggggaaaatgatccctatgatctaataacctctcaccaggtccctccctcgacacatggggattaaaattcaagatgagatttggatggggacagaaggccaaaccatatcattctgcccctggtctctcccaaatctcatgtccttttcacatttcaaaaccaatcatgccttctcaacagtcccacaaagtcttaacttattccagcattaactcaatagtttaagtacaaagtctcattggagacaaggcaagtcccttctccctgggagcctgtaaaatcaaatgcaggtaataaaatcaacatggattgagggcttaaatctaagacctcaaattatgaaactcctaaaagaaaacattggggaagctttccaggactttggcctgggcaaagatttcttgagtaataccccacaagcacagacaatcaaagtaaaattagagaaatggggtcacaccaagttaaaaaaaaaaaaaggacttttgcacagcaaaggaaacagtcaacaaagtgaatagggaacccacagaactggagaaagtatttacaaactatccatctgacaaaggataaataaatagaatatataggagctcaaacaaccctataagaaaaaaaaaaactgataatctgatttaaaaatggccaaaagatctgaataagtatttctcaaaagaagatgtacaaatagcaaacaggcatgtaaaaaggtgctcaatattgatcatcagaataatgcaaatcaaaactataacgatatatcatctcaccccagttaaatggcttttatccaaaagacagggtataacaactcctggcaaggatgtggagaaaggagaaccttctttctccattagtgggaatgtaaagtagtgcaaccactatgaagaacagtttggaagctcgtcaaaaagtaaaaattgagctaccatattgtctagcaatcccacttctgggtatatactcaaaaggaaggaaatctgtccatcaaagagatatctacactcctatgtttattgtacactattcacaatagccgagatttggaagcaacctaaatgtccatcaacagatgaatggataaagaaaatgtggtacctatatatactgaaatagcattcagccataaaaaaaagtaatatcccatcatttgcaacaacatggatagaactagaggtcattatgttaaatgaaataagccaggcacacaaaggcaaacttctcatattctcacttattttgaggaactacaaatttaaacagttaactaatagagatgaaaagtagaaggatggttaccaggggctgggaaaggtagtgggtaggagggaagtggttaatgggtacaaaaatacatttagataaaattaataagatctataatttgatagcataaaagggtgactaaagtcaacagtaattcacagtacatttaaaaataactaaaagtgtatatttggattgttagttacataaagaaaggagaaatgcttggggtgatgaatatcccatttgtcctgttgtgattattacacatcgtatgtctgtgtcaaaatatctcatgtaccatataaatacacaaaactactatgtacccacaaaaattaaaactttacaaagtgataaacttcaaattctccttccggttttgcaccatcaccagtgtccacagtcttgtctttttttcctcgagataaacagctctaagtcattcatcttttccttatctgatatggtttctgtgactctgctctactttcctttccctgactagtagtcttcttatcaagctctctttctcttgctcagaagtaaacagaatttatattggaacaatataattgatctgaaaacttctcatataaaattctctattattttcgtgtctctcaaatttaactaggacatcataggagactttggaatacaggaaatgtctaatgattgactctctgtttaagtataatgagaagttttcctgatgcttttactattagctttggaatcagtgaacctttaacttgtaatccctggggctagttttgttttcattcttattaaattggggataagggcagattatcccacaaattgtctctctgttcttattcaggtagaaatgaaaatcagccaagtgagaagttacagcagcaggacctggtcaaagtggatagggaagaagggcaatttccctgtctgaaaagaacctgactgtctcacaacctggcagatcctttcagaagtgaagctattaggctgttcattcagcttcacagtgtcggccacggatatgctaaattgtcacacttatctgaccaaaaaaatcctaggcagtaatttctgctttaagctaaaatagctttcagacctctttggctagtgaaaactaactggatttttcttcaatgaatgtttgatttaagctcctctgcatgtgcaatgggaaagcgactgctcttcccaccaccagaaactgctcattagtaagtagatgtgcctaaccagttgtgccagagaggggcaaagaagcctttcaggcagttaataatgttatggcatcctgttcccctcagaatgcttcattttaattttgtgctcaatatgtccctaataaaccaagtggggtggtctgaatggttggggaaatacccctgaactagtttttactgttttgccttttatctctttctcacaacttcttttctggtttatgactatatgtatatagtcttggctaaatcactagtcacttaaccggattactagtcactttacctcagtttattcctcaataaaatggagggctttacaatgcctttctccaaaggccattgtacatatttaatgacaggacatgtgaaagtttcctagaatactgtgtagcacataataagtgctcaataaatgatgtttaatgcagaatcaaactgtattaaatattaaataatgttcctctaatgtgaatgacccacaggtaaagtctctcccgattcaaagagcttatagggcaagcctacaaagacagcttcataaagggctcataaaattattcatcatttctattcatacaaaacttaatgactgtggagagctcagaaaagagcagtgaaatgatgaaagttccatgaggtcattcctctgagaaagggttagaggagatggattctttaatctgggcaagtgaagattgcagcatgacttaataatggtcttcaaggatgattgatgttagtagcagagagagtaatgtaagggttgcattaaagtggaaacacacccttataattctctcaagacctgctagatatttcctaagagcacaagtaaatgaaacagattcctattgctgatgagaatagatattaaagctggagtcaagaagaaaatgcccctgcatgtttacttgtcagagacagcatctggatggctgatggctggacattgttgagactgctgtgcctcgtggactttaggcaatttcacagcatctgctgctgactgtaggattgcctggcaatctgggctagccccacaatgcccaaaacagaactgactcccattgaatgtgtgacaagtatctgaaaaaaagaactcatttacacaaagagtatgccatagctccgctggtagaggtaagaattttacgggtattggcttagttatcttgattggaggcaaagcaggccctgcttttaggttcttataggaatcagaaccaggtttgaattcaatctaccacttactagatgggtgaccttgagcatagtttataattcccctccctgttctttgtatactagtcagagttcattttgataaataatagaaatctactttggataaatttaagcaaaaaggaattaacaagtgagatgactagtttatagaattgacagaaagattaaaaattaagctgtagcagaaaccagagtaggcaaggcaaaggaatgctttgcataaggcatcacaccaattttgctgcaattaaacacttactgctctaatggactgtggactccactgtagtgttgagtaatctccaacagaccccacgcttttatgtcattccccaaaagttctgggtaggagtatctgattagttgttcttaagtcatatgccctacactctaggggccatggtactagagagggaatatctgttcccaacaggctgttagcatgccatacctccacttatcataggatttttcccaaatttggatgctggtcacccagaattacacatgtcgactacatttcactcttagcttttgcaaagcagagataatattctactgctagagttgacgtacatgacatgtactaatagatgacaaatgctagctgtcttaataaaaattacagtagtggtgatggttgttggagaaatttcccagtgggaactgggtgacttctgtttactagacactgaactctttgagggcagattactcactctccagtggtggaactcagtggccctcaatcatggccgtatatgagaatttcctggagagcttaaaaaaaaaaaaaagaaaaaaagaaaaactgtgacagtgcctttccttttgtttgtttgtttgtttgtttttccccccaaggaacatggtatttgtaaatgattagcattaaaattgaaacaaaacaaaataactgtcatagaacatttatatacctgaaaattgatgtgatggatttatggggcccatttgattaatagtggtttactctactattattaccattaggcctctataattttttttttcttttttgagacatagtcttgctctgtcgcccaggctggagtgcggtggagtgatccattaggcctctataatcttaatagtataagagtgcctggcactgcctttccaacattaagtatgttaggcaattccaacaggtacttatagtatagtatagctgctctgtattgatggtgcaagtcaaggccagattatttaagtgtctgaaaataagataaaattatccttttgttaatgcttaagcacttcaattgctcaactacctagagaccgaatcactttaccatgaatatagtcgacagaactgcttccaggtaaagctaatgtgttctgtacacatacaatatactccccaaaaaggatacattttcttgtttgcagtacctgtcaatatatgcttcctgcaaagtacgtcttcaacaagctaactaaatgaactgctacacagggttaaatgtaggtctagatctcccaaatccaatgattttaatattgtcattgtctgaatcaagaatgatgttatctgcagtaattatcctgttcgtttagcaattaaaaatgctagtaaaacagttttgcaatatgtatcaagatttttgaaaatctttacacctttggagtcagtgtaaaagcttaatttaaagaggatgcctagaaaatagtgtgaaatataaacaaatatttttatataaaatatgaattatgctattagtaattagttcaaagagtgaacaaatagaagtaaacaagtatttagcataaggtgtaattaagtaaaataggatacccaaataatggaatattgtgtggttattatacccatccaaaagaaaaatgaaattatatatagtatatatatacatatacaaacacacacacacacacatatatatatatatataaaatattccattatttgggtggttataaccacccaatattccaataaccaaacaatatcccattatttgggtatcctattttacttaacatatatatatatatatatatatatatatatatatatatatatgtcaaatgtgacctcattatataaaatatcctaagtatttagccagcgttaatagtggttgtcttgagtagcggaacttaaggataatttttttcccatgctatatttttttgtataaatttccaaactttccatagtttttgttttataatgaaatgtccctattgctgtttttcctaaaacaaacaaaaaaaaattgctgacacaataaatttaagcaacataaacacctaaggaaaaaggtgaaattcatctccttatgccccgagaaaccaccaccattttggtgaccgttcttatatgcatcatctttttaaaaaatattgacatatactatacacttttacaataaaggtatttacattgctttatggtgctcaactttattcaattttttttctccttacctctccccttacatttattcttccacatcttcatgtaatttaaccaactccccatgtaaccacctaatatataaatttacaaatgcacactcataagaatatatatgtaggcttgtgtttatgtatgtatacatatatggatatgtatatttgtgtatagtagatgatatgcatacatatccatatatacatatatatgtgttatatatacatatgtacattacatatgtacatatatgtatgaataaatataaaattatagaaatcatttgaaattgtcaattttcaactgctttgacttacaaacatctcaatttcataggatatattctccaaatcaacagactgatttgttttgatggtattaaatgatttcagaaatatgactccttacatgcagttagtacacatgtcttccatggagaggaaacaaaaaagcaagtagacagtcacagttcacatagatttcctaggagagaacactggaatataaccaagaagtgaccagaaacactgaaagcaaaggagagggaaataggcaggctggttggccaggactgactaggaactgggagaagctcctggacataaggaaagggtgagtgagtgacgtcagggtttcatatacttgccatgtataatcctagccatggaaaagctcctcaagcctcacagccttgagactaatataggcagctgcctagtgattgtgccaagcttcagaaaaggaattcacacagtcccacagatttccaaaccctgagcagctgcaacatagtgccattctgagagctcagccctcaaagactaccaaggagaaagaggggaagccaggcactttcatccaccctaaagacaaatctcacctctcccactgctgtgagctgttgtgggaccaagatgtgaggaaatcacaggccccatagctgtctgcctattctcctcccactgagagtggcccccatcctcctcagtggcaggcctccaatcctgcaccagtccaagttcacagcccttagaggactgtgtcctccactgggttcaacactgctgttgccactgccagaccaggaagggagaagggaagctaggcaatgtcgtacattccaagtacaaatactaccgcctctgcttgcgagctgctgtaggaccgaggtgggagaaaatcacaagttctacaaatgcctgcttaagctgctcccactgagagtggccccgccctccctggaggccagtctgcagcacagtcaccactgcacccacctgaacattctgccaataatctggggaccatcccattcctgcctattacagacagtgccagaacatcctaccagaaggcctgaggacaagcctgctgtcctggtcccacccccacaatacttaagcatgacatccaggcgcctgcagattgcccagcccaatccacatgtgttggcacctaaacacttttcccagggtttgaggttatgccaacccaactgctgatactgccacagctagtacctacctgtacaagccacttgcaggccacagggatgccctgaccagcccatcacagccaccgccaacatcaccgtggaccactggggttccggtgggttgcctcaccactacttctgccattgcccacaaaatacccatagaccaggggccctaaaacccacccaaatttctggaccattcctgatactaccaacatccaagcaagctacctggaagcccaagaatcaacctgcctggacttacgaacactagactcaccatacaccactctggagctcacagacaggcatgctcagctgactgctgccaccacagggacccgaagactggcccacctggtatcctagtcctcagcaaaacttcaccacagcctccactagtaaccataccctaagccactgaggaaattgcagatatcaccaatgctgcttataggccaggaaatcatacaaagactgaactactgcacaaatccagaatcaaagctgaaggccccacccaccaacaacatatctacatcttcagcaaaaagccttctcctatgaaagcaagttcaaaaaaatagaagtgactgttatacaagctatgcagatgtcagcataaggaaaccaaaaacatggaaaagaaaggaaatatgacacttggaaagagacacagtaattctctggcaatggatcccaatcagaaattcataaaattttggataaagaattcaaaatactgattttaaagaagcccaaatgagacacaagagaattctgaaaaatgatacagagaatataaaaaacaattcaggatatgaatttaaaaattaccaaagggatggatatttttaaaaagaagcagaaatcttggaactgaagaaatcattgaatgaaataaatacatttggaaactttgataatagtctagatcaagcagaagaaagaatctcaatagttgaagacaagtcttttgaaataatctagtcagacaaaaataaaaaggcctagaaaagaatgaacaaagactttgtggtgtttgggacaccataaaccaactgattattgaaattatcaatgtctccatggacaaagagataatgaaggggttccaaaacctattaatgaaataatggatggaaaccacaagtcaggcaaaagatttagatatccagatataggaagatcaaagatcaccaaactgacaaaactccataaaggtcttctctgtgacacattatagtcaaactgtctaaagccaaagaaaaagagagttctaaaaacagcaagagaaaagcatctagtcacctatagaggaaccaccatcagactaactggggatttctcagcacaatgcaggagagaatgagatgacatattcaatgtgctgaaagaataaactgacagagaaggataatatatccagtaaaattacccttcataagtgagggataaagtctttcccagagaagcaaatgcttagggaatttatcaccacaagatgagccctactaaaattgattaagggagccctacacctggaagcaaaaaaacatttaccaacatgaaaactcataaaactgtaatactgacaggtaaaccatacacacaaatgagaaagaggaagggctcaagtggttccactacagaaaatcaccaaatcacaatgacaaataataagataaaaagaaatgaacaaagaacatacaaccagaaaacaatgaacaatatgacaaaaaccctgacagatcattaataacctcgaatttaaatggattaaattctgcacttaaaatatatagattggctgaatggattttaaaaagctataatccaactatatgctacctattagaaatgcactttacctgtaaggacacaagtaaactgaaaataaaaggatcaaaaaagatattccactcaaacagaagctaacaaccgggaggagtagctatacttatttcagataaaacagactttacatcaaaaacaatgtaaaaaagtcagagaatatcattacataatgataaaagaatcaatgcaaaaatagaacataacaattctaaatatatatacatacaacactggaacacccagattcataaagcaaatattactagatctaaagagagaaactgacttcagttcagaaatactttaaaagcctattctcaccattagacagattctctagacagaaaattgacaatgaaatcatggatttaaattggactttagaccaagtggatctgacagacatttacagaacattttattgaacaactacagagtatacattcgtctcattaacaaatagaacattctccaggatagaccgtatgttaggcaacacaaaaattctcaaccaattaaaaaaaaaaagaaataaacttcttctatttttttgaacttgctttcataggagaaggctttttgctgaagatgtagatatgttgttggtgggtggggccttcagctttgattctggatttgtgcagtagttcagtctttgtatgatttcctggcctataagcagcattggtgatatctgcaatttcctcaggggcttagggtatggttactagtggaggctgtggtgaagttttgctgaggactaggataccaggtgggccagtcttcgggtccctgtggtggcagcagtcagcagaccacagtggaagaaaactagaaatcaataccaagaggaactttgaaaagtatacaaatacaaagaaattaaacaacgtattcctaaacaaccattgggtcaatgaagaaattaagatggaaatcaaaaaatgcctttaaaacgtgacaatgggaaaataacataccaaaacctgtgggatacagcaaaggcagtgctaagagaaaattatatagcaataaatgcctacatcaaaaaaaaagaaagatttcaaataataacctaatgatgcaccttaaggaactggaaaagcaagaacacaccaagcacaaaattagcagaaggaaattagatcatttaaataataaagatcagagaagaactaaatgaaatacagacttaaatataaagaatcaatgaatagctcgttctttaaaaaggaacaaaattgaaaaaccactcactagactaaccaagagaagagaaaatccaaagaaaaaaaatcagaaatgaaaaaggagactttacaagtgatagcacagaaatacaaaagatcatcaaagactattgtgaacagttatacactaacaaaccccaaaacatagaggaaatggataaattcctggaaacatacaacctaccaagactgaatgaggaagaaatagaaacctgaacagaccaataatgagtagtcagattgaatcagtaatataaagtctcctaacaaaagcccaggacctggtggattcacagctgaagtctgctaaatgtgtagagaactaacaccaatcttcctgaaagtatttcaaaaaaaaaaaaaaaaaaaaaaaaaaaacagaagaaaagggaactctccctaacttgttatctgaggccaacattaccctgatatcaaaaccagacaaggatacatccaaaaaagaaaactataggccaatatccctgatgaaattagatgtaaaaatcttccacagaataatactagcaagctgaatccaacagtacgtgaaaaggaaaatacaccatgaccaagtgggatttacaccaggactgcaaggatgattcaacatatgcaaatcaataaacatgttacatcacatcagcagaatgaaggacaaaaaccaaatgatcatctcaatagacacagaaaaatcatttgataaaatgtaacatccctttgtgataaaaactctcaacatctaggaatagaaggaacatacctcaaaataatcatgccatatatgacaaacccacagctgacttacatcatagtgagtggggaaaagctgaaaatttttcttccgagatctgtaacaagacaaagatgcccacttacatcaatcctatttatcatagtactgggagccctcagcaaaacaatcagacaagaaaaagaaaaaaaatatccacatcagaagagaggaagtcagattttctctgtctgctgataagatctaacatctagaaaaacctaaagacaccacaaaaaaatctcctacatttgatatattcagtaaagctgtaggagagaaaattaatatacaaaaatcagtagcatttctatacaacaatgatgaactagcagaggaaaaaaatcaagaaagcaattttatttacaatagctccaaaaaatatatactcaggaattaattttaccaatgaggaaaagatatctgtaaggaaaactgcgaaacactgatgaaagaaattgaagaggacacaaacaaattgaaagacattacatgcttatagatcagaagaattaatattattataatggccatactgtccaaagaaatatacagattcaattcaatccctatcgaaataccaatgtcatttttcacagaattcaaaaaatcaattctaaaatgtgtatggaaccaaaaaaaaaaaaaaaaaaagccagaatagccaaagcaatcttgaacaaaaagaacaaagctagaagcatcacactacctaacttcaaaatatattacaaggctatagtaaccaaaacagcatggttttgttgtaaacacagacacataggacaatggaacagaatagaaaggccagaaataaatccatgtatttacagccaactgatttttaataaaggcaccaagaatatatactgaggaaagaacacggtcctcaataaatggtgctgggaaaattggatatccatatgcaaaagaatgaaactagatacccatttcaccccacatacaaaaataaactcaagatcaattaaggacttaaacataagacctgaaactataaaactgctataaaaaacataaggaaaacacatcaaaatgtcagtctaagaaaagatttcatggctaagaccgcaacagcacagacaactataacaaaaatagacaaatgggactatgttaaactgaaaagcttctatacagcaaaagaaacaatcaacagagtgaaagacaatctgttgaatgggagaaactatttgcaaactgtctatccaagggactaacattcagaatattcaaggaactcaaacaactcaacaataatataacaaatagtcccattaaaaagttgcctcccattttgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatgctaatgcctagattttcttctagggtttctatggttttaggtctaacgtttaagtctttaatccatcttgaattaatttttgtataaggtataaggaagggatccagtttcagctctctacatatggctagccagttttcccagcaccatttattaaatagggaatcctttccccattgcttgtttttctcaggtttgtcaaagatcagatagttgtagataagcggcgctatttctgagggctctgttctgttccattgatctatatctctgttttggtaccagtaccatgctgtttgggttactgtagctttgtagtatagtttgaagtcaggtagcatgatgtctccagctttgttcttttggcttaggattgtcttggcgatgtgggctcttttttggttccatatgaactttaaagtagttttttccaattctctgaagaaagtcattggtagcttgatggggatggcactgaatctataaattaccttgggcagtatggccattttcacgatattgattcttcctacccatgagcatggaatgttcttccatttgtttgtatcctcttttatttcattgagcagtggtttgtagttctccctgaaaaggtccttcacttcccttgtaagttggattcctaggtattttattctctttgaagcaactgtgaatgggagttcactttcgcaacctactcatctgacaaagggctaatatccagaatctacaatgaactcaaactaatttacaaggaaaaaacaaacaatcccatcaaaaagtgggtgaaggaaatgaacagacacttctcaaaagaagacatttatgcaaccaaaaaacacatgaaaaaatgctcaccatcactggccatcagagaaatgcaaatcaaatccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccatttactgggtatatacccaaaggactataaatcatgctgctataaggacacatgcacacgtatgtttattgcggcactattcacaatagcaaagacttggaaccaacccaaatgtccaacaatgatagactggattaagaaaatgtggcacatatacaccatggaatactatgcagccataaaaaagatgagttcatgtcctttgtagggacatggatgaaactggaaatcatcattctcagtaaactatcgcaaggacaaaaaaccaaacactgcatgttctcactcataggtgggaattgaacaatgagaacacatggacataggaaggggaacatcacactctggggactgttgtggggtggggggaggggggagggatagcattaggagatatacctaatgttaaatgacgagttaatgggtacagcacaccagcatgacacatgtatacatatgtaactaacgtgcacattgtgcacatgtaccctaaaacttaaagtataataataataataataaaagaagttggctaagcccataatagacatttctcaaaagaagacatacaaatggccaagagatgtatgaaaaaatgctcaatatcactaagcatcatgaaatgaaaatcaaaatcacaataaagtgtcatcttatcttactccagttagaatggctattattaaaaagacaaaaagcaacagatgatagtgagtatgcagagaaaagggaactcatacactgtgggtgggaatgtaaattagtaaaaccactatggagaacagtacactttcctcaaaaacctaaaagcagaaccaccatatgatacagccagcccactacggggtatttatccaaaagaaaataaatcaggatatcaaaaagatacctacatgtgcatatttagcacttaactattcacaatagcaaagatagggaatcaacctaagtgtccattgacagacaaatgaataaagtaaatgtggcatgtatacactatgaagtactatttctccatagaaaagaatgaaatcatgtaatttgaaacaacatggatggaactgtaggtcattatgttaagtgagacaagccaggcacagaaaattagataccacatattctcacttatgtgtaggagctaaaaaaaaaaaaattgatcttctggagatagagtatagaatgatagatactagaggatgtgaagtgtctatgggtgggatgggaagcagattaagaaaggttgattagtgaatacaaacatatagttacgtagaagaaatatgccccaatatttgacagcagatagggtgactatagttagcaagaatgtattatgtatttaaaagaagtttgaagagaggacttgaaatgttaccaacataaagaaatgacaaatagtgtaggtgatagataccacaaatattctaacttgatcattatacattctatgcatgtaacaaacattcactcataccctataaatatgtaaaatattttgtatcagtaaaatattgatatgccgtggtgtggatctatcacaatttactcctttcccttattaataggcattcactttttatttttttctcagcacaaacaacaccccaataatcattattgtacatatatttttcataaccagtgtttctgtagctaagcaatatattttcaggtgtgtgatattgatttttaccaaagccatttacatatagtattaacaaaaatgtatttaataatttttagtaggtaggtcttggcacgttaagtagtgatctaatgtttctattttacaaaaaatttttgtttggaagaattaacaaattttatcaagtgtttcgtaaacatctattgttttataaactgtttaatgtattattctttcaaaagagcacttgtaacgcataaacacatattaggagacataaaaatgaacactcactaacaagtcatccaatttcaaaataaaagaaattactcataattttgaagttatcctagtgctactcccttatttcatccccttttgtcacttatccttggaggcaaaatttttccagaattgcatatttattattccttcacattttaaaatatgtaattttagcacacacatgtgtgtatttcaacaaatatgttataatacattttactattttttgagctttatgaacatggtattatactatatattttgggaaatatatatgtgcgtgactcagcaacttattctactcctaaatgtatactcaaaagatattcatatatatatgaaccaagagacatgaggatgacatgtatcaacagtaatttttataactgcaataatttgaaaataacaaattgtgaaatattcatgcaatgtaatattatacagtattgtaaacaaatcaacagttcaaacaacgtagataaatcttataaacattgttttcattgaaaaaaacaagtcaaaaaagttgttcctattgacttttctcccatcatacatcaatatttattcttttttagaaaaattagtgatgtagagccatctttttcatcacttgatcatcctactaggttacagtatggtttttctcttggtattcttctgtttaaaaactctcatgaatagctttattgagatatatttcaaatatcatacatttaacccatgtaaaacatatgagtaaatcagtttttcaaagatctttgcaaccattgccaatagctaattttaaaacatttcatcacccaccaaagaaactccgtactcattaagcaatcactccgcgtaatccctttcccctaaccacaagcaacactaagctactttctgtcagcatggatttgcctattttgaatattttatattaatgaaacaatacaatctatggccttttgtgtctgacatctttcactgagcgtagtgtttttcaggttcactcatgttatagcatgtatcagtacctgattcctttttatggccgaataatattctattttacaggtacaccacatttgtttaaacagtcatcagtttatagacattagggttgtttctactttttgactattatgagtaaatccactactaatattatgtaccagtatttgtttgaatatatatttgtaattctcttgggtgtgtatacttaggagtgggattgatggatcataccgtaattctatttttaactttctaagaaactaccaaacagttttgcacagtggctgcataattttacacgcccaccagcaatggatgagtattcaagtttctctacatccttacctatacttgttattatctcactttttgattcaagttgtcctggtgggtatgctgtggtacctccttttatttttgatttgcattttcctgatgactaattaagttgaatatctttgtatatgcttattggccatttgtacatcttctttggagaaatgtctgttagattctctgcacattaaaaacgggttgtctcttttcttgatgtttctgcatactatattaatattttatttagaattataaatatattgtcatatatgagctgctctgtgactttgttgtctattatctgtaccaagtgggtccactttaaaaataatttagaacttgttattgctttctattttgaaaatgtgtaagttatattaattgcttttcaaaatttagacttggctataaggtcacgtgaccctgaagaccttgaaaatgatagattaatttttcatttttgagcttttttatgattatgtgtccttctcaaaatttgtacttcttatatgcacagttgtagtaatttatattttttgaaaaactatacatttcccttaggtttagaagccagttaccacatattatcattgcattcccatataattattttaatcttttaatgtctataattatgtttctttttctatttcttgtttaacagatttttgctcctcctttgcatttcttaattattcttataggagtttcttttttcaataggtacaatttaaacatatttttattcttctcttgtttttttttttttttttcttgagaggagtctcactctgtcacccaggctggagtgcagtggcatggtctcagctcattgcaaccttcgcctcttgggttcaagcgattctcctgcctcagcctcccgagtagctgggactacaggcgcgtgccaccacccccagctaattttttgtatttttagtagagacggggtttcaccgtgttagccaggatgatctcgttctcctgacctcgtgatccacttgcctcaccctcccaaagtgctgggttacaggcgtgagccacagcgcccagcctgttcttttctttgtatttctactttatacattttagctttcaaatttattctctccctactttcttgtttcatttcaaattgtttttaacttattaagaagtaaaccattcctgtgtctaagcgttctcattgttcaattcccacctatgagtgaggacatgcagtgtttggtttttttgtccttgcaatagtttgctgagaatgatggtttccagcttcatctatgtccctacaaaggacatgaactcatcattttttatggctgcatagtattccatggtgtatatgtgccacattttcttaatccagtctatcattgttggacattttgggttgcttccaagtctttgctattgtgaatagtgccgcaataagcatacgtgtgcatgtgtctttatagcagcatgatttataatcctttgggtatatacccagtaatgggatggctggggtggggggaggggggagggatagcattaggagatatacctaatgtaaatgacgagttaatgggtgaagcacaccaacatggcacatgtatacatatgtaacaaacctgcacgttgtgcacatgtaccctagaacttgaagtatagttacaaaaaatatttttaaaaaaagtagaccaaatattgtcatttcagtgcagatcttttcctctggtcatatcccagtttttgttataaggtcttcaactttttactattttctggatagcatattatttttgtttgactctcttatgatccagaacttgattaagaaagtctttcttaatttcaggtgaataattgttattaaataattatgaagtcagttatttatcatttaattgcgttagttaatgtaaattatgaaatatctgttttaaaatattttaatattttgtttgtgagcaaaggcaggatcactttcatacccctcaaagaaaaaaaatatgcttggtttataggttataaatataaatcaaatatcatatattatacataaactccagtttttgtgtttttttcttcctatacatttagatctatccagttctgtagggggtataacattttcaacaataatttatgtcagattctacttgaattcatgagtattcactctttgtaattagctgctttgctgtatattgtatacaagtttatacctgtgatatatttgtttcaggccttgacatattatttccattttattataccctgtgtcttttttcctaaatttcaactggtctgatatcaatattactactccttctttgtctgttactttgcattccctgatacattttggctctttattttcaatttgtcttatttcacagttcaatgaaataatacagccaggcagaaaagtacacaggaaaatattacagatgcctttacactagaattattttagtaaatattcaatatttctctacatttgcaccaaaattatttttactaataattggaatattgtagatttgaataaaatctaaattctttttatattctttcttgactctattccttctacattttcctccctggtgataattacataaataattataaaaattgacatgcctccatttcacccatgttttaattattttgctacacatccataaacatattatatatatatatacatatatatatatatacagacacacatataatttttgtttgtatttaaattttataaataagtaatcatgtacttttctaccattggtttttcactcagttgtgtttcttaaagagacacatattgatacatacatagttctgataatttttttaagtactatatagtattctatttgaagaagacaagattgatttagttttcattcttctagtgatcaacgtttaaattgtttccatttttaatacaaataatgtctcaattaatattcttacagaagtttctttgtacatatttgcaggaatttctttagggtatatatcaagaggtgaaattatttcatcacaggataggactatattcaattttattagatatcaaaaaattattctgtgaagagatttacccatttataccattgtaggagagttgcttttctacatattttcactgctgcttggtgcaggctgacgttttacacttttcaacctgacctatgtgaactggcctcttttgtgtttatttgcctttccctaattagtagagaggttaaacatcttttaatttatttattgatcattctgtttatttccagtgcatattttctgcccatatttatactgtatcattcattaacatttttcctgtagaattacagagtttataattagacactgaatattcatttttttatcattcatgcaaatatctttgttacatgtttgttacactattaatgctttttttcctcttttggttaatttttgtgtctgccttatatttcagacatcctttattacatggatcattaagatattatttcacttttttcctgagttttatacaattttttgtatgttattaaactctgtaatacattgtaaaatttacttctatatattgtgtgaaataagaatctatttttgttattattctgtcagaggagctatttgttcaatctatttgactagtccatctttactccactgataatgcttctattattttcacactcatatatatgcctatttttcagattttccacattgctttgttggtttatttgctattcatgcatcaataacacattattttatttactatatttttgaaaaactttgtcatttggtgtttggtaaaattgtccatattatttttcctccaaagtttcttcttggccttttcacagaattaaaattcatcaactggaatgtccagctgcctctgcttctataaccagagatactatgagttgtggcaagttgtaagttttctttccaggaggaaggctctctgtattggtcaactctactataaagataagaattcttctgcccttagggagagaggatttaatccaattcagttttgtcatgactctctgggaaaggaatagcaagtgtgcacaaggtcattttcacaggtttagtaaaggctttcttcttttgagtgccaaggttgccagtaatcactgtgttgcatccttagcccagggctgtctaacaccagtcttattacatttcaaactctggataagagtatatgtcaacaacttaaatttcagctttagatactggcatagcttgctgacatcttctaggacctgtgaagttgccatagccagactttctcaagagaaggaatagatagttggattggagtggaaagaggcagtaaaaaggatacgtttaagctttatctttctggagtcttttattccaaattttctataatgagaatttattattttgatcatctgaaaaatattaagtgaatcaattttttaaaaaactaccatgtcagcatgacagaaaaatcttgtcttccttttgtagcctctagttcaccagataagttcactagcttgattatctgtaactacttagtaaaaacataacactttcaacacttcatagaattaggaatttcatctgtcatgagagttcttatttatgccacaatggattttactgtttggccccaaaaatattttctgtaataaattttataaataatcttagattatttctaaattctctgtaagtactaaatcagtttatgagatctaatgattatgtacctccaggttgttagctctccgtgcaagatgtgagcttgtatttagaaacatccaatttattatttgtcctttatgactttaatattttatttcaccacaatatttataatcagtttgacctacagttcccaacaattcaatttgcttgtctctgagatctgtatacattttattttcagcacccagagctttatacgtgacatggctttttatccaggttgtctctgttataatttatccttattattagcagtgacataatactgtgctttttagtgttgatggaaagtgtagttgagagattgtatttacaaacccttcgtaaagtttgttttacaatctgttttcagatatgttacctcatttgaactttattcctactctgcaaataagtcattgttttctccattgtaagaggaaggaaactgatgtccaacatcatacttgccgttgttaagtgtaagactcaaactcatattttccaacttttatttcagaattgttttttcccctatgctgtgttctgatatccagagtatttaggtattttactgattgtagggggctaccattgccagtgactatcctgatggtggtagagagtgtgttttgtagtacttactgtctgtgaatattatcacataataatatcttaatgtaaattgtccctgaaagtatgactttgccaacatgcataatctacaggtctttaaatgtgtctgtatgtgtgtatgcgcccctaaccatgttaattcagtgaattttattactgctaaagatatctcagaaacttttccatgggatgcaaatcttttgtcttttctgaacaagtaacagatatttgttctcttaccctatcctttttgttcttattcaatctgaaaagcaattgaagatgtgtgagttcatactggtaaattgctggggtaggcgtttcacatgtgacccagtgtttgtcatctgaagcttagctcacactccttggatactgtgtttaagatttcacattagcatgttttttcttggtattgatggggagaacattgtgacaactgttattccatctcatctgcatgtcctatgcagtgagtcaaagtagcaggagacctcattatttgagtcatcaacaatgaactggacaaagaaatgtacaatcaactgtgggcaataatatgtgcattattgggatttaaactggtttatcccatctgttctaattactacaaatatgtcatgaatgacaaaaacgctttgcagcttattactttgcagctgataatgcaatggagtaggttttcttctatatgggcttcattcactattcacaggagtgatctgtttgtgatggggtaagtggaggaactagaacaagcattatttctaaaaaagtatctgggagccaatgtatttgtttatgttgtatagttccttttgctggccttgccccttctctggcattttgcacttttctcccaagttcttaaagtttaatctgttctattaccacccctggccaaagctcatctatacttctgtctctgtctttggcaagtagttaccatagctttgaaatcctctgtccttgctcatatgtattgtcaggaacagaatttgctgaaggcttagaaggcaaatcctagtgacctctgaagatttatggttgactcatttcctacaggtgccactctcttgatagtattataaataatggaggtaaaagattgtatgattaaaatccacacagaatggacaaatgaatgagtgagcagtatagggtagtagactcctaacctggataagtaaataaatagtcttgattgagagacttctgttgagtgcctgacactggtttatgtgggaaaactaaggatttgttgccacatgacaaggtagcaacagagttcaagtaagattttctggctccaaaacccgtgatcttttcattgcaaaatgctgcagaaagtaaaaatttgttttacaattttggtgtttgcatttattacactcctgattgttaggaactttctctgcatgactcagacaactcattaccatcagcatttacccatggccctaaggaagctaagcgctctaggtatttctgattttatcagaatctttttcaactttattcaactttatattgaaagaagttgtgccaaaaatatatctattggacttttagtatgttgttcttcacagttgtcattgtggttgtcctactacctgcctttcagacagtttttagctttaggattcatgtggcaagtagatgtatcacagtggcccattctggttatacacacatcattgtgactactcaaaaaggtaaaacaaatgaagcaattgtgaatggttttcatcctcaggcagatccatggaaagctaattactgtacataaagtttatagaataataatttcctatcttttttattttttaaaaaatttttatttatgtatttacttttttgagatggaattttgttcttgttgcccaggctggagtgcaatggcatgatctaggctcaccacaacttccgcctcccgggttcaagtgattctcctgcctcaacctcccgagtagctgggatacaggcatgtgccaccatgcctggctaattttgtatttttagtagagacggggtttctccatgttggtcaggctggtctcgaactcctgacctcaggtaatctgcctgccttggcctcccaaagtgccgggactacaagcgtgagccactgcacccagcctaataatttcctttgtatactttgttcgcaaagacagaacatacacagtaaatcttgataagtaaatcggatattgaaagaggcaggcataagtatgaaaagaagttcagtgttatgctatctgttaaaagagtaaattgaatctatacatatcaaccagtccagttgtaagctataaatcatgtgactagaccaatgttaagacgcgctaggacaaaaatcaaataagccaaatgtgtttctcattaaataaaagaaccaagaattctgggtttgagtcttgttctgtctcacttttgctatttttcttgggcaagttctcctatctatgtgagcctcaatttcctcatctttgaaatggtaatactaatccttcttggggttgctattaaagtacaatgatatagcatataccaagtacagagaataatatttgtcctgtgtctttcagagcagctctaggtaataggtaattatttacattgcttcccagtttgagtagctgggtcgctgggtataaatccagtcatttagaggctattctcagtcagcaagaccctgcaaataatggctgcatcagactgtgctgcagtgtacctgagtctccatatactattctttgcttgcctagcctagtccctaattatgagctgtttcatagctgcaacacttggctttttttttttaaatacagtaattgatcctcaaaccctcttcacacacaatgtttcattagttccaaccttgatctaataattactatgatatcactgggagaaacctattgcatcccttgtccagtgctagatccaggaactattgagctgattctcaacagagatttttctcttccccaaaccacacaaattagtgaataacttttgattttctttctctctttctagtggtgagaatgctggctccatgaaagaggtctgcgagagcagggaccttgtttgctctccagggcttactgcaacagactggcacataagtgtctaataaatattccgacagaataattggaagctagggtgctttttctgagtgcatttaacttttattgtgacaatacgatcatgataataccttatatttgtcaagggctttgtagtttacaaatccattcacgttcattatctcatttgatcctcacattagcaccatgcagagattataattttatgttcttggatgtacatgtggaagctcagaaaggttagtaaacagtggaggaggagttggaacttaagtcttttgattacaagatctatttactcccctctactcacacagcttttcctatgatctgactcctttttttgtacataattgaataaattcacagggtgcctttgtaattttgtcttaattaacttgatgcttaccacaatttacctataataggctttgggaaacttggtttttaaaatttcttaaggtcttcattcctatcttgctcctgattacatacatttggtaattttcctgcttttcctgtggcttccagggagaatgtatactactctatatttgatttcagtgtatttattttaaactcatccattcactagctcgaagcagagaattcgaaggcatgctcagattttcagtcttgtctcttccccaggctgtcactagatccttgctgccactctaacccctcttctcctgcactctatggatatcacccttggtatctcttcctgtgattatgtcaatatggtggattcagagttaagggtattctagctaaaagtcatgtttaaagctcattgcaacacatcctacacaataaataccccaaacattttcccccttttttattgtttagtttgaatgaagtgaaatatttgttttaaatcatcccctagaaaagttatgtttacttcttcattgctgtgggtatcatgtgaagcccggaatggcatatatcttacaaaagccatgctgctaccacaataaattatgaatccaatttggcatttattttctgttaattcctgattaggtctcagaatgttcccaagatagtgcctcagaaaaccattacttatctatgcagtaatcctacctataagagttaacctaaatataatacaagctactaatctataaatttatcaaaactacatggaatagaggaacacatggactcttgtctccagagtgatcttttcaaaacagaaatgtaattatgccttactgcttctgaaaaaaaacagtgatttcccattatctactggatggtgactaaactttaggaggacttaaatcttaagtcctttcattgagtggtcccactgtactttataaactcatctcttcctcaccctactcctccataagccctgtgctacagctacaccaaatacttcaatgtttcctgaacactgtattttatcctgcatcaaggttttttgcatgtgatatttcctatacctagagtcatcttttagctttgtctgataaaattcgacttgcttttcaaggttcaattgagatatctttcctatggaatttccttaattctcatctttatctaatagtagctccctgctcttctaaagcaactttaatcatcccctctgctataacacttggaatattgttgtaattatttgtctacattttctccagtagactacagagtctcagttgtaggcccatgctttttcttcatatatcttctgtgcccagtttttatttataggagcctctcactaaatgattgatgaatgaatggaagttggaattctgagttttctcctgggtgcatacaccaaaacccaaaatatctgtttagttcagagccaccagcatgtcagagtctcataatatgataccctaatgtggtaaaacaggctgaaaactgatttaaaaaatcattctagtgtgtttgttaaaaacgcattttcacaatttaagtatcctatcttaaaataatgatattgttaaaaggccagcatccaatgtgggttgtattactatcctttaaagaattgtcaatttgactaccattttctgaatttatgagtttattctgacattgtcaagaaacttaagacaaccgatcttggtgatacagacccgcagagtcacagttcagctgctgttcagcacaataatatctcagacctacccaacaatttacaggcttaccactgccccaagtcatggtgctcattcatggttgtaatgatgtgtttatgactttatggcctaattggtcccaaaggcacttaagaaaataatacagtataatgactctgtgctctttagttggagctgtcttttaagaatattgaagtagaatctggaataaaatggccttcattcagttttgacatattctcactgtgtgacttggggcttcagtttcctcatctgaaaatgggacatggggccaacaatttatgtggtttatggtgggaataaataagataacatgtgcaaagcacatataatagttattattactattattatctcaaaatacctaccagcctaaatccactatgttcttaacccctagagagctattaggcccactctaatgtgtctgagcatatgaccctctcctttattgcctagcatggagaagatagtattggttgaataaatatcatggttttagggccatagccagagagacaatagaccttctgggcctttcctcctagaagggacctaggagtcctttcatttctggtctgtcattgtatcttgcctaaggaaaaagtagaaaaataaaggacaggacttattacatcatatattggatgcatattatttcaaggaactctgtgggctcatacttgtatatttaatcatcacactatccatgtaatgtgttctccaaattttagacacaaacaatgaggctcagagtaaaacaagtattagaaacttgctcaagatcacactttggaagaaggaatgtcagaattcaaactcaagactgctgaactccttcaatcaaatcacaatgcctgagacatcctgaacatactttgtgtttcacagttttttcttcttcattgaatatcttcctttcatataaaaatcatattaagaaaataatctttgcatttaccttgcttttgtgacctggaagaacctaaatacgaaaataagtgactttaaggttttagcctcttgtgacatttggcagcaacaaaagcttattcttttaccaactcaggtctcaacaggatcctacagatgtagccccatggaaaacaatctttcatttaaagactttaaataatttgagtggaagaaatataataaatgacaataacatgtccaagcctttagaaaatggaaatgttggattcaaatagatacttcagtaatcaaaatctgttgaatagagcttacattgcttttttgaggtaccttaaatattttgtgagcatagaagaaagactttatttaatgagcaaagcatagaatgtatgcagttaggaaaagaaccactgaataaaacaaactgaataaaaaagaaaaaaataaaggcgataatgaaagtaaagaaaatgagaaataaaaaataaaaatataccagagagttattaaaagcaaaagttttttcttttcttttcttttttttttttgagacggagtctcactctgtcaccaggctggagtgcggcggcgtgatctcagctcagtgcaacctctacctgccgggttccagcgattctcctgcctcagcctcccaagtagctgagactacaggtgtgcaccactacgcctggctaatttttgtatctttagtagagatgagggtttcaccatattgcccaggctggtcttgaactcctgacctcgtgatccacctgcctgcctcagcctcccaaagtgctgggattacaggtgtgagctaccacaactggcctgcagaagttatttctttgaaaatatttataatataaacaaaatcctggtagcactaataggagaaagagacaaggcacaaattatcattattagtagtaacaagggggactaaagtacagatacaacaaatgtttctgaaaataaaataaataatgtatgttaaattttgaaaatttaaggaaatagacaaataactagaaaaatataatttatcaaaaatgagtcaaaaagaaataaaatattgtgtagatacacaacaattaaatttttcaggtagttaaaaatcagtactcacctacacatagctattcaaaactgatgcgcagataagtatgagcaaggtcagtgaaacaatgaggaaatgtatattgatatttacaaaacattgcagaaaataaaaaggggacatatttctcaatttcacttaatgtagttaatataaacagctacgaaactagtcaaagtcaatcggaaaattacagttcaatatatgttatttaaaaacttatctgaacaaatattagcaaaacaacctaaaatgattatttaaaaaaatattgtgaacatgttgcttttatctaaggaattcctagaatgtcttaagagtagctaatgtaccagtgtaattccttatgtttaatgatataagaacaaaatatgaagaatcatctcaaatagaaaaatatttccaaaaaaatcaactatgttaaagaaaaaaaaatgttagatataggacttctaccaaacacctatatcaagcatcatatttagttaaataaaggcttaatctataactgttttgaaaaacatatacaacaaaaaatgatgaaaattattcaacattagcagaaattaccttatgtccctcaaagaaaactgctgccttccaacaaaagtgaaaacagaagctacatgattggagagtatataaaatatacaaatacattttaaaaatctacataaatagtaaaacaaattaagtgggtaaaattacaaacataattacagaaacaagaaaatcaataaatatatagaaagatgttttactagtaatcaggaatatctgaataaaactacatagggttactatctcacacccactgtagtggcaaaaactaaaatttctgacaatagcgactattgacaaagcatggagcaacagaaaaaaatgtatactttttcgttggggcataaattataggcattttgaagaattattttctagtttggtagagttgactgtgcacataatctctgacccaacagttctacttctaggaatatacttgggaaactcttgtgcatgtataaaagaacatatgagcaggattgttcatagctttgttgattgtgattgcaaatatcagaaagctaaatttccatcaaaggtaggataaaataataaacagcactggaaatgaacaaattaggcttactttttttcaagatgggtaaatatcaaaataacaaatgaaataagaaagttacaaagttttgtgtgcagcttgatgctatttatatcattttaaaaggtaaaattacactatatgttatttagggattcatacataaagaaatacacaggaatgataaaactacagtcaaaatactggctaattctaggaagatgtcatcagatagacatgaaaagacgtctttgattacttagtaattatttatctatttaactagatgacagatattgttgcctatattatagtatcctttacacttttttggattgctttaacatttcataaaaatgacaaatatatgtgtaggtgagcaataaagaattactagtattatcattgccctgatgatgattaaaattaatcccaaactgcagaggattccaactattaccatttatatttttaatccttgagttttatctgttaggagaggcagtaggtgcatgtacatggtgataacccacgaactgaaaagctcactgaaatacctgggggctaaggcctaattaacatcttcggcacttgagttgaatggcaagacctcttcaggactgtagggtaggcggggaggactttacatgattctgtaatgttggtgaatgcacgattggccagccacatcttgtttccaagtatagatcataatccataatggatggcttttagaaatcatgtttatgaatgtgcatagaggcagagaatagtggctgtattcaacaaacatcatgaataatcatgctggaggggagcacagaatccaaatgcaatttagaagtgctctgtggaatttgtagagcattttcttaaagcagaactgggcaaatttttatttctgttcactgcttgaattctgtggaagcatgaaggaaagttcagtctagtcctttttcctggtatcagtctttcctctctcatgcattctccggttgggctgaaaaataaacatttgttgagagctgaacctagatacaatgtgggggaacaaatggtaatgtctttgctcctacccaaatcttccaaaatgttatgatccagcctggcagtatatgtttgcactgtgatatgaattcctgtagcatgaaaaggtatacctgtgactgaggtcccttttttcccagattgaggttttgaactctattaagagttccttatccaccactgacatctactctatatttactgtcctttggaccactctgtgcatgatcttcttctataatatgtgacccatcctcttccttagtggtcactcatagttatctcttttagctaagaccaccttggctattctttatctctcctttttaaaagaataacttttatatgtatgttatttcaatgattaaaattgaagttgtagttttatttaagataatggagacagattatcaatgttaaaatctcagctccttcaatttccagctgtatgattttggtcaggttcaaacttctctgagactgtctcctcatctgtaaaataaggctaataatagtagctattccatcaggttgttgagaggattaagtaagctaattcttgtaaagcacttagaagagtgcttggcagagtgtgtgctaggtgttgtgttattgttgttaatcactattattactgagatgttatctccaatatattctagcaaatatataatgtaataatacatttgtaataatctctctttacttcctgtaataatctcatgtttacttcctctaacccatcctagtttcctacaactttcttatttgtacttttcctcgagaaagagttactatttggcttattttatttgcctcagcaaggggtaagtaatgctccagagaagcgccctccactaagcctgccattctcaccaacggcaatctggagtgttatggagacatgatgttggatgagaaagataaggtccctggcctcctgggtttacagtgcagtgaaggaagagagacaataaagatatatgctggatcatctcaaatactggttaatgctaggaagaaaaggaagcaaggtaatggattagggaggctgaaaagataaagctacttcaaaaatggtggtcaaagaaaattttttcagactgtggcatttgaactgcgagctaaataaaagaaggattatatattaagaacacaacacaggtagatgcaaaggctcatgcaaaggctccaacacagatgatggatttgagaaggccagaatgtctggagtgtaatgagctcagggaagaatggtatgggatgagaaaaagcatgaggacagtctagatcttatagggagtcataatattgttcaaagctcctactaaaatctaaacacaatagaacccacatatggacaatacgggactaaaatactgtattgtgtaagatgcaagctgacatcataacaaagaggacataattggaatgagcctgcctacttgagtcagatccagggcccagatccaccccattcttgctgcctatttggtgccacctggtggcgatggtcctcaagcctcaatggcatgttgagaacacctcttgttcctgtcttagctggaacatggcagctgttccagaaatacccttgtgagttggtacctctttagctgaaatgatcccagaagagtgagctaagagaatattgagcacatggggcccattgtctttcctgaagcaggccagcctcctgtttaatgctggccttgccttttcttctctttctatctcccccaaagataaacaccttatcccacctctgttagataattaggacaagacagagtatgagactaactgacactcagaagtcacattataatgaaatcatgttatcagggagtatgtcatccaaggattttattgcatattttattattagggagaatgacaatatagctttgattttatacttacagtgcttgatatatagtgatattataatattttcttatattgtaattatatatgtgcttgtctccctcaaggaaaatgtactactgagagccaggagagggtctaattcaactttgtgcccctagtaagaaagggggaaatgaaaaccaacgtgtatattcacctactacaaatagtagtagaataagtcttatttaatagtcacaaatagtctacaaggcaagatcgattatctttatttcaaagacaagggagacaaggatgaagaatgaaaagccacataggcagtaaagaacagatctataaaatgccatcccaaattgtgtgaaaataaaagctacatgactagaaaaaaaaaaagaaatatgcaacagatataaaccaacgaagcctgttgacattccacctaaccgaacctattaccgccaatgcttgaacatgtttcctggcaggtagctaatgctcagcagatatttgatgggttaaaaatgaaaaatacatttgaccattttggatttaaagagtggggttaatggcacctatttccctaatcaaagccagtagtcaaggtgattggacatcaagtttattcttaagcagcaaggccacagtcagctatggtttgggaccccaggcagccctactgaagttgcacagaagaggtacttgtcaatgccaatcagtctattcctgctgttcaattaggttctgatttgtaattcactaccctccagcaccattttactcagtgaattgtagtcaacaccacaggaaaaattaatgcctgtgaaataatacctgagtaaggggaagaaaagccaaatgcaaactgttcttctcttataagtgtgtttatttttttccaaaaataatatggatttgctcttttgcaaagaagtcattcctcagtgaatgtgtgtatgtgtacatctgtgtgtgtgagagagacacattggtggcttgatatcagaaaaaaatacttttgccagactataataactattatttgtgattctattaacggaaatatatctttttcaaattaaagtatatatatttacatacagatggaaaaggaggaactgcaaaataggcctagttttctcaaagacatgcttgaaactctgagtcagtcagagattgttgttttgttaactaagctaaaatagaatgaaattaataatatttaggataataaaagttgtcaagtattgagcatggactctgaaatctgaaaccaataatcaacttccaggcattatctaatttaagtatcatggagatatagcgattatttctcttattttagtgatgaagaaactgagactgaaatataaaatacatggttccatagccaattaaggaacagagccagaacttgagtttggttcaatttgactcaaaatacgtgtcttagagcctgagcccccctggtgagtatgttagagtgatgatgagacacccacccctgcctgggattccaggcattgtgcctaggactgagcataccaatgctggtattgaaatattagcatttccagctatattggtatttatcttatcaaaagcaaaaacataaaacttgattaatctttaattcaaaacaactcgattgcaaatgattgacctggcagtgtcatttagttagcacagaaaatgttacacaattcaaagcaagattttcagaatctaacatattccatcattttgcaaatatcaaaataatacattaaagaaaatagttttgtaaaattaacaaataacaatttaacattgtcaatttaaattgatttaaaatatttgccttataatttttaattccaaattttgtgtatatttggcatataaaaatgaagatgttggagttccatgctaaacataattataatgttagaggtgtgccagccaaagaatttagaaattttgttgcccttgtcaatatgagggcagatgtcacagattcagaattctaaatctgtcaagtatgagtaaagtgagccagatatggactgctctgcagcggagagtccatgcgccacctaaaggcagcacctgctcctcatgttctgccagttgtacccatgtggcaacatgaattgaaggttgccagattaatctcttttttgttttttttagagatgccaggcatccagattcttaatgttggcatctgattcaatatttaaatatagctcccctgtgccaaacgaaatcacacaatgtgtgtgggctgtttctggccagggggcagactgtttgggtcatctatgctaaggctgtgggaatacatctgtcacaggggtttggacagttttctttgtgacaagaaagccctgccttatggattgagaaactattcttttacagtgtacagtcctgtcctgtattattgaggactggcttccaatgtatttgttcctttgccaatgtcattattgagaagccaggagttgggtggggtaggtgatactaatggtcacagcgatggcaatgggtgatagaatccttcttagaggggtttcttatagcttgcaggtagggcgggtaggtggtaaaattgagggtaaagcaatgaacaaatggcgaaagtatctgaaaatgactttcctatttcttggcacttttgtgttgacacaaagtacttaataattcccttttactatttgcttttaattatatgtaaacatgtgcatgatttttacagtacagaccttcatgtggtcctcaatagaaacaatctgtagacttctctgactgttgtgcttctacttctttctgaaaatctcagtctttggcataagtcatgggaaaatgataggaggggacagatgggagtagcttattgaaaattactgaaagaaaaaagacataggaaaagtaaaagttcagcagatgaagaggaagcagatatcatcaactagaatcaaatcccactgcaacatgtttaactaattctctgtggggggccttcctcttgctacctgccactaactttcttctccatcccccagtacctgaatacctagcatattatgttataaagaacatagagctcagaggcagaagaccccatctggacttctccactttgagccattttctctttgggcctcagtttcataatgtttgaagggagaatttgaaccttaaagtgcctaattcactgtggaatgtgaggatcaataaagatattgtatgatagcacatccattacggttccatgctgcacctgccctaagggatagttgttattgctaagcctccaaggcacagcatttcacatcaaaaagactctcttaaggactccatgatctgactttgattttgaagccagaacattgtctagagattgcaaggaggaagttggcagctgaactttgctcactacaagttgaggaggtagagcaaatgaagctctaatgagctgaacgagtagcttcatgcagagctggccctgggtgtcttctcagcaatgctgttgcttctcagtattattcacactgcatttctcctggagacatacttgtttctacatcttcctcccacagcagactgtgagatccccgagggcagaagccatgtgtggttacttatggtctcacagaagaaggtggaagaaaggggcaactttgcttatagaagaacagagtgtttggcattagacagacctgaacttgaatcccaggtccatcatgcaccattctgtggccttgggagggtgacatatactcctagtgttctaatctataaaatggagaaagtaagttgtacttatcagggttgctatggtgactaaaacatagtatctgagtacttaataggcattgaaaaaactattcatcctcttccttatttataattttagcatctagcagaatatttgagtgggcatatgttaggtgatagatgcctgtacacgtgtgtgtatcttgtgtgtgtgtgtatgtgtagttacccattgcttaacaacagggatacattttaagaaatgcatcattaggccatttcgtccttgtgcaaacatcagagagtacacttacacaaatctagatggtctaccctactacacacgtaggctatgtggtacagcctattgctcctaagctacacacctatacagcatgttactgtactgaatactataggcaattgtaacatgattgtgagtatctgtatatctaaacatatctaaagatagaaaaggtacagtaaaaatatattatactcttataggatcactgttgtatacatggtctgtcaatcacacacacacacacatacacacacacacacacacacagacacacacactcttcttttaaatatatctagcgatttggcattggtatttttttttttttgagacggagtctcgctctgttgcccaggctgaagtgcagtggcatgatctcggcccagtgcaacctccgtctcccagggtcaagcaattcttctacctcagcctcccagggcgcccaccaccacaccaggctaatttttgtatttttagtagagacggggtttcaccatgttggccaggctggtttcaaactcctgacctcaagtgatccacctgcctcagcccccaaagtgctgggattagaggcatgagctaccgcgcccagccaccattgtattctttaaacagctgttgaattgattcatggtatatgctgttaagtatttgtcctattacctaggaaaccttaggcaaatcacctctctcatggggacctcaacttttctacatgtagaagagtggttttgggctcagaatttgcaactgaaagctcaagttcaatgaaaactatgttttatgtgtcctgccctgcacagcgttggtctaaatgacattttcaaacaaataaataaaaccaaccttgtaaccaattagacagacggtgaataaaccttcgactgggtatagtaatgatcttttctgggattccagcaaggcatggtaacatttttggagctacataatagctgttccccttgggcagaacatgtacgctctctagtttaccaacacctgggctacatcactcatttagattgcttgcctggattctgtaatcttcggaatgtatgaccttgaatatggtagcgtatagacatgtcaatcctctgtgcctctatgattcaatgatttctaagcatgtgggatttagacgttcttagtcataaccagtatcactatggctaacccacaccatagaaaagagttgtttttccatgggcactaaaaagggatatacagcaaatggtcatgggcaatgacattatcctttaagtcatttctgattgatctccatcacataatctaccctctcaacagtctttcttctctacatactaaagtggtttttcaagatatatggttaggtttattcagtgagaaatgattcagtccctttgtttccacttgttacttggtcctggctccaaccttttcaagtcgcagatgcttcttcatgagaccagctctgactctggatccatggtgagcagcatgagttctgtaaagatatttttaagccaagtgcatccaggatgctatggagccacaagcagacaaaacggcataaatgctctttgggaatcataaaccctagtgcttctatctgttaagagttcttgaattttctcatcttaatttcttccccaactcactgaagaaaaaaaaaaaaaggtgctgattttccccctttcagaagcacaatgataaaactttgtgaatttgacaaaagctttttttttccaaaataactttttcattatgatggttacttgtctgccctttacacaacatgaaagaatttttctctgggtgtaatcagatgatgacagaaatatggtgaagctctctaaaggattgacttacttaaattcttcagttctcattcagggctgaagcctccttgtttcatttggaggtgaattatcttattgatcatgtctgcataaatacctctaatatgaataatgcagactattggaatactcaaagtaaaaaatgtggacctgtctttaaagggataggtttaacatcatgaagaataaattaaaaatcaaattgtattcctccttttaagccggaaaataaagcatcattcagaatagaattcttaagttcataaagcaactaaggattagatataatggcataagggaagaagtgaaacgtagtccctttgctccctggccaccaccaggcttgtagtttggtgggagtgacagtgtgatctactgagaggtagagtagcctcataaagttttgtattcagagaaaagcaagcctaaaacttagaataccatgtaactagatatgttgccttatggaaattatttaatatctttcagacttgtttcctttagctgtaaaatagagataaaaatattccattggttgaatttattttggctggaagtaatagaaatctcaagtaattgtgacttaataataaagtctttaattctctctcatgacatgaattctggcaatatgtagctccagggttggttcagcagctcaatgacatcaaaggcctagtttggtatttctgtgatttaattggaatttttcccataaactaaagaaggctgtatctctctagtcctcacgttctccagccagctgactacacagaatgaacatagtaggaattctgtcatttaaccatgaaagtcaaccccactgccactccatctccagcagacttctccttacttctcattagcaagaacttggtcacatgcccttatctagacagatcactgggaaaaaggatgaaaattccattattattatagatatgtggttctcaaagtagagttctcagatgattctggcaagcttgtttaaatacagactactgggttctacccccagaatttctaatttagtatgttgtgtgggaccagataattttcatttataatatgtttcctgctgatgttaatggtgctagtctgaggaccactgtttgagaaccactgattgagaccaacagtgatttaccccttgggctaggagataggcttccttttgtttgtttgtttgtttgttttgttttgttttttgtttttttttttagattaagagggcaatactctttatgcaagcaagtcaaggttcttctaattgaaagtgaatgtgtgggaggtggaaggtgtatcactcagggtagagcagaaagacaaaatctgtatggtgcctgcccccaggatgaaggatggggaatgtacagccgctaccactctactggctaaaattgactgaaacgtacctggaagccttcccctggaagttgcaagccttcaaatagactccagagtcctaaaattgttatatcaggcagattctgccagtgtaattatagtccaggttgggagagagattcctggtgctgactcctctgctattttcccagaatcctcagaggtatctttcatacatagttcataagatgacattgacacctttttaatttaccttcttgacaacaataaatacccatatcaatcgctttgggaaaaacaacaacaacaacaactttgatctggcactaataggagaagagagatatggaaggtgccctttagacagaggagcattccaaaggaaaacacacacgctgtcaaagtagcatgatttcttccgccaatacatccatctcacaatatgccgtaggactgacataaaaagaggcctaagggacatctgtggattttgtctcaccagaattcagttcctatcctagtaagggcattccaatagtttctgaggaacaaccccttctaaattctcagtttaagatatctcaagtagtgctgattttacctcttgctctaggggtgggctggtaaccagacatgaacccagtaactacttcaggactcatcatgtaaccaaatcaagatgaatgcggctcaaatcctagatttgtgccagtactattgataagaatctctccctttgacagatttaaaatgatgtttgcctagaacatctggaggccattacatgaagaggttctggcctataggggtggtaatatgatgatgataagagtggagatacagagggagcctaaatcctgataatattgcttagttgcatggatcccatagagtctagagccccaacacttgtacattttgtgagccaatatgtttcttttgggagaggagaggtaagcagggttaaggtgtcacttacaacagagggcccagtgtctaaaggtgcatcagcacccgcttaagattcaagtgctcagccccggcccctccccatgcacctgctccttacctcatgctgacctaatttctattctcccagatctgtattccctgaccactcctccaacatttgtccttgactccttcctttggttttgatgtgcagaaacattttttggtctctcatttgtttctaatttaaaaataaatgcatctggctatcctgcctcagggcaaatttagaaatatttctttcagttcaatagagtcctatggttacccttatgttggtactaatcctatctcacataccctattctgggggtaggaccagatgtagggtaaaaatctatgtacctgacttttactggtttcttacagatctaaagttatggctttatacttttctctcttttgaatgtaagtattacagctacacatttgtttctaggcactgctttaactggttcccacagattgtagcctgttgtttaataatatcattcagtcctaaatattttatattttccttgtagtttcttctttaattcattggcttttggaactggtgtaatttccaaatatttgtaccttttctaaatatcgtattttgatttgatatctgtttaattctgttgggaccagaaaacacactctgtaagatttcaagcttttgaattttggggggattgttttatgaacaaggattttttccatcttggtcaacattccacacgcacttgtaaaaactgtttatgctacagtgattgggtataatgttcaagaaatgccaatattgttcatgtcttctatattggtgattttttttggtgtatcaattgctgaaatagaggttaaaatctctagatttgtatttttttccttttggttcttttattatcatttcatgtgttttgaagttttgccattaaaaattatatatcaattgctggatcaaattgtagttttatttttagttctagtgtttttcatagaggctgttctaatttacattcccatcaacagtgtataagtgttccttttctctgaatccttgccaacatttgttaatttttgtcttattaataatagccattctgattggtgtaaaatgatatcttgtggtttaatttgaatttctctgatgattaatagccatgagcatcttttcatatacttttggtcattcatatgtctacttttgaaaaatgtatattcatatcttttgcctacttattagtgagattgtttgattagttgttgggttgtttgtgttccttataaattccggatattcgtttcctgtcagatccatggcttgcaaatattttcttccattctgcagactgtctcttcactctgttgtgcccaaaggaaaaaagccattatatcaaaaagatacctgcctgtagtcccagctgctggggaggctgaggcaggagaatggcatgaacccgggaggcggagcttgcagtgagccaagatggtgccactgcactccagcctgggtgacagagagagactccgtctcaaaaaaaaaaaaaacaaacaaacctgcaatcatcttttaatttaagtactattcgcaataatgacaatagggaatcaacctaactgtgcatcaacaggtgattagataaagaaaatgtgttagatatacacaatggaatgctatttagccgtaaaaaatgaagtcatatcttttgcagcaacatagatgaaactggaggccattgtcctaagttaaacaagtcagacatagaaagacaaatgccacatgttctcacttgtaagtgggagctaaataatgtgtacacatgaacgtacaatgtgaaatgatagtaaatggagactctgaaggtgtgcggggtgggaggggaggtggatgatgagaaattacttaactgggtacatgtacatcccgtgatggacacacgagaagccctgacttctccactatgtaatattgccaggtaacaaagttatacttgtaccccataaatttatacaaagaaaattttcaaatctatatatttgagtgttatatcttcttggccaattcattctttttatgaaataccttttttatctttgcacattttctttatcttgaatcctatttttttcttttcttttttttttttttttttttttttgagacggagtctcgctctgtcacccaggctggagtgcagtggctcgatcttggctcacttcatgcaagctctgcctcccgggttcacgccattctcctacctcaggctcccgagtagctgggactacaggcgcccaccaccacgcccggctgatttttttgtatatttttagtagaaacggggtttcaccatgttagccaggatgggcttgatctcctgacctcgtgatccgcccgcctcggcatcccaaagagctgggattacaggtgtgagctactgcacccggctgaatcctgtttttttctgaaaccaatatagctattctagttttcttatcatttatgtctacatggaatatctttccccatacttctagtttaacttgtttgtgcttctgtatcaaatacatcgtttgtatccagcaaaaattgggtattgctttttactagtctgacaatctttgcctttaagtgtttaataaatatacatttattgtaaatattgatatggttgggtttgggtctactattttgcatttttttaaatatatattgtagatccaatattatccaatgcctatgagattccccagtctgctttttggaagcatgcactgttcctcttcctgtgtaagcaccaggctctattacctctaatacattttggtggtctttcttcagctttggataatttcatcacacttattttctgattagcactttgctgattacctgactggtattctctgcagaacttcaaaattacctctctgttcagctatctcctctccaatactctgctttataacctctgcttgccttggtcttcctatattcccatctttgtatcctcaaaccaggtagttaactaggctcctcatgggttttcttccttctaccatggcctggacctctctcaaggtagtaaactaggatacttgtagcactcttatcatttgttttatgtctcttggggatcactttcttagttatctaatttccagtatcttgaaaacttttttcatatgtgtgtgtgtgtatatatatatgagaacatatatacatacgtatatgtatatgtatgcatttgttcctgtttgtttcagatgagacaacaaattaaatccctgctactataccttggttggtagcagaaatctgttcactattcaactcagtatgttttttctttacattttgaacatatttttaatagtttcttcaaagtcctatgtattcccccaagtgtacaagaggctgtatagtataatgattaaatgtatgtatttgggagttaagtagaccttggtttaaatccccactctgtcactttccagatgttttactgtgggtatgttatttaaacatgtacacctccattttcagtaaaattagagcaattcaaatgatctcagaggcattctgaagatcaaatggagttgtgaatataaagcacttgtcagagaacctgacacgtagtaaattattaatatatggaagttcaaaaattcttcctatttaatagagaaactgtaagaatcgtagaatattctaaaatagaatgtatgtcagaattaaatggggtggtagaactgttaaacactataggaattcagagaaaagaaagaggacttcttggtggaattaagatttgtgcttggattttaatttaaaaacaatcacttgcagggcgggaagcctcaaattcaatggaatatggaataggtgggtatgtaaagcaaccactcgagagagtgcaaaggttttatgatgaagaattttgagaaataaaggcaaattgatagtcaaagtgaggtcaaattgtttgtgctttgaatgcctgataggagatttttacaataagaatcatttgtaattactagaggagcaggatatttttaaaaatcacagaatcataggattttcagtcttggagtgaataagatttagttccatgtttttaaaatcttcaagtttcatagcagtcaaatttcaatagttttgttcattggttatgaggaatgacagtgaggaaggagtgctggggaggaaaatgaatttggtacatagaaacacatgtgtcatgtaaagctttgggcagaataagtttgaaatgaagagacctatgagatttgcaaatccataggcaatagtaaatgcgtttctgagtttgtgttagaggtcagcttagagatatagatcagagagtttccagaataaaggtgagagttgaaatgttaacagatgggttcttttaggaagaatttgagcacagtttgttagagaaaatacagaaaggcttcagagataaaattagaaggccatatccaggaagaaatggattgttttgtgcagagtcactgaagaaagttagagagctatattgtcaatactactgacttcactgttaatagcaggtacctttcagattaatacacaaaaactagttactaataaggacttacaaagaagaaacagcaataatgacatcaccagatattttatgagacaatcagttgactttgcggagattgttcataccttattggaacttgtttgtgaggcagacaaaatttgtatttttaaaattgccatttgcctaatgaagaacccgaggtacaaagaggttccttaaaccttttagcagtcattcagctggttagcagcagaagaagctatgagcccaaagctaaggtctcccatattctagaatattaaaagtagctgtttttgtttcttctcatgctgctaataaagacatatctgagactgggtaatttagaaaggaaagaggtttaattgactcacagttccacatggctggggaggcctcacaatcatggcagaaggtgaatgagaagaaaagtcaagtctcacatggtggagagaagagagcttgtgcaggggaactcccatttataaaaaccatcagatctcatgagacttattcactaccacaagaacaatatggtaaaactgactccatgattattttatctccacctggccccacccttgatacatggggattactacaatccaaggtgagatttctgcccctatcattctgccctgacccctcccaaatctcatgttctcacatttcaaaaccaatcatgcctttccaacagtcccccaaagtcttaactcatttcagcattaactcagaagtctaaagtccaaagtctcatctgacacaaggcaagcctcttccacctatgagtctgtaaaatccaaagcaagttacttacctcctagatacagtgggagtacaggtagtgggtaaatacactaatgtgggagaaatggccaaaacaaagagactacaggccccacacaagtctgaaatccaatgaggcagtaattaaatcttaaaggtccaaaataatctcctttgactccatgtctcacatccaggtcacactgatggaagaattgggttcccacagccttggacaactccgccactgtggctttgcagggtacacccctctccactagctgctttcaagggttggcattgagtgtctgcaacttttgcagatgtgtgttgcaagctgtcagtggatctaccattctggggtctggaggatggtggccctcttctcacagctagctctactaggcagtacctcagtggggagtctgtatgggggctccaatcccacattttccttttttactgccctagcagaggttcttcatgaaggctctgcccctgtagcaaatttctacctggacatccaggcatttccgtacatcctctgaaatctaggcgatggttcccaaacctcaattcttgacttctgggcacccacaggctcaacaccacattgaagctgttaagggttagagcttgccccctctgaaaccatggcctgagctatacactggccccttttagcctgggatacagcagctgggatgcagggcaccaagtcctgaagctgcacacagcagaggggccctggactcagccccaaaaaccacttttccctcctaggcctccaggcctgtgatgggaggagctgctgggaaggtctctgacatgccccagaaacattttcttcattctcttggtgattagcatttggctcattacttatgcaaatttctgctgcctgcttgaatttcttcccagaaaatggggtcttctcttctactgcaccattaggctgcaaatttttcaaacttttatgctctgcttcctcttgaatactttgctgcttagaaatttcttccaccagataccctaaatcatctctctcaagttcaaagttccacagatctctagggcaggggcaaaaatgctgccagtctctttgtgtagcaaaagtgacctttaatccagttcccaaaagttcctaatctgcatctgagaccacctcagcctggactttattgtccatatcactatcagcattttggtcaaagccctttaatcagtctctaggaagtttcaaactttcccgtatcttcctgtcttctgagcatcccgagtctctagaaagttccaaactttcccacattttcctatcttcttttgagccctccaaagtgttacaacatctgcctgttacccagttccaaaatcatttccacatttctgggcacctttacagcagcaccccactctcagtaccaaaatctgtattagtcagggttctctaaagggacagaactaataggatagatgaatatatgaatgggagtttattaggagaattgactcacatgatcacaagctaaagtcccacaataggccatctgcaaactgaggagccaagaagccagtccaagtctcaaaacctcaaaagtagggaatttgatagtgcagccttcagcctatggctgaaaccctgagagtccctggcaaatctctggtttaggtccaagagtccaaaagctgaagagcttggagtctgatatttgagggcaggaagcatccagcacaggagaaagatggaggccagaagattcaggccagtctagtccttccacgttcctctgcctgcttttatcctagctgctctggaagctgattagatggtgctcacccagattgagggtgggtctgcctctcccagtctattgactcaaatgttaatctcctttggcaacaccctcacagacacacccaggaacaatactttgcatccttcagtccaatcaaattgacactcaatatgaaccatcacactaatagaggccataaatgcacagtcctttcattttacacagaaggaactgaagcctggagatttggactgtcttggaatgtggggattataagttacagaacgataaatatcacttgcctaatgaatgtctacctggatttgtagtttttagattgatctcattcaatctttaaaacaacagcattatggcataggtaattgctgtggtttagatgtgatttgttcccaccaaaattcatgctgattttgatctccagtgtggagtgttaggaggggggccgagtaggaggtgtttgggtcatggaggcatagccctcatgcacagagtgatgccctcccgtgagggtgaatgagttctctctggcaggaatcgattagctcccatggagtctggttcatcagtttctctctcttgtttcctctcttgccatgtgatctctttgcacatacccaccccccccccctttttttttttccacaatgacttgaagcaggctgagaccaccaccaaatgcagctacctaatcttggacttttcagtcaccaggatcatgagcaaaataaatcttttttcttcataaattactcaatctcaggtattctgttatagcaacacagaatggactaagacagttatgttatcatttaaaagccaaagaaagtgaagctcaaaaaagataaataacttgctcaaagtcaaagtcatgtaacagaatcagaattcaaactcaaacatatctaactacaaagctttgtcttgttttatgtgttatcttgactcttgacttttagcaaaaaacttcttccactcctttagctgcctacgtaatctgtgattagtgctgggtttttttccttgtttgcttgtttctgtttttatttttagatattgcatcagtatgagttctaacctgagcacagtcttttccctgaatatggaaaagggtctctcataataattaggaaatgctggctagcaataaaaagcaactccaagcagtaatggctcaataaaatagaaatatatttcttactcacctaaatagcctatgacagtttcaggtctgtggaagggccctggtctacatagccttgcaggaagccaggcagaaaaatgttgtactattttcaatacgtgatttccaaggttttcctggaaattggcctgtagtgagcaggtagaaatattctggaggatcatattaggcatttttatgacccatattgaaattatatcacttctaactctgcaactagagctcagccacatgaccttacatatcttcaaaggaagcatgctccaggcacatccctaagaacccaagagaaacaagagatagaagaactagcctgtttctgcctcagggtctttgcatgttatgttcagtacaattctggcattcagcaaatagcagaaaataagcaggtttgtgtttgctgtacttgtgacaatttatgttgctgattttacttccttaaacttatgtgaagttttttggtgaccaagagaatctaaatctttatgaggcatgtattatagatttatagattctattcctgaatgcttaacaaggttacacttgtctcaaaatccaaatgattatttttaaggttccagaaataatctcttagtcctaaccagtttcctgattgcaagttgatattattatatatatttttattttcagaatcaacttattctgtcttctgttttatagcagtaatatttagtccaaagttaatatccagactgtgcttaagagtctttttttgtttaacagtcacatgatgtttgattttatcattctcaacctacagattagaaaacaaagacttgtgaaatctaaataattattagtgcattattaagcaggaatttgaagtcatgtttgtctctaaagtctatatttataacaacagtttatttttcttttacattctatttgccccctagactctatgtatctggagggcagagaccttatctctctatgtctgcatcagaggatataatacagtgcttagtatatggggcaaatgtactagcacatggtgggtgctcaataaacttttgttgaatgaatgaaaatatcaaagtttttctcatgactcaatatcaccctaaaaactcttaggaaaggtataatctatccacaacctgagccactacttcagtgcaagctttaactattagtatgaaatacgaaagtacctctttgaaaataagctttgagaaaacctttattggttttataaattgtcaaattgcaaatccaataggaaagagattagatggaggaagagatccatccagctcaagagatggattttacaggaattcaaggatttgtttgcaaattgctttctctaggaaattcaccatatgccccaaaaggattaaaggtattgcttaggatacattttatgaaaacaaaccttgggtattcgtctgtttctcattgtaaatgaaaaattcatggcacacgtaggacttttcattgcaacaattatagaaattgttataattattataattataatcatgattaaaattactcctaataacaccattgcaattataacttttttgttacctattttgcccacttaaaatatctaaagattagaggtagaagcaaagtattaaatagaaactacataatgtcttttagaggaaaataacatgtaaatattaaatttactttttctttagttttatgaattgacattgtagtttgtgacttgcaaacaccaggaaatcttggggtattttgaaaatctccattatagccttggttaatttttcctttcattcaatctaccagtcatttattttttcatacattcattcccagggacttgtattgggcactttcaaattgcttggtactcccacttccaggtatccctagcaaggtaaacctgcataaaatgttgtctgttttcttggaaaatttgcatttgagtgatagacactaaaaggaaatcactgtgataggacaagataagtactaaaatagatgtgtgtacagatactgagttactaggggagggagttggtgatattggtggttgtttgaaactttaactattagtatgaaatacaaaacacaaacacacacacacatatacgtatatagttcttccctttgattatgagctcctggatttttggagtcatgtttcatccatttttgcattgaacacaacacaaaaataatccttgcacatatttttagctcaacagatatttacagaattgaataaatgtattatctttctgtaaataatcctttcttgatttgtcaacaagatatgatagttgtgacaaaaactagttctagctagttttgaactgtatttcaccatttgtaagctgtgtgacccaggccatatgttagttattgtgttgtcgacatttgactctgaggatacagaaatgaatactccatagtatctcactcaacaatcccccagcttctcttgtttccttgttcacattttcagctctgtgctggattaaactgagatttaaacaagattttaggactttctgtaggaggaaaggtgactttttgtttgtttcctttgggatggttgacacattgtgagtgcagccagccaggctcacagtaatttatcagaattccttgaatgagagttgattctgtagtgaacttagagcttctgtcttgtttgtttgcctgtagggagtgctgactgggagaaacaaatctttgcctctgaggacaaaggcagccacaacctagcttgggaagaaaccatcatttataatttgtaaattccccaaagtgttgctgaaaagcctccaagtgttttctatatttgggtctgtgatggttgctttatatactactgtgactacctacacagaagaaagccagtgttaggaacacagtgaaaacgtgagcccctctcaagtacaatatggtacataaaaatgaattttctggctttaattatagaccttgcacagagaacagaaatgtacagcctaggcaccagcatgtgatgtgaacctgattatttccagtgagtttctggaatcgtctgtgaaaagtacagttgtcaggcaaaatgggcttctccactactttctcatttcccatgcaagccagggattccctagtgtccctggggaagttgtagatgtgtaactgtctgattgtcttcactgcttttgaaagactcctgtgctatacagataacttctgccctgctgaatcatggaaactccttatcgtttcattttgggaatagaaatatctgtgaattgaaaaagtatttgcacatcattcaacacttctgttcttcctagaaatgttctattgaatttagggctgaaggagttactttatttgatcagataatttatcctccaaactcaggtgttttgagagtaaaagggaagtagatataaactaggacttttccaggcaaaccaggacatatgattgctttggttgagatgcttctatttgtgtatctcctgatttcccaaaacgctaaccatggctattacctaaagtattgtccacagcctgtaggcaacagggtctgtgttaatcatgactggtttttctgagagctttggaaataaatgtcagaggtagaattggttgctgctttgttacagagagttatccttcagcctaacatagagaagtcatctctataatcagccgtctgtttatatgtgtgtctcttgcctggtattcaaaaagcagtgggctgattgtgttatttagaataagccctttccctccaggagccacagcccttagtcatttctctacttgaagttttaaagtttttagtgatccaacatatgtcccagagaacctggacctgtaaaatttgaggtatgacaatctacatggtgattggaaatttattttctgggaatttataataaacacacacagcctaactgcaatatctgaagatcctatacaaatattaggccctagggactgagggcatttagaagtctaagggatgatgtatgtgaaaagatttaatgggctgaacaatacatgctacagaagaagaaggtgaccattgagttggagttgcacagtatgaggaactacaccttttctctctttacttggccagaatgccttgagatgacattacccagtttcaaactaaattaacagcccggtgcacaacatgggacttgtcaagataatagaaccaatggtagctgattgcccctgaactgatgcttcttataggccctgttaaaagaaattgcaaagtacattttgttcattatgggttagattccaatgttaattaaatttatattcatatgagtcccatatttcagatatttccaagacaagtcaaagaagattcccaggcagcagtagctacattctaagaaataattacttggagaaattctgttacaatgaactgaacccggtttaaaaattggcaactctgttttctgcaatggtgtcaatctccttcagtgcagaggcaaggctttgtgctagaaaatctatacatgaaccgggtatttggtgattctaaaaagccagagcctagacaaaaacaaacaaataaacaaaaaaagcctaggagacttcctttcctcaagaatgattgaagaatgagaatctctgatggactagcataatcaatccatagttttaaaagaaatagaacgatagttcccaaactgtgttccccacaacactagttttgcaagatattaaaggtatcccaagaaaaggtaattattagctaaataaatttcggaaacagtgtgtattatcaatcttatctcaaagctttgcaggacatataattatgacaagtctctggggctgtcatttaaaaaaatcagtttaataatatttaatccagagtgtcctgaacttatttgttcataaaaattttcaaaggacacaccataaaatctggaattgccaatttagaaatttttaatccaaaaaaaaagtcatatacacccaataccaaaactgtgccaaacaccctcaacctagttattcagagacaacacagcttttgagttaggatttttttgtgaccataagctctcattcattgttcaatatgagagaaaacatccaagaatgaagctttcaattcatttgaattctggaaaatatgggatttgcttcttccagtgactttcattgtaggtgactaaacagttttaattgatatgttgacatgagcatgttttaggcatttcctgaaaggttagtgtcaaaagaaattaatatcctggtgggcttgtgtttttctctgaggcagatattgatgaatgttcagagggaatcattgagtgccacaaccattcccgctgcgttaacctgccagggtggtaccactgtgagtgcagaagcggtttccatgacgatgggacctattcactgtccggggagtcctgtattggtaagcagctttcaggcatgccctccaactgcttggacctttgcaggaggtgtggcttgctttggtactctgttcagctcccagtgttaaaatatgaccattcattggttaaatgcatcagttttcaaattttctccctctacaattcagggattaggccagggatcatgcaaagtggggtgctagaatttttatatagaaactgtgacagaggaacaaaacctgggtctatatgttatggctttgttctaaggaaaaccttagtcttcttaattctttctaaggaaaaccgtgatgacttgctgaaatttttgacagtttgggaggcaactgtagagatgaggaaatgttaaataatactggatactggatttagattaagaaagtttagtttgaatctcatctcttatactgcaagagtcactatagtctctaatccttcatctgtgtatatgtaaaaatgaggataacaagatacatatattaagattaaacaagaataccacctatttaaaaattgcaagatttgaattgatgcacatatatgatatagttgcattaacattattgttgctattaccgccaccatcatctcttgaaaagtctgctttattgggtctcttcttgtggttctgttaaatactgaacacgggaaattagcagatggagttattcaccttcaagaccttacaactttcatgaaatccgaacaactgatcaaaaacataactgtttccatgagaaccttagccaatccaattctttcatgttgtgtcacctcagttgaattcttaatgctgatttggaccaacctaggggccaagcattctgaccttgggctcccaaagtttagcttgctgaattagaaagtgggaatttgattttgaatatttgttttctctgcttagggtatattgttttttttctaaaggctgctgctgagatatagtcagtgttttttcaacttctccactgatgttgatgtaaagcaaagatgaattacagaacaatggccacgtggcatgaattatcccccatagtcttgacattattgttgagaggcatgcagtatagttactaaaagtatggacttttggaccagatgttggcagtcaaattctagctctgctgcttctaagtcatttaccatgggtacatttttatccagtctgtatttcagctatctcatctgtgaaattgaaataatgtttatatgtttttgagatgagtgttgtgataattgagttaatatctgttaaatgttcaagaaatgttagctattattttaaatgtcactgtgtattcagcattctaccccatactctgttcatatttcttttcctttacatactgccaggtacttctgtacatatgcagctcattgtaaatcaatgttatatgaataggaacaggtcaaatggctattgttgaggaatgaaaatggaatattaacatatgacattaagcatggtggctaaaagaaaattttaatttttacagataatatttgacatcattaaaaggggagactcttagattttttagtgcacaaaggaccttagagaccagctagttaagccaattttatttattattttttctacttttaagttcaagggattcatgtgcaggtttcttccctgggtaaactgcacattgctgaggcttggtgtacagatgatcctgtcaccaaggtagtgagcatagtacacaataggtagccttccaaaccatacccttcccctttcttccctcctcaggcagtcctcagtatcttttgttcctatctttgtgtctatgtgtattcaatatagttaaaccaattttataactgtttggacctgccatgggactgcacacttctctgcctttatatacgttgtccctctggctgggatgaaacatgatgattcacatatgaatttcattttcctaaatttagctcacgtttcaccaagtccccatgaagtattctttgatgccttccaaagacttgtcactcctttcttctgctaactctagatctatctttttccttggtgtatgtttcagtagcttcacttgtacaatatatttgctctctgactagactattgagcagcgaatgggcttttttcttctgtttcttcagtgaggccctttggtggttgttgtttaataaatgtgaaaattcaatcatatcatgtgatcaataaagacactcactctcagaaaggtgacacctcattcccagccacataactggtttggatacaagttgaggatcagacctaggtcaagagaacatgtaggaatagtttcagtttatgcctcttgtttcaatgttacctgtagagccctatcaccctcataaatgtctctggcacctgtcctggtgctcatttctctctaacatgctgagtggcatgtctgaaggatgcggtaaaattcctgcactctcaaggagcgtctttcttcatctacaacctgatccctgttttgcaaaggaaaatgtcagtgaactggactccttggagttggagtcattggattagtggcatttttaatttgggtagtagtctgaatttctttttatttccacacttttgggaaaacatttgtaaatgatccttcatcaggacagaaatctgaccctcacttagttatttctgtggtagttgggagtactctgttggttcagaatatttcttgggcaaacaactatgtaagtcagataatgacactttcttcttatggccttctaatgccttcccaatgagtgtaaaataaatttctaactttatatggccttcatggttttagatgatattgttcctgcctgcttcttggactcatttcctatatatataaggctttttgatcttttcatgccttgaacatgacaaaaagctcattccaatttcagggcctttgcctttactgttctctctgtctggagctctcaacacctctcttgttgtatggctgccatgttattaggtctcagacaaatgttgcttcttcatggagaccctccctggcttttctctgaaataatccttccctactcactttgttataatacttttatatctttttagcatttgtattcacatgcacatgtgtgtaatattctcttgcctcaaacaagttgtttgagggcagagaccttgtttgccttttactactgtactcgcagcccctaagataatatagtcaaagagaaggcattcaatgcatgtatgtcaaatgattgaaggcatggatgttcaaaactgtatcaaatcagatttattttctattttgtttgatataactagttgtgtggtgtagattgtggtgcatgacatgagatgttaaatatcacaaaaccatgagtcttttatttaaaaaaatgtttattgagaacaaccatcataccagcactgccttgagtcttctgggaatatggttatgaacaagttaagatgtcagttcttgaaggattaatgacctgacgtactctggatcttaataacatagcttaatagcactgaaaatgagcacatctgaataaaccctaaataatatcaaccactaatgcttacatttaaaagaaatatcagcatctaaaataacccttacaattttttttaaaagtggtttgtagcatatactcagctatgtttttttcttcagacaatggcatatgttatcatctaaaatgtatcagtttaggcttttagaagaatagtctcatgtcactctatgtcactttttgtcagatgaggataatagcaccttcactactgattttatccattattgtaagcttgaataatattgatatcataaagaacagcatgcttgcaagatttcttattttatgagaagaaatgtttaagatttgcctttttctcttaaagtgtaacatatgattgaagaaatggccagtcctagtattgcagaggcagatagagtcactattcttgaagagcttatcagagttagtctcttctgtctctctctctgtctctctctttgtctgtctctctttaacttgtatatctttataatgccaggagaaaatagtacacaaaaatttgtaaattaatatttgcagaagatgataatgacagtgatttgttggcactgtagggtacaatgcactctgtgttttgatgcagtggtaggagtcagtgattctcagttttaatatagaagttgtgagcaattgcttttttgtctaggcatagttatctgggtcatttagaaatgagaagaactaatatataattaacaatggcatgtataagcagcagtactttgcatattttaaaaataagattcagactcctcggaatgtcaatcagtttccacaatattgctcccacaaatgaaactttattttcctttgttctctcatatactttgcatggatactggagactactcaaattcttattctgctcttcctaaatcctgcattctctttcctctactcctttgcttgtgtgcttttccctgactatccccatagccccatttccattagttaaaatcctgatgaagtcttactctgtaaagcagggattctcaaaactgtgtcatggtagattcactggagtagtgaaacggcagagttccctgacccccttagtaggacttgtgacaaagatgtggcttgtctgatcacctgccatgtgctcccaaactccttatgggagggagagtatacagatgtgcaggagctggggcaagcacttttgggctctggccccacaataatatctagggatgggtgcctgaaactcctaaagcccaagtgggtgtgtgttacactatgttctgttagctttgctgtgtacaggcagtaaatggctcattgtaccctctgccttttcacaaggacagagggccagtgtgacggctttctgtatctcaagctcttgtctggtgtccaggaaaaatcatattacacacggacttgaaggatggtgaatgtgggattttattgagtggtggaggtggctctcagtgggatggatgcggagctggaaaggggatggactgggaagacgatcttcccctggagtttgactgtccagcagccagacactcctctctgagtgtccccagccaaactcctctagacattcagatgctccttctcttctctcctctgctgctcttctgttcgtctgctcatctgcttgtggagcctggggtttggggtttctatgggtacaggatacccatagatagcccatagggtgtacagaatcctgggtacaggataccgatagggtgtggtgggccaaaaggcaacttttggttgcgaaaacaggaatgcctgttcccatttagggccatttagggccatttagcccatttagggctccctttgccagggagctgccctcttctacccagtatttccctgtctcctgtccatatcagtagctttttaaaaatgcctgtgacgggacatcacacatcctgaagattcatattcagttggtctggtgtgggacctagattgacaccattttctaaaatttgtttaagtgtattttttataaattcataatatttttgcatatttatggggtatatgtgatattttgttacaaccacagaatgtgtaatgatcaagtcagggtatttgaggtgtctatcaccttgagtatttatcatttctatgtgttgggaaaaatacgagtcctgttttccagctattttgaaatatatagtacattgttgttaattataatcaccctactctgctctcaaacattgtaacttactccttctatctaactgtatgtttgaacccattgaccaacctctctttaacactcattccccaacctgcacacccttcccagtcgctggtattgatcattttccctacctccatcaaatcaatttttttagctcctacacatgagtgagaacatgaaatatttacctttcggtgcctggctgtattagtctgttctcgcactactataaggaacttcctgagactgggtaatttataaagaaaagagatttaactggttcatggttctacaggctgtacaggaagcatggctggggaggcctcaggaaacttacaatcatgggggaaggtaaaggggaaccagacatgtcctacatggctggagctggaggaagagagtgaaggggggaggtactatgtacttttcaacaaccagatctcatgagaacccactcaccatcatgagaacagccaggggaacatctactcccatgattgaatcacatcctaccaggcccctcctccaacactggagattacaatttgacatgagctttgggtggagacacaaatccaaaccatatcactggcttatttcatgaagtcatttaaaaaaagactacaagtgattattagagagacaatttggccaatgtagagaactactgacattcagttcttctaataataagaataaaaatttctcccctcttatttgtcttcatagccgtttatttgccattcttttatagactttagcagattagacttgtgttcttaattacgtctttatcacctacagtacaatttaggtgttttttgatagatttttatcaattaatgttgaattaaattgtattggttgtgttatttttacctatcatataaaatgtttcattcacaagaaagcccatgttgttgctggagacacactccaagatgacatacagctattcttacgggactgaatacctgttggccttccattgttatctgctttatagcacttagttgggtgaagcagtttcctagactctggagcctgctctcaggccactgtaaatggcacagtgaggatttacttctcagagtactgctgaaaccatggtcaccatgcaaagcaatatgaaacaaccaaaaatgttccgctgaaatcccttgggaaagaaatttccattttatctggtggatgtgtcaggaataattgaaatggcctaagaatgattttgctttgactgcttctgctcagtgcctgtttttcataggagtggcgataaaaaggggtagaacctggaggtgctctatctgtaaaaatgctctcagtgacaaacctcactgaaggggaggggagctatgaagcctttgcaggcaatactgtgatgtaatggagaggggttttaaggacattaagcctagattcagtccgaaatcggcctctttctagctgagcagcatttagaaagatatttaacctttcaaagccttagttttcttagtgtgcattaagataatacttacaatggaactttttctaatatgtgtttttatatgcaaatttcctgacaagtattatatgatagtcaacatttaacctcccttcacctcagttccctcacctgtcacatgaaaacaataacagtaatactaataagagataacatttattgagagttttactttgtgccagacactgctctcagcaatttacaaaagcatcaacctcatacgggttgctgtggagtaatcgtgacaattaagtgagcaaacaagggaaagaagcattcagcacttaggttttaagcaggcaatagatgttattttcattaaccgaacaactacatgatgtgctagacacagaaccaggaaatttcatgtattttctaatttaatttcacaatgaccataggaggaaagccctcttactatccccattgtaaaggtgaagaaaatgtgagctcgaggacgaagagaacttgtcccaaattccgcagctgataaatggcacacagaagccataatccaggtgtgtttgatcccaaagcttctgttcttaatatgttcacactgcactgctttctggaagggaggagaacagtgatgggctcataggtagaggagatgttagccagagcagttggagattgaaaatacaaaaaaagggagcatgagagaaaacagatgagacccagatggacagttacaatattatctctgtgtgatgagcactagggacttattttattcactggactcaagggatgtgttctggggccatccttctgagcgatgggcaggataactacgcgacatgtttttgacagttaatgtgaaagcacctcagccttgataatactactactgggatatccactgatgtcattaccttctttgcatttctggtgatgtaaatccagagaagaaaaaggaaagaaagggtgggtgataaagagaatgagaaaatgatcggcagatttttaaaccaattttttaaatgtacttatttattatgcactgcctcttaaaagcaattagaatagtatatacaaagatcacatgttcaagagttatttaaaatacaaatatttgaaaaataaagaaattatattaaccaatgatagttatcaaagatgttcataaatatcctggcagtcagagcaaaatgggaaacatgagtatataaattattctaatttaaaaggaggtttcattcataatcgtcaagaagtaaagtctcaagtgtgctgttttttctattccagggaagagacatgtcagggtggaaaagcaccttagtggaccagggtatttcagactaagaaagtttaagagacaaggcagagacactaatcccagaacactcatggattttctctctatgctaaacaataagacccaccctacacataagatattttttggttaaatagcatgccacctttctttgataatatttagtgtggtctcattacttcaaaattgttgtttccaaagagctttacacacagttttatcaaagtactaaattctgtattattgaagagccttgcttaaggcagatgccacttaaccatggaactgtaaggaatcaatatgaagtaaatgcaagcatgattttgggaatcagagggcctcagttgcatgacacaaaattgccacatgtcattaaaagtttcagatggacagagagaccaagacccagacaccacctcagtatggaatggatatggaaaaagatcagtattatcagggtgcagaatggagaggttaagaacattttgcaacatctaatagaaaagaaagctcttctgggtcccccagaaaggaccttacagtggacacacagtggcagatgataaatcaggtgagaaatgaatctcatcagaccctctggaagcttgcctgctccttttctagtcctgccatacatagataagcctgaagctatttagcatgtgggctaaattggatacattttagagacttctctgggaagacaagcgcacctcctccgtttcgatgataatcacttcacaaagtaacatcaaaatagagtgcattacactagactcgggcatgaacccaaggttcattcattacccacagcctagctgggctgacagagcaagcctataagttgttttctatgtgtactttctaggagtttctaaacatttctgggagttagtctaacagaacctcagatgagcagtagggtctgtcctgtaagccattatgaacctgtctattatcttttcattctcagtcttttgaatatcttcctaatggcaactatgactagtcataaagaaaaagaaaaaaactacaactttggaccatgacatgaagcaatacaggcatatggggagccaggggaattgcaattctagttcaggtgaagttcacatgggcagtaatgataaggagaaaaattagaaaacttacaaaaaccttcacaagtattgggatgttattataagtattatatccttaaaaatatcctacagtggttttagcactaagctaggtggtaggtaggatgcagaaaatttataccatagggacttttaaattccatgttgaagacaaaaataatcagcttacataaaacaaccaacagccttctgatataggttatactttaaaatatggggtcaatgctataaaatatataggtaattagggaagaaagtgattagagaatatcaaagaacagtcataacagaattcttggggctgattcgacctgaaggatggaagggtttaggtattttataggtataataataaaagtaaatattaatatctaagattaattacttcatgttctaggtgctcttctaagagcttgacatttctttactcactttatcctcaaaacaactccaccaggtagaaatatttatgatctctatttaatggacaaagagcctgtactttatattatgaatgttctaaatgtatttggtcatataaccctttcctctcctgggcatcttatggatttggtttctattattataaaacacactaattgaaaacttgagaatgaatataaattcctattctaggaatttatagaaaaccttatttgctcagtatcattgaataatgagctgtttcagatgaggttttttttttccgttctgtggcaaaaaatgattgcatacactacttgctctataactatcagaatgtttctactatcttaactttggtgtaaggatatccttccaatatatgtctatttgtgtattacttttttaaaatgtggtcactaaaaatgtgaattactcaaaacaactgttgattattgagtgacgttctagtggtttattgaggtatagctggttggtccctaagttaaatgttcccagtcataatgtttttgacaaacatatttcttttttacacagatattttgtcttctttccacattgtcaagctaatctctattttttaaaatgacatttacgaggttgctctcctttccactctgataaactaaagagttggttatgtgatgtctcagacgacaggacctcaaagtcccagaagcctttggggataaaaaaggattgtgaagcaggatttcacaagtgctggatgacaattttgtattctgtgaattggcctggtgggagtgctgagaaaggaagacatgggttggggactttgagactttattggagagctggaacttgaagagtaagagttgggtaatacacaaggaaaagattaatacgttcccctaaaaaggtgctttgtagtgtggttatggttttagggtcctttcctcactgtgaacctgacattttttggaaaacaagcaacaggagaagctttttagttttctgaacaagaccttgaagttgataagcaaattgttcttcataagttttaaatgtcttttttctttcttcctgaatagctggcagtctcaactgagtgaaaacagaatgagagggggcatttctgaaaaataggttttcctcagatcctattacttcctgtgaactcagtgccccttgtagcttcaggcagtaattttagaagtatgatcctcagaccagcatcatgggagtcgcctgggaacttgttagaaatgcaaattctgtaccacactctctagaccttctgaatcagcagctctgtgggtaagggcctagtgatctgtgttttaatgagagctctcattggttgattctgaagctcactgaattttgaaaatactgccttggggttttcactgaaagccctcagaacactctgaaactgtatgcaagcttgtgtatacatctgtgcctacatcttctggaggaaatggaaccatagtttttcctgggatcttggccactaacaatgtgagaaccactgttgaaataccaggatccggcctcaatgtttccagttaccactctgactctgatttaacttataagtattttcttcctgaagatttataattcagtctcaggggagattcactgctttcctttgtcagtttctgagcactccttgatattgaattccatgtagtttcagcttcctgcctttttgaggctcagtgtgagcaattgtttcattacagaaactcctggcttgaatgtgttagagccaaagatcatgtctaaacagcaattcagagatcatcattgatatggtttggccatgtccccacccaaatctcattttgaattgtagcttcaataatccccatgtgtcatgggagggaaccagtgggaggtaactgaatcatgggggagggttttccctgctactctcataatatagaatcagtctcacaagatctgacggttttataaagggcagttcccctgcacacactctattgcctgccgccatgtaagaggtgcctttgctcttcctttgccttcatcatgatggtgaggcctccccagccatgtggaactgtgagtcaattaaacctcttttctttgtaaattacgcagtttcaggtatttctttattagtggcatgaaaatggactaatacaattatctacaatttctttgaaatgaatattgaatagttttttgttcttaccctgagattactcaagctgctgtgaaatatttacctgtgggtttatgagcagggaatattaaactatagtattcagaccaattaaagcagtgtcagcataaaatcactagtcatttgttaaaggaacattcattgagagggtctggtcagtgttagttcctgtactaagtcttaggcatacagagaggaatatgacacagtctttccagtctggagtggggacagtggaagtggacaaggatttggggaggttgtattgtggaccagctacattataaatcagtaaaacataaaagactctaagaaaaaagcaactaacttctcatggagtggggatatttggggatggcaatgtatatggtaatctttcacagaaaatatatttgcaccaggtctattgaatgagaaggattttttccaggcgaactactcattaaaggatctgttccaggacgtgacagcagcctgattatagatgtggtcatgaaaggaatctaattgcgttccaaggatggtgagatttccagtgtagatgaagcacgtgcttcatccacaaaccctatatgggtttgacttaggtgaggaataattagaccacagcctttcaatagaggtggagaccagattgtgaagggtagtgtgttctaagctgaggagttgcaagttttgaattttgtttcataatatcagtgttatataatattgttgtgaaaatgtgatcatttgtaaagaagtcacaatttttaatatgacacataattacgcaaatgtagtagtacttcccataaaatttcagatactctatcataagtctatcaatgtgattttctgcacctgtttctgctgttccttttgcttcaaatgactttcttctgaaaaagtgaggccctcagaattagccagctattgaacataatcattatcaagcaactactatgtgttaaatttgtcctaaaattctcataatgaaccttcaagtttggtatgacttcctgctttatagatagacaaactgaagaacagtgaggtctgaattttctcattgccacgtagtgagtagcaatttctcagctgagaaattgtgaaaatgactgcctaaaactgtttggggacacatgtaagtaagagttggattcaaatacaagtttctaccgattcctaaatatacaatcatggcgcaactgaaactggatcattttcctgctaaaaaaaaatcctcaagataatgagagtagcattatcaaactattcatttagcttctctttgaggaagagaccatggcagagcaaacagtatggtgccattgtaataaatggtccaggtagtggaaatgcagaggagtgaataagtggcattatggggtaaatggcaaagagtctatctactccaataaattgtaatggtttttagatagaggcatgatttaatcattttatcattgccttttataaatattaagtatcattaatatttggagaatcaatgtataggttgtcatgttggagattgtattagtttgttttcacactgctgataaagacatacccaagactggggcaattccaaaagacagaggtttaatggagaactcacagttccacatggctggggaggcctcaaaatcacggtggaaggcagaaggcacatcttacttctcaataggtgagagagagaatgagagagaagtgaaagcggaaaccccttataaaaccatcagttcttgtgagacctattcactaccatgagaacagtctgggggaaaccatctccatgattcatttatctcccacaacatgtgggaattatgggagctacaagacgagatttgggtagggacccagagccaaaccatatcagagatttaccatctagtctttgcataaggttactgtgtttgtattctacagaattgggagtcaaccattggttatgaggtgggacaagcctggctttaagttaggatgcctgcatttgtgtcctgacaaaagaattctagttgtgtggctggcccagggcaagttacttgaccctttgttactctttctatacctcttacactggggtcctagcattgctgaaagcatgctgctgcatacaagataacacaaaagcaggaaaggaattttactgtactccatggtttcaggaaaatatgatttctatataaacaatcctgactatattattaactagaagacaaaaataatttttaaaatagaaatataaaacttcaaatatattctatactaatacataacagggtttatgaatatccaagattccaagtgagtgttcactctttttgccatggagataactttggtagaaatgtttgagaagcagtgatcatttaagtgactctcagtttggttaagtggcaatgatgttgatacaaacattctgagtattttgcaaggacaaattagatcatgagtttgaaatggttttgaaaattctaaagagtataatgtataagagtttactaaggtattgttattatgcataacaaaaagataaatctctgttatatcaaaatgtgttaatcaatcataactcaataaaagtacctagggtggccaggatagcaaaccatctgcaggttcttgaggaagatacatgaaagatacatgattctgttgtttgtttcctcctattgtcttaaccttccaagagaacgaattgtgtctgttttacttgctgtcatattcccaattcctagaacggtgtctgacacagcaaatcaacatttgctgaaaagtgaatttataaagagactctcagtgcagtcatttttcttattaatgagtacattggcccccatctgtaatttatcctaataagctgggctcaaccagggatgaactgccagaatctttttatttgtaatctggcaccctgagtggcattaaagataccagcagtattaaagattttaaaaacgtaatatgaaagattgccaaaggtggacactaaagtgttaagaacagattttaatccctaataaattattgcaatagggaagagggcccaatgtaaacagaaatgaacttcaatttgtgcagaaatgactgggtgttttagagggtgaataaaagagtggaaaaagagtgaggcaggggcttcaacatgagtcaggaaagtggaatttacaaaaagctgaaagggtaggtttttcccatgaagcccatctgaatttgttaagtggcacttagggaagttagactcaactcctccacagagactaggagaggggtcctattttcaagtgttggctgaaataaacagtaaattattttggcagcctttaccttttccaggcagaaacttttggggtttggaattcccatcctagtgatgtgaccttgagtcattagaaaaaatgttagtgtttgagttcattgtagattctggatattagccctttgtcagatgagtaggttgcaaaaattttctcccattttgtaggttgcctgttcactctgatggtagtttcttttgctgtgcagaagctctttattttaattaggtcccgtttgtcaattttggcttttgttgccattgcttttggtgttttagacctgaagtccttgcccgtgcctatgtcctgaatggtaatacctaggttttcttctagggtttttatgcttttaggtctaatgtttaagtctttaatccatcttgaattcatttttgtataaggtgtaaggaagggatccagtttcagctttctacatatggctagccagttttcccagcaccatttattaaatagggaatcctttccccattgcttgtttttcttaggtttgtcaaagatcagatagttgtagatatgaggcattatttctgagggctctgttctgttccattgatctatatgtctgttttggtaccagtaccatgctgttttggttactgtagccttgtagtgtagtttgaagtcaggtagcgtgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacgatgttgattcttcctacccatgagcatggaatgttcttccatttggttttatcctcttttatttcatggagcagtggtttgtagttctccttgaacaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttggactgagaccatagggttttctacatatacaatcatgtcatctgcaaacagggacaatttgacttcctcttttcctaattgaataccctttatttcattctcctgcctaattgccttggccagaatttccaacactatgttgaataggaatggtgagagaaggcatccctgtcttgtgccagttttcaaagggaatgcttccagtttttgcccattcagtatgatattggctgtaaggacatgaacagacacttctcaaaagaagacatttatgcagccaaaaaacacatgaaaaaatgctcaccatcactggccatcagagaaatgcaaatcaaaaccgcaatgagataccatctcacaccagttagaatggcaatcattaaaaagtcagcaaacaacaggtgctggaaaggatgtggagaaataggaacacttttacactgttggtgggactgtaaaccagttcaaccattgtggaagtcagtgtggtgattcctcagggatctagaactagaaataccatttgacccagccatcccattactgggtatatacccaaaggaccataaatcatgctgctttaaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcactctctggggactgttgtggggtggggggaggggggagggatagcattaggagatatacctaatgctaaatgacgagttaatgggtacagcacaccagcattgcacatgtatacatatgtaactaacctgcacattgtgcacatgtaccctaaaacttaaagtataataataataataaaaaagttaatgtttgtttgagtcttttaatgagggttggtgaatggagtagacaaaatcatttatcagagagtctgctcagaggagtctgactagtgttcagtcatggataggatctttgttagtgacctactttggttttccttggaaaccaacttagtttggcttatatgattttacctcccttagggtaagaaacacagaaaaaaaagacaaatttaaaataaagagaatttgatcctccaaagtctagagcagtggactcaagtctcctactctgtgcttccttttcccttgtccccagaaaagccttacagatcttttcagagaatcttcctttcaaattagggggcagccccagagctattttaccgaaccagttgtttgtttagcattttatagaagaaatatgaagagaggatcaagattcaaagggataaaatcttccaagaaaagacaccatgagatcaaataaagcttcattaattagcttgtttttcttctctgcagatgctgcccttcttggaatggtggttcaaattactgtccttgatcaatgtcttaactcccctactagggcatagtttttggaaaagccttgacttccccttagaagtttggaactacaatacacagggcagtgaaaggaaataataaataatatgcatgaaaggacttggaattcttagctcctgtaatctgaccctcctttgtttacattaaaacctggtttgagaattgctgtattgacaatgtttttagacctttgacttctgtgtaaattgcagaatgcttcttgtagtgaatgaaattactttgtaacctccctgtgactaagacctttccttggcacagaagagagaagaaataattcctcatctgagaacttgcttgagagaatgatctgtcaaaatagagagttagttttggttttcaccttggctggattccccatgtgtatttgtcaccgaggattacattgccaaggcttcagtgcagacaggaaaaacatacttcttcctttgttgcttcctctcattggcacttgcttgtaaatactcattaagggagagcagaaatgtttcaataattatggaatgtccaagagaactgtttaattctaagaaatgcatttgttatcccaaaactagttctttccttcacctctaacctgctcttattctgtcaccactcatattctaaaacttgaattacaagctcagccttacagaggtgaaaagtaatcatatcaaattggaaatggacaagatcttagaaaacattttatatagctcctaaattttaccaaagagaagcctggggccatccaaaagcaagggttctttttcaaccacagctccaccaaatctaaacttaacaaatgtttatgcatttcttattaggtgaaagacactgtaaaagctgctatgagagacataaagataagaccagaatcttacaaatgtgaatgggtaaggaagatagaaaagatagaatgcttacagctaagcatacaagaaaacataaagccaacataggcagcataaaattaaaatacagggaaagtaattcttttcagcaaaggatgaaattttgttaaagacattaaacaatataatggctataacaatacagtgtgtatagctgggtattagtcatttagtagactgcagcaataatacaaaccaccctcctactcataagcagatatgtaaaaacatataaatcgtgggttgttgacatcaatactgtagcctctgtgcagtaaaactctgtttaaacagcaagtatttcagtatttatggattttttatttattctctctgctggtcagaactgtattgattttaagcagatttaatcactggttaaagaagtatgacttgttcatagcagaaagtaaaccaacttgattaatttagaagaaacttttcttcgtctacagtaaaacacctaaatttgtacatcctataaataaaatgtaattagtgaccaaagcaagttcatggagtgtaagaaaattatgtttttcaacatgtttcacttaacatcagattaaggctcagagaaagcttttaatgttaacatttctgggtatggctagccaatgtactaatcaaaaccatgtgaattcatgtgagaatcagaattcacgtggaaatccttggcaaatcgatgaatgtgtgggctggttgcatcataagagatcaggagtggtggtacagatttgagtatatttgagtatctgtcctgaagagatgggagagtgaaattcattaaatgagattaaatgtatgagagaaaaattatagaaacaataggaacaagaccaacaataatagtgactaatcatttttgagcaattattacatgacaagcatatcgttatgtatttacccaaatgattctatggagtatatttttatctacatttttctacataatgggaccaagactcagagatgttaggtaaatttttagagtcgtacaactaataaattgcagggatggactgggacagagttgactcacttgtccctatggggctggaactttctcagttttagcactgaaagtcagctatctcaggaactccctcagtgccaggcaaactggtatccgcagtttctggattacaaaggttaagctttcaattggtatgctatacttcttccactaaggagaaagagaaacaaggaccagacgtggaaacttaggatatacaaatatttttttaaaatgagagacaactataaagtcaatacttacagggccatatctggcttctttgcccattgtatctccagcacttagcagtgtatctggcatagagtagatgttaatggcatagagtagatgttaaataaatatgcagggaattcatttattcattgatgagtactagtgactagataatgaagagataataggatgaagagggcaatattatattccagaagggtcacagagagagctcttagactgaaataatcaataacaatatttgttataatactttttaagcaagggtgatgattttgcaaactagtggttatgagagacttcaagatttagccttcgagaagagggtcccacggaagcttgcacacattcaggagagaatgaaaatgagtaaatgcggatagttgctaattgtagatactaggaaataaaatctggatcaaggaaatagtgagccaaaacagtgttatatttttcctttgtcaaaagagagtctccttaattaaaagaaaggggaagagtcattgcagagtaagaaaattatacaccaaacaagggaacaccataggaaagggtttcttcctgactcaggaaaggtttggggctggaacagtgagtgaagagttaatgctaaaggggtattgaaaattcttcctaaaagatacatagcagcatctcaaatagatgaagctatctctaacttatctcttcctttagtctttgtcttttcaggctgaacatcctgtgttttgccaaagtgagatgagtttgagctcctcatcacgctaatggatctcttctgatgtgttctaactgtgtcaacctcattcttcatagtctgtgtgctaaagggaacacaatatccaagtgtggtatggccagcacatgatagagcatggctgccaccgcttagcctggatttgaaatttattgtgcaggttaaaatttcattagccttttattttgcaagttacatcagacttcagattcgctacttattttacttattttgctaacgtgtagtgtgtatattttcccccataattttctctctgccactgtaaaaaaagcaatactgctttagatattggagagggatctgttctctagactgtctgtcattaatgaacccccaagctctgttctcatttctgagccactcataatgatttccaggtaggaacacacacacacagctgtatattcaaacgctgggtaaacttttgtttctgacacatcacctgttttgagtttgaaaataagactagatgtgctgtcaaagttattcaagaaagaggaatatggggtaatgaaaaagttcactgctttgacctgttaccaaactgttggtaaaatgtttactttgatttctgaaatcaacctgtagaagtattagctcctgaggcaagtactaatacagtggttatgctattaaaaatttctgcagagccatttggcttgaagggtaggaaaattgtttgcagctagtttaggattggtttgattgctgctgttataaacatctctgaattctattttcttacatgcccaagtaacctaaaaacctcacatcaaagatgaaagcagattgacttggcacaactagattgttttaaagagcaaaactgagtacaataataacagctttcagaaattgtgaaaatgttaatgcaagaaaattagttctaatgcaagcttagccatggaattttattgaaaaaatatttcattcgagcatgaagcatttaaataatgaatttataagaagaaacacagagagatcacagccagccattatttacaataagaaaaacaagtacattctaatgataatagatttgagtacgaaatactcaaatacttcgtgtaatttttctttcattgcctgtttgtcattgggaggcctgtctgatgatttgggtaagtctcacgggtgaataactttgtgtttgctcagcagagaacaacagttgcaatatgtaaatagggtgcctcttcccgttggctgccttgggatatgtataatagattaagttggctttgtgcagagcaaacaggtctgtattactaagaatatgaataatgttggtttccataattgctaacatctggctttccataaatctgctaaattgcatggaaacagaattagatttctgtgtcataagtaaagcaattacatggaactctgtaggcaatatggtcctatattcaactgtgaaatcttttcattctggagaagtgaaagcaaatcctggttttgcgccctgcttttattgtgcacaataggtatgtttatctttatgctcagccttcttaatttatgagagaaaatcactaccaatatatttgcaactttgtaaatgcaaaataaccaaatattttaaaagcataatatagctgggcattagttgtcaatgtagatattttttagagaaagccataaattaccaacccttttgtagccactggtggtggatgggttgaagttatacttccagacaatttctggagccatttgttaatgcttcctctgcccttgttctcaagcatttgacagaaaataaaagttttttcctggggaaggggcagggcattgccccttcttcaatgtggttgctaatttgctgtattttttctactttaaattagacccaagggccttcacagatgagaactcaacaacaaaatgtgttccctgaagggcagggttgtgattatgccttatgcttgttgaacactctaaagaccgagttttggcaaagtaggcattataatagtctcagtctgtggatttcctaagaaagttaaatggaataaatacatcgaatatccatatagtattctgttatactcagcactgggaagagaaagaaaaataaaatttagtgtctgccctcaatgagctcactctctctggaggtagacaagttaaacacgtaactcctgagagaggaatgcaggatagaattgtgtataaggtacagagaaagcaaaaaatctgtagtgactgtcttgccatataagagatggtgaggcttaacctgaatttttaagactgcgtaggagtgaaagtagtacaggaaggaaagtgcttatcaattaattgattgatacctcacctcattccctataggacaagaaaaagtagggaaagagagagagtactctcataataaaagaaagcatgttctaagacacagttgtttcataggaaacaatatggcctctttgtggatctcccgttgctttttaaaaaaaaatcagttgacaaatacattttatatatatttatggtgtacaacatgatgttttgaaataggaatacattctggaatggctaaataatcaagctacataatatatatatatatattaccttatacacttacttttttgtgacaaaaatattctcaattttcaagcatacaataccttgttattaactacagtcatcatgtttgacaatagagcttcttgaatttattccttctatttaactgaaattttgtattcactgcttttgaatgaaaagggaggggacaagagataacaattgcagtattagatggcatttatatgctatgctgggtttaaaatttttggaagaccatacattgagtgggtatagtgtatatagaagataaatgagagaaaaacaaagtaacatgtcaaagaatatataactgttacgtgtaaaatgactaatacatggtaagcactcaactaaaaagtaagagcttggtttcaaacattggtcaccagactcccacatttaaaactccttttagttgagaagaataagagaattgaaagaagattgaagagataagagaggctatatgaaaggagcaccatatgttcaaatagaaatacactgagaatgggatgggcatgactagtaacagtgaggagatatagtgaggcttgattttagttgacttaccatacaggcatcataatttgggatcttttctataattttcaaaggagaaatcattgttcactaatgaaatgtcttgactaaagctaaaattggtaagacaaagccaaaaattagatcttggaaaaaagtaacttctagaaatattattagaatttcttaatgtcatctgctttgtattgcaccatgtgcaaagaaacttgtgcatagcaggtaaaccaaaaccaagtagactagtagacacttattcaatggcctcagacactaagtatcagtacttctacaaatgagtagaagttactcggtagtatatttcatctcaatttaagggagacatttccaaaagagttatccaaaggtggagtcaggtattttgcaaggtaatggattgccttttggggaaggacttaagccagggttggacaggtttgtgtttgagatgttgttaaggtcgctcaagctttaaatgtcagaatcggccgactggatttatgtttttattccattgttggctgtcaataaagagcaggacaatatatttatgtctttcatcagcatccatccatatagcaattattttttatgcacgggcaaatattctgctggccataaggatagtaagactttgactataaaagacacctatcaagaattgttcccacttccttcaactttggtggtaggatctaggagcaatctgattgtctcaaggttgcccaaattgcccacttgttcctactcagtggctaatacattcacatcttttctaaaagactcagatctccatggtggtgtgtgcatactgttaatgaattaacagtgtttatggcctctggatgaaatcgttcttaagaatatcctaaaagaacttgctaactgctactggatattttagtaattagagtctgggagctagctgtagatttgggtctcagatcagccacttactagctctatgacagtggtcatgttatttaagttatgaacctcagcttcattatttgcagaataggaataaggacagatctcccacacagagcagaactgacttgcagtgtaaatgagataatacatgtgaacagcttggcagtacctagcacaaggtaaatggtcgatgatgttagttaatgctactgcaaatgatggttgtttgttctctaagttcccttggctagattctaagcttctgtgcttcctatattgcagacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggtgaggctgatgtggtgcagcagaaattgaaactgttctttctcttcttccctcacttttctacctccccagctctctccctcttgctgttgactgtagttcctgaacaggcttctcctgttcttatctacattacagctaatgatgatgctaaggggtagggaagcctgctttgaattgattgtgttcttagtggaaagtgaggtatgagattgagaaggaactgcagggaaggcgaagcagggtagaaaagccaatgatagtcctcccactgaaagcctacagtgcttttaaggttggttgggtgagagttttaatgagccctcatcccacgcttatacaaacttgctgattaaaactactctttgcctaaaataaccacctgcatgaacttgctcactttatgacatcatctagaaaagcaaggccaacagacttgcatccagtgctgagacaggtggattttcattttgaacaaatgataatgatagtatgaggcctcttagaaattgatgtcttctttgttattctcagtgctgggccattccttatattaagttgttggaaagtgagcttaatgcttatgaaaataaaattctgtcatcatttggttttgctttatgctttgcaaaatgggtctattaaactgtttgatctctttgtgctttatttcttcttttattgatcttgcctatttattttcctttgttattgctctactgtagctcttgcctggtatgtctatgtctgttgggatgggactatttaatcttgagctttatgtgcatgggaaccaagataaattacttgcttagtagcctcttagccaagtctcctgataaattcccagtctgctgaaacagagctgaaatgagccttaagaaatcatccagttcatccacttgccttcatctgccacacatccacagacctggggccacctagttaggagggccacattatcaagtgctagatcattacccccaacacctattttttcccctttcacataaacctagtttcccacactccaatctaggtttgttttcccttattggagcacctgctatatttcagccaccctataattcaaaaaagctgcatcatgtttacttcttacagcactactttgaaagacaatgaaactgaatttccatgggataaagtaacttgccctaaatgttaaagatataaatgtctaagctgtgacttgaactccacttgcttggctcaaagttcatagtttttccatcttgtcagatgtcttgtaacactctacgatgatatttattggtatatttaaaaccagttaggtaactggtaatctaacttgactgagctcagactttcaactcagacttttgactttcaactagattccatgtacttccttgtatgtaagtgactggtgagacattccttcaaggggttttgaagttattaagtataatatttaaccacatggtgctgactcaaagggcaaaaatttttaagagaagacaaatctcattgtgggttagaatatttccataattcctcatggaagaggatggtaattaggtctcccattcagccagcagaatgggggtgaattctttgctaggtcatttcaagaaactattgtgttattaaacttttgaggatgatcattacatatcctcacatcctttttgggctttctaggtccccagtccctggaataggcaaaggacattagtggagtcttgattagtatgagagtaaaattcttctttcagtttttgttttatttaagccatgatgaagcagggaacttactaatcattgaaaatttcccagagcttctttaattaactgtattaataatccaagcaacgtatattgatttcttctgttttgaatcctgaagtgtttccaaagtcttatgagaattagactgaaatttccacaggggatgagcaattcttgtaatctaattttgttaatatgatgcaccttcactgcaaagcactgcaatttctgaataaagtacaggcagatttctgtacataaatcttttgtttgtttgtgttctacatgtactcattgcccatttatagcacagtttcccagaggttgtggagggggaagacagcctggtttaggagctgaattaagcatcctaaatcagattctgtaagtcaccattataaaatgaactgtttgtggccctccttgtttctattatttgaagttgaaaatgctctgtttcaattcaatttgataagaaatacctccaatacttacacatccaaatgggtgactataatggcatcatcttggaagctaagtaataaaatcaaggttgggatataaagtactatcttttcaatcatatccttgatgtttcagatttaaatgccgtcaaattatgcaacagcagaattacacaaaccaacaaaaggtcaagacttactgctgaaggaaatagagttaaaatttttaaaaggctactttcccctttgagagtcagtacaccagcttagctgctagtgtttcatggtaattgataaaaaggccttgaaacatgtccacagatgaatagagttcaatgatgaagctaggctagcataaatggatttgggcttttgtttagattctatgtacttccttggcagtgacaatgtttttgtgcatctttagacacctagttaattaggtacagaaagattgctgcacagcttaaaacttatgtccctccagcattatttagaccacaggaacccagatgaaaagtggttgtctctctgggattgatccataaatcttggttacagcccagcgtcttttcatagatacccatctgtggctcttccattcataaatttgtctaggactttaggaagacatctttattttcagcctgtgctacatgggaaggtagagacgtccccagcttattcgtttctaggaaatgtagtattttagtgtgagtagttgtgtttatgttgcagatcatggagatgaagatgaaaatggatacacaaacaactaaccacttgtcatatatggtagagctatgaacaatttgctgtgggaacacagaaaggggaagcatagtctgccctctgtatttgttggttccacattcttggattcaaccaaccccagatcaaaagtatttaaaaaacaaagataatgcaaatttaaattaaaaatataaatatttcatttttaccctattaggtattattagtaatctagagatgatttaaagtatatgggaggatatgcataggtggtttgcaatactatgcagttatatgcaaatactatgccattttataagggacttgaacatctgcagatcctggtatctgtgcagaggtccttgaaccaatcccccagagatactgagggacgactgaatgctctactctgggaagatgcagaagtgaatacggaaagcctttcacagaggaggtgatctttgaaggggcccttaaaggatgaggaatttaatcaagtagagatgtaggggaaggtgaatcccaaacaagagggaactgtaagaacaaagatgaggaagtgtaagaatatatgttgtgttagaaatatgaagtgaatcatgagctcaaaatatcaggaacaaaaagagtataagaagggtatagtcactgatgagccaggagattatgatgagccaggagattaaggctgaagacagagccaggccacgggatttagacttcatcctgtgggcagcaaatgatcgtaagagattttacgtttggaattggcagggcccagtcaaggtctgattgacagcatgatggatgacctgagcagatagaagctaactagaaagaaatcacttaggctgaggtaaaggttcagaggagtaaagatgaaaacctgaaagagggatagagaagtaacatctaatgggagaaaatgcagaagtgaaaaatgggtcctgatgactgatgatgctagagacttagtgtctgtggtaatgtcttccctattctctgggcaaaaaaaagctcctgagtagcatgtttgagacatagctgcccattttctcaggtgaacaggattcaggtgccattacataagagtaagaaccagggtctgcaagttgggcttgtatactactacatctatacctacatgtacacttatacctatactattttgagtagtaactggataatctagtgggaggaagagagcgaactatgaaggccagatagtgtttctatgatttcttgcagttaaaaaatgtgagtagccttcatcgtgaaaacaaagtaatactaaagacttgagcagtgttagttcttgagtttttctggggtttagagatgagtagggaaagggataccataaatagccagtatttatggtataacagtattccatgttataataaagtcagggatgaattaccgtggaaaggaaagtcaaagtgaagaagacctttttcatgagattgtctggaatcatggccatctgatctggtttatgtaaacctattcccagaaactgaagatggtcatgccagcgacactctcaagaactcatgtatctctttctggcaaggaggaaagaatctgatccacaaggagcagtcagcatactggttctgccttcctaagaataggacttactcacaggaagaagccagggaacagtctggtctgtgcctggggccaggatagaagcaaactttctgaattccagcaaactgctcataaaaatgctttgccttgctctttgaacccaactagcagcattataaatattttcctgtctgtggtggttttgatggttggagttagctgtgcaagctgtaagattgtgtttcttttccttggaaagaggaacttattggtaggtttcatttggcactcaaaactctaggggtcctgtaaaggaacagggcgtctctttctatttccctgactctttcccctgtggtagtgttcaaaaccctgttttgaccttgcaggagcttgaacgttacaccatgctacctccccatctgactgggtgatgttttttctccatgattttgaagctttgcaccagaatcacctgcagggcttgtgaaactttgatcactggctctaccctcagtattttctggttcagtagatctggggtggggtgcaagaatttgcatttttcagtagttcccaggagatggtaatgctgctggtttgaggactgccactttgaaaacttttgccccaagaatacttctgatatcactttatctaaaattagtttttcctatcccctagcctcctcacgatacaaaaggtgcatcacagtggaaaatcattgttatgaaagttcaggttagggataagtttctgttttgttattagttttctacatggaaaaggcatttgcctctctgggcttggtttcctcttcattaaaatgagataactggataaaatgactgctaaatgtgtttctaccccaggtgttaggactaagagaccagtttgtgggctgtgacctgaaggcaaaattaatactttgtaaaaagattggaaatcacagctcaatttgtgtgtgagaaagtagaataggtgcgtctagattaccaaccctaatttcatagtctatatcaggcatcagcaaggtttttttctttaaagagtcatgttgtaaatatttcatgttttgtagaccataaagcttctgtcccaaatactcaattctgccattgcagtgtgaaaaagacccacagacaaaatgtaaatgaacaagggaacttgtgttccaataacacttcatttacaaaaacaggcatcaggttgaatttgtaccgtgggcatccgttttccaacccaaagtttatattactgttttacagaaataatctgacctacgtccaccttcttgatttaaaagtttcaaaactctatggcagaaaaaaaatgagtgatattatgtaatctggagtaaatatatcagtatttactgatatattgactgaaatactgaaatattactgaaatactgactattccatattaaaatttgtaattaatagcaaaaaacctataatatttttatggcataagaaaaaatgtattttttttaccagataggaaactttatttccctgctttttaaaattcagaagcaatttaaatattagaataattattaattgcttatcattgaacttgcagtataaaattgcatcaaaacagcttctgtggcagaagattgcaaaaatacatctttggcatataagtagggattgttcaaaccacccaagttaggatagagatcaagctctggaaacagcctcaaagatctctgataaaaggattacttatcatcagtgagctccatactctccccaaatttagtttctagtgtgattgtgctctgtgagctgatgttttataatggcattctcattgtattaatggagtcacctgtgacattttcattattaaaaatgattttcttgacagttaccctgtaattcaaaggcaaagtgaacattgccattgttctgaaacacgttagaagctaagaggggcctatttggcattttcacataattgatgagatatgaaattgctttattttgcactaaccctggaggctatccatttattcttattcattcttttaatcagcacataggaagaaaactgacattcttattgagtctcatagcctgttgtgcagcgaccttttctgaaagaatttatccttttgtttgatgccagccacagacacagacatgctggttcctaaggcatgatccttctacacttgggaagagtgatagtgtgccattggaagctgagctgatcaaatggttttgtgttgtagctatcattactttgcttagtttttgttggttaaagtaagtcttcagggagtcatttggggccatggtgacacaagcaaaatatattactgagttaaaataatggtatatgagctgtaaaccaaaggcctattgttgggaaattcctaggatcaggacacttccttgtcctgactagctggattctctgattgaattcacttgctaaaatatagagtctcttgcttgctctctatatacacatgtttgcatacacatgcaaatgtatatgtgtgtgtgtataatctttcatctcttgatatttttggaacactatgatttcttgttatttgtatagtaaaagagccaatgcacacgatacatttttcaacctgttgttatatatgtagctggcatgtctcctttccattctccttaaagaatataaagcttttaaggtttccactttagctgacacaaaacatctcagcaagtcctgtctgattattcagcgttgttgtggataaagtagataaagaccctgagggcaagtccatcaagttttcagatgtcactaagctgtgaaggacggtgagctatagtaaatgacataaataacatttgcaaagcattgtgacaggaagaagagatgaaatagatctaacaatatgaaatgcaacagagataaacatcaagttgtatacttgctgcccctaaacagccaactgcccaagatgagataaggcttaatgaggttttagtcttcattaagctcaatattagccaacactatggcatagtcaaagaagtaaatacagtcatgcatcacttaatgacagggatacattctaagaaatgagtcattaggctttttcatcactgtatcaacatcatagagtatatttaaacaaacctagatggaatagcttgctacacacctaggctatttggtatagtctattgcttctaggctataaacctggacagcatgatactatatttagtattgtaggcaattgtaacacagtggtgagtatttgtatatccaaacgtagaaaaggtacaataacaatacatataaaagacaaaaaatggtatacctgtatagaacacttaccatgaatggagcttacgggactagcagttatggtaggtgagtcagtgagtgaatgttgggtgcatgtgaaggcctaggatattactgtgcacttctgtacctttatgaaccttgtatacttaggctacactaaattttgaaaaagattttttttcttcaataaattaaccttagcttattgtaactttttactttataaactttttaatttttgtaactttttgactcttgtgtaataacacttagtttaaaacacaaacacattgtacagcagtacaaaatactttctttatattcttattctataagctttttctaattttttaaaacttattaaacatttttttcaaaccggcacacaaaaacacaccttaacctaggtctccacagggtcaggattatcaatatcactgtctttcacctccatattttcctccatgtcttgtcccacttgaaggtcttcagggacaataacacgcacagagctatcatctcttatgataacaatgccttcttctggaatacctcctgaggacttgcctgaggctgttttagttatctcttttttttttttataagtaggaagaatacattctaaaataatgattaaaaaagatagtatactaaatacataaaccagtaacctagccatttattatcattatcaagcagtatgtactataaatgactgtaggtgtatatttttatacaactggcagctcagtaggcttgtttatacaggcatcattacaaacacatgcatgagtaatacagtgcattacataatggctgcgatgtcactaggtgacaggaatttttcagcttcattaaaattatataagaccaccttttgtatgtgtagtatgtcagtgaccaaaatttcattgtgtggcacatgactttattgaaaaaaaagcctgcattaaagaaactacaacacttaaaacaaggtgagcattaaattcaattcactctttcttcaaagaccattgctgaataattctatttagttctctctcagctacctcatttgagaaatagagagatacattcgcattccacaaattatcaggattaaatgtgatcatgcatgtaaatgcctctgcacaatgcatgacacaagataagtattaaatacatggtagaatatgatgatgatgatgatgatgatgatgatgatgatgatatatacttaaaaccattgaaagagaaggcaactatgacagtgaaaggattataaatgatggggactggtcaagaagttagaggtgtttacccagagatgaaacatctcagtgagtacataagagctgtcttctaaaaactgaagaattgaaacatgacaaagtgtttggagttctgttattactgaaggtatggattcgggtcaatggatagaagtaatgagaagtctgattttttacattataacatgtacagagatgcacactgaattctctccatagtgatgaatccaagactgagagcctcaagcacttcagcagttgaatatgacctcaactgtaggtcaggaggcttggttatatgttctttaaggtaacttgcagccctgagactctttggttttttaaaatattcagcaaattagttattagcatgaatggtgatgacagacaggtcttaccttaaattttcagcaatgaagaacattgtttaagaaattactgtaagcaacagacataaaaaaaagacatgctgcaaaatgtttactcttactgcttaagtgctgctgactttcaattttttatagctatgaatcctcaaagacaatacttcaaaaattgtactgtgcttacaatatggggaactgccataaggtggaaagaggcaccttattatacacccctgtagtacacaactttaaggcgatcttgccaaagaatattttgagaccataacaattggtggtgctgcttggagaaccactacctaactatgtcatcttggataagtggtttagcctctctgggtctacgttaattttctgtataaagggcataatcagacttcctttcacggttgggacagggatatagttagatgaatgtatttgaatatgttaagtggtagcatggaaatacaggagcatgattttccactcaaatgacttattgatcatatatgcatttttagctgcttacttataattcttacttagaaatacgatttttaagaacccctttgaaaaagattttcaaaaaacatgttgactttttgttaaacttaaaaatgttcctatttttattttttctgctctgcaagcaaaatcagggaaagaaagggtgtgtttgtgtgaacacacatgtgtgcttcagttttgaacagaatgagaggtggccagggggtgaccaaacatccaagaagttcatttctcttagtgtagctgtccatcatgtcctaaatgatgaaacctccttaacttcatttctaaacaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggtatgttggcttcctttataaggtgttgagcctttactctgaaagaggttacaaattcagttgtctgtgggacctagttcccagtttttcataatactatacagggagctctgtggggcctgtggctaagggtcatgttctcttcctaaagatattcaggttgtatttgaaatactgtacaaagtaaaaagcacatatttatgggacagatttgacccaaacaatgacagtttacagctattactaaaaagaaatcaagatcaagaaaaatctctgcaagaaaggaagctttcaaaaccttgactagtgcttgtagtcctgacagagctaaatctctcatttctgtgccataacccttaaagatttcaatataagaggtaacaaaacatagtagaaatatcagagatttaatcatagagacctagaatctaaatgtggtcctcccacatactagcttaaaatgattaccttgggcaagtcctagcattttactgactattctggccctcaagtggacacaggtatgtgagtacctctgagggaaagaatgggctgttacaaagattacaagatatgtaagaaggacaaatacagtacttggcttagagaaggtacttagtgtatggtagtaactattgttaatacttcctaccttgaaaaatcttttcagatactacatgtttaaaaaggaaaaaatgaaggttgttataaatattaatatagggctactaatggtataattagatttgagaaagtccagagaaaaggcttaatttcttgacctggttctttcagtttcaaattatatcacaaagatttctagcagtgggaagacttctaggacacattgtcatggaatgtgatgtcccatatgtaaagtcacaactatggaacattctgagttgattggtaatggaaactattagctgtgtgtccgtaatttaacatttgctgacatgaatgattctcattttatgggtactgtatgaaaacaagtattcagataaattatgctctaaatttccatcagatttttttaaatcttcaggtgaatgtgcagataatcttaacagaatatgtctttcttaatcactcctatgactgagaagcatgactcagataaataaaaattgtagtcattttttaaaactcccacccaaggacaaaaaaagtcaatacaactgtagaattagtttccctatgagactggcaaattgcatttcttttccaagaagctaatcatcaggcatccagaagaattagtattaatttgatgcatgaaattttcatagatagaatttcaaaagtgtatcctcttccatcctagcccctaagatgaatatttctcaggaaaattgaagctgttaaacacataacttatgaattacttgagaatactgtgggtcatacttaataaatattcaagacttttcatgtgccaaactttgtatgacgtaacagtgagcaagataaacatggcctatacctacacaaagcccacagtcttatggagatgactgaacaattaaataagttgccatatattgtaaggtattatgccatagattataattcatgatagcagaggaagaggatgcatagtgaaatagttttattgtgggcagctcaatgaagccacagatgccagatgctgagacacacaaaagctccatttgaactgcaatctagaaagttcagtggtcacatgttatattcaaaaccattctgaaatggttatcttgacattgcccaatcttaactttaaatttgattgaaatattacagtgcttcaggttctgcttttgaacttaagagaaattaattgctctttatatactagacagtaccttataatttatttattagcctttattgaccaaaactgtgctaaacatgatggagagaaagtaacaagcagaaagtctgaaagctcaaaacttaatgtggaattgtgctaattatgatataagtatcatgttaaaataattataggctgtgcttggcacacaaagaagctcacctagctctttctatgtcctgcagtatagatgatcagcaaaagcattctgaaagaagtgagacctgtagtaggtcttcaaggaggaagtgtactttatcctcaatggtgtcaactagaaatattcagtgatgagaattactgtgctctctttccccttctatgactttgggaataaaattatgcataggaacaataatgagacattttttgcttttcctctacaggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaaggtaattggatgttctgcggatattgaagccttgaacaattgccagagaacacttgcaggaggtccactcctgatgtttctgaatacacaggttcaatggacatggtggaaactctggcatacatttacttctcataggaatttaatatgtatgaatattatcatagctgcaccctgtaaaaaggcaaattccaaatgagcatgaaataaaagaattgctcctgcctttgaactacataattttgacaagtgattcttggcttaattatgactaacttaggctcttttgacatgcatattaaataaaaagaaaagaaagaaagggaaagaacaaggaagggaagtagaaagaaaagaaggaaggaagggagggagggaaagagggaggaaggaaggaaaccagtcaacttcctttcatcctggaaaagtttctaagttcttttattaaactgtcaatgttaggggaaaaaagtcctctcaagttgttttgctttgtttaattatcagagtgcctaaggtggggacctgcagctcttgctacagcatttcattaacagtgattatttccctgtctttttggaggggttttcatgagacatcctcatgtgtcattaagactaaaaaactgaccattctctcccttcaaagctcatgaagagctggagtggtagctgatttggaacaatcattagttagtgtcaaatatctgccaaaatatctgtttaagattcccatgattaaacatgttaaaactaggagcctacttggtcccatcaaaccctggctcagcttcaagcatcagtggaagcttcccaacttgcctctttatgctgttataaatgtagattttttttttctgggaaagtatcatcttaagatgtagccccagtagaaaaaggatactatcagacctcatatagaaaaaggtccatggtcccatctgtaccttcagtcccagagaactaaatgaccaggacacagggagacctctgttacttatttgataattatgtggaattataaaggtatatttacattagtacataaaatttttaatgaatttataagtatttatatacctaactatgcactatccccttcatagtcaccatgagagattttatgcaaaccttactggaccccatcttggacttgcctgaagattgttgggggtactttcaaatagcttcttaaatgacaaattgctatcttttagggatttatttttggaaagaatctcgcttggaataagtacagcaaacaggtcatgtgaaaagttggaaatcccagggaggcctcccaagcagggattgagtgcaggtgatgtgtgaaattgaactgctagcagaatcccagtgagcagtaccctggagggtctgtcagtccttcctttctttctactctttctctagtttttttcctagcatttttttctagtcattttttatagccttcttgaagtttgtctcaaaatgctgaaagttgttttgagtataaaaattgcagactgctaatttatattccatgtctcaactggctaacacatgtttctttgatgtacagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaacaggctgaagccaagtatgacaaagaggggaagggccaaaaacataatcaaagaataattttaaagagaattcttgtctctcttgcaa

SEQ ID NO: 1390 - DNA, 906113 bp, Homo sapiens; identical to SEQ ID NO: 1389

SEQ ID NO: 1391 - DNA, 24272 bp, Homo sapiens
tacttacacctttctattttttattttttacatcaaacaggtaatgtgatgatgctgtaacaaggtttgagggaagcatatctgacacatgagcatgaaaccaaatcaccatgcttatggactacaaaaggacctaagccttttaaactagactgtctcaactgtgcattaattatgtatttagatataggatatgtgcttgggaaaatgtataactaaactttatgtcttacttctcaaacttaagaaaaacaaaaacatctagcaacatcttacatgagttttccattacctagtgttacatcattgttaaaatcatactctaagcctatattttaccttaatgttatctgcttcatagaatagttattcctttaacacttatttttaagaaataaatttattttacttgtagttacttaaaccctagaaataattttttcaaacagtagaagtacagccttttataataagatagttcatgatttgttctttcgaggattttttttttaataaggttcttctacaattggatggtgacaaagtttgggtttgttaggattatttttcagcagccaatcagctagccaaatctatgggaaaaaaaaaaacaacctaagttaagaaacagttacatatttcctttcaatatatactatatcaattggaaacttaaacagttttcaaaatcactttaagaaaatgaccattaaaaatggaaacatttggatttacattatgcaagattgtcaagaatagatccaaactggcaagaaagaagtaaaactatctcttttcacagatggcataaacctacatgtggaaaaccctaaggaatttacaaggaagccactacagctaataaattcagcgaagatgtaggttacaatacacaaaaatcaactgtatttctatacatcagcaatgacagtccaaaaaaaaattttaaatcactttcatttacagtagcataaagacaaataaaatgccaagggataaatttaacccaagaagcgaaaggcttatacattaagaactgtagaacattgctgaaagaaattaaagaatacctaaataaatgagaagacattatttttcatggatacggagatttgatattgttaagatgtcaatacttcccaaagcaatctacagattcagtgcagctcttgccaaatgtccaacaagtttttttgcagaaatggaaagccaatcctcaaattcatatgaaattgcaaggggctctgaggagccaaaacaatcatgaaaaagaacaaagttggaggactgatttgtactctcaatttcaaaaccttctacaaagctacagtagtcagcacagtgtggtaatgacatccttatgccagacatgcagaccaatagaatggacctgagagtccagtgctctcttcggcagcacatataccaaaactggaatgatacagagagattattagcatggctcctgtgcaaggatgatgcacaatttattaagcatttcatattttaaaaaaagaatgagaatccaggaataaacccacgcatctatggtcaacaaatttttgacaatggtaccaagcccattggtaccactggacttggagaaagaacagtctcttcaacagatggtactaggacaattggatttccacatgcaaatgaataaagttggacccctataccacaccatatacaaaaatgaactcacaatggaccaatgacctaaatataagagcttaaacaataaacatcttaaaagaggccagtgactcacacctgtgatcccaatacttttggaggccgaggtaggaagatcacttgagaccaggagttcaagaccagcctgggcaacatagggagaccccatctctacaaaaaattttaaaaattagctgggtgtggtagtgtgctcctgtggtcccagctacttggcagcctggtgcacaagaatcacttgaactcaggaggcagaggttgaagtgagccgagatggcgccaccagactccagcatggggaacaaagaccctgtctcaaaaaaaaaaaaaaaaaaaaaaggaaagaaaaaaaatcttaaaagaaaacataaaacacaggggtaaattttcatgaccttggatttggatttcacaatggattcttagacatgacatcaaaagcacaagaaataaaagaaaaaataaataaattggatttcatcaaatgaaaaatgtttatacattaaaggacattatcaagaaagtgaaaagacaacctacaaaatggaagacaatatttgcaaatcatatatctaataagggtttaacatctagaaatacaaagaactttaactcaacaaaaagacaacccagtttaaaaatgggcaaaggacttcaatttgaatagacatttcttcaaagaaggtatacaaatggccaagaagctcatgaaaagatgttcaacattagccattagggaaatgcagatcaaaaccaccgtgagaaaccattttgtgttatctactagcatggctacaaaaaaaaagaaagataggtcgggcgcggtggctcacacctgcaatcccagcactttgggaggccaaggcaggtggatcacctgaggtcaggagttcgagaccagcctggccaacatgaagaaaccctgtctctactaaaaatacaaaaattacccgggcgtggtggtgttcgcctgtaaatcccagctactcaggaggctgaggcaggagaatcacttgaacctggggggcggaggttgcagtgagcccagattgcgcctctgcattccagcctgggcaacagagtgagactccgtctcaaaaaataataataataaataaataaaacacagcaagaaaataataagtaatcaataattatacatatctaacatgtatatgaaataccttctagaaatgtttattttaaaaaggttctcaatatttgcagtatttcatttatttacttatttattttttgagatggagtctcgctctgttgcccaggctggagtgcagtggcacaatctcggctcactgcaagctccgcctcctgggttcacgccattctcctgcctcagcctcccaagtagctgggactacaggcacccaccaccacgcccggctaattttttatatttttagtagagatggggtttcaccgtgttagccaggatggtcttgatctcctgacctagtgatccacccacctcggcctcccaaagtgctgggataataggcgtgagccactgcgcccagctatattcgcagtatttcaaagacacaatgtcttaaacgtgaaaactacagacaatttatagaaaaaaaaattttttttttgagatggagtcttgctctgtcacccaggctggagtgcagtggcacaatctcggctcactgcaacctctgcctctgggttcaagtgattctcctgcctcagcctcctgagtagctgggattacaggcacatgccaccacgcccagctaatttttgtatttttagtacagacggggtttcaccatgttagtcaggctggtctcaaactcctgacctcggatccgcccgccttggcctcccaaagtgctgggattacaggcatgagccaccacgcctggtgacaatattcttaagtgtgaataaaaatatttcttaccaaaggatctgctggtttttgcttacaaagctctgtgagtccttcaagcagagttggcattatatgtaaatttaaatagtccttagcagcttgtccaattggaatgggctcaacaatcactgcaaatacaaatgtattctcattgatgcaaacataatgattaaatactatacaatcattaaaaaggttctttttaaagaacttttctctatttttttatatgtttttttgagatggagtcttactctgttgcctgggctggagtgcaatgatgcaatctcagatcactgcaacctcctcctgggttcatgtgattctcccacctcagccttccgagtagctgggactacaggtccgcatcaccacaccctgctaatttttgtatttttatttatttttattttttgagacagagtctcgctttgttgcccaggctggaatgcagtggcacaatctcagctcactgcaacctccaactcctgagttcaagtgattctcctgcctcagcctcctaagtagacaggagtgtgccaccatgcctggctaatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttatttttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacagggtcttgctccgttgcccagtctggagtgtggtggtgtgagcacagctcactgcagcctcgaactcctgggctgaagcatcctctggcttcagccttccaagtagctgggcctgcaagtgtgtgccaccacacccagctttttttttctttaagtgtttagagacagggtgtcactcacgctggtctcaaactcctggcctcaagcaatcctcccacctcagcctcctgaatagctggatttacaggtgcaaaccactgctcccagctcttttttttttttttttttttttgagacagagtctttctctgtcgccaggctggagtgcagtgccgcgatcttggctcactgcaagctccgcctcctgggttcacgccattctcctgcctcagccttctgagtagctgggactacaggtgcccgccactaattagtccggctaatttttttgtattttttagtagagacggggtttcaccatgttagccaggatggtcttgatatcctgaccttgtgagccgcctgcctcggcctcccaaagtgctgggattacaggcatgagccaccgcgcccagcctcttttcacattcttaatgatgtcctttgaagcacaaaagcttttaatttgatttagtccaatttatcaatattttcttttatggatcttgcttttgatgtcattttaagaagtctttgtccaactccagttacaaagattttcttgttttcttttagatgtttttacattgaagtctgtgatccattttgagttaatttttgtgtatgctatgaaacaagggtctaagttctttttgtttttatgtgactatcatgctgtcctagcaccatatacagactttcctcaatttacatgggttacatcccaataaacccatcataagttgaaagtatcagtaagtcaaaaacacatttaatacacctagcctattgaacatcatagcatagcatagcctactttaaatgtgctcagaacacttacattagcctacagttgggcaaaatcatctaacacaaagcaaattttatataaataacattttctatataatatacatatattatgagctgggcacagtggttcacacttgtagtcctagctccttgagaggctgaggcagtaggattacctgaagccatgagtttgagaccatctgggcaacaaagcaagactctgtctcttaaaaaaaaaagatatatatatatatcatttttgggggaggatctcttgaggccaggagttcaataccagcctgggcaatatggcgagactgcctttctacaacaaaaaaattcaaaaagtagccaggcatggtggtctatgcctctagtctcagctactcaggaggctaaggtgggagaatgcttgagcccaggaggtcaggctgtagtgggcaccactgcacttcagcctgggtgacagagagacaccctgtctcaaaaaaaaaggaaaccaaaatagaatggttgtatggatactcgccattaatgtacacagctgaaagcaccatagtaaagtcaaaaaactgtaacttgaaccatggtaagttggggactgtattggcaagaccatccttttctcactgaattgtctaggcacctttgttgaaagtgaattgaccataagtgtaaaagtttacttctagatcctcaattctgttccaataatctatatgtgtatctttatatcactgtcataccgtcttataattgtggctttgcagtaagtttcaaaatcagatagtggaagtcttccaactttgttcttcttttctaaaattgaattatttgcaattttgctaaattttaaactcagcttgtcaatgtctacgtaaaagtatgcatggacttttaaaaggattacattaaaattttctttaaattttttttttcttgtagagatgaggtctcactttgttgcccaggctggtctcctactcctagactgaagcaatccttctgcctcagcctcccaaagtgttgagattacaggaatgagccactgcacccaacccaaaactgttaattaatttagaaagaattgccatcttaacaatattgagtcttccaatccattaatatggaatatctattatttattttaaaatttatctcagcaatgttctttgtttttcagtgtacaagaattgcactttcattaaatttatgcttaaatatggccgggcgtggtggctcacacctgtaatcccagcactttgggaggccaaggcgggtggatcacctgaagtcaggagtttgagaccagcctgcccaacgtggcgaaaccctgtctctactaaaaatacaaaaaattagctgggcgtggtggtgggcgcctgtaatcccagctactcgggaggctgaagcaggagaatcgcttgaacccaggaggcagaggttgcagtgagttgagatcgggccactgcactccagcctgggtgacaagagcgaaactctgtctctaaaaaaaaaaaaaaaaaaaaaaaaaaaattgtgcctaaatattatattatttttaatgtcattgtgaatggaattttcctttttacagctttattgaagtattactcatgtacacaaaattgcacacaattaatgtatacaattttttctcaatatgggcaaatgttttattcatatattatataaagttcattatgccaatttatcaggtactaatcattaaacaaaaatttttttaatttttttttttttttgagacatggtcttgctctgttgcccaggctggagtgcagtggtgcgatctcggttcactgcaacctctgcctcctgggttcaagcaattctcctgcctcagcctcctgagtagctgggattacagatgcatgccactatgccaggctaatttttttttatttttagcagagatggggtttcactatgttggctagtctggtctcgaactcctgacctcaagtgatctgcccatgtcaggctcccaaagtgctgggattacaggcatgagccaccacccctggtcccccaaattttttttaacttataagtgtacttaaaatttctttttattttaaaagcatgtcatccttgcataggggccaagctaatcttctctgtatcgttccaattttagcatatgtgctgaagtgagcacaacaaattttttaatagataagaaatattgtatacatttattgtgtacatgttgttttgaaatatgtaaacactatggaaagacaaatcaagctaattaatatatgcattacctcaaatacttatctttttttgtggtgagaacacttaaaatctactgtcttagcaattttcaacaacacattattattaactatagtcaccatgttgaacttattcctactatcacaggaataagtatcctttgatcaacatttccatcccctactctctcttgcaagctcctggtggccaccattctactctccgagttcaagtttttttagattccacatataagtgagatcatgtgatatctgtctttctgtgcctggcttatttcacttaatataatgtcctccaggttcatccatgttgtcaaaaatgacagaatctcttcctttttaaggctgaatagtattacattgtgtatatacaccacattttctttatccattaacccactgatggacacttaggttgattccatatcttggttattgtgaataatgccacaatgaacattattgtggttcattggtgcaggtatctcttcaagatcctgattcaattctttcagatatatatatccagcagtgggattgttagatcatgtaacagttttatttttagtttcttgaggaacttccatactgtcttccatagtggcagcaccatttttaatctccaccaaatgtgtacaagcattccaatttccctatatgcttgccaatatttacctttttttcttttgataatagccatcctaacgtgtgaggtgatatctcaccgtggttttgatctgtatttccctgatgattagtgattttgagcacttttttttttttttttttttttttttttgagatggagtcttgttcttgttgcccaggctggggtgcaatggcgcgatcttggctcactgcaacctccacctcctgggttcaagtggttatcctgcctcagcctcccgagtagctgggattataggcacgtgccaccacacctggctaattttttgtattttttttttagtagagacagggcttcactttgttgaccaggttggtcttgaattcctgacctcaggtgatctgccagcctcggcctcccaaagagctgggattacaggcgtgagccaccacacccggccttaagcaccttttcatatacttgttggttatttgtatgtcttctttagaaaaatatctattcaagtcctttgcccattttttaattgggttatttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaatttttttatttttggtagagacagggtcttgccatattgcccaggctgctctcaaacttctgggctcaagcaatcctcctgcctctgcctcccaaagtgttgggattacaagtgttagccaccatgccaggctagggctgaataaattaatgagagaataaaaagagtgttttcatgtttcttacatggatgaactttaagttttttaagttttctctcatccttgttttatttatttatttgtttgtttgtttgagacagggtctcactctgttgtccaggctggagcactctggtgccatcacagctcaaacagccttaacctcctaggctccagtgatcctcccactttagcctccagagtagctgggactacagacatgggccaccatgcccagctaattttttattttttgtagagatgagatcttgctatgttgcccaggctggtctccaactcctggactcaagtgattctcccgcctcagcctcacaaagtgttggaatcacaggtgtgagccaccacacccagactgtatatttattttcaaatataatcattttgatagcagggatatcttcttattcagctttgcatttatggcaaatagtaggcaacttaataaatttgttgaagaaatggaatatagcaaaactttgaattagccatttatattaaaagggaaaagagaccagcctgggtaatgtagtgagaccccatctctacaaaaaaattaaaaaattagccgagcatggtggtacacacctgtagtcccagctactcaaggggctgaggtaggaggattgcttgaggacaagagtttaaggttgtagtgagctatgattgcaccattgcattccatctggagtgacatggagagaccctgtgaccaccccccagaaaaaagggaaagaagagagcattacttttttcttttcttttctttcagacagtctcactctgtcacccaggctggagtacagtggtacaatctcggctcactgtaacctctgcctcccaggttcaagtaattctcctgcctcagccttctgagtagctgagattacaagcgtgcgccaccacgcctggctaattttgtatttttagtagagacagggttttaccatgctggccaggctggtcttgaactcccaacttcaagtgatccatccgcttcagcctcccaaagtgttgtgatcacagttgtgagccaccacgtccagccagcattacttttttcaagggttaagaacatgcctttaaatatcttgataacttgcttgagtgaatcatcgtataaagttttgcacatagttgttcatcaactgctaagtaagaggacgctcataccacaaactctgagtacttgctccaaagaacttcacagcaaaagagctacaatgtgctaagtaattaatgattttatatttatcctacaacttgctgcttctcaaatgtctaactatatctctaaactcatgcctagcggattaatttaatgagtaaaatcaaaggcaactgaaaataacagttggctgggcacagtggcacagtggctcatgcctgtaatcccaacactttggaaggcaggtgggagtattgcttgagcccaagagttcgagactggcctgggaaacatggcaaaactccgcttctacaaaaaacttgaaaaactagccaggtgtggtggtgcacacctggggttccacctactccaaaggctgaggtgggaagattacttgagtctgcgtggtcaaggctgcggtgagctgtgattgtgccactgcactctagcctgggcaacagagtgagaatctatctcaaaaaaaaaaaaaaaaaaaaaaaaaagaaagaaagcgaaaagaaagaaaattacagtttaggaatataatcctatgagtaagaagagcttccaaatataccttctatttaagataaaatgaaattttatcctgttttatttaaaagctaaagagaagtcaggcatgatggttcatgcctataatcccaacattttgggaggtagaggcagcagtattgcttgagcccaggagttcaagaccagcctgggcaacgtagtgagatttcatgtctatagaaaatataaaaattagccgggcgtggtgatatgcgcctgtggttccagctactcaaaggctgaggtgggaggatcacttgagcccagaaggtcgaggctgccatgagtcgtgatcatgctactgcactccagcctgggtgacagactgagactccatctcaaatagataaataaataataaaagctaacgagcaaaagtctaattcacttgtaagactaatataaagtgctaccatattaaaaagacctctcgctgggcacggtagctcactcatgtaatcccagtgtttggggaggctgaggcaggaggactgctttgagaaaaaatatatatttctaaaagtggtttttgtttgtttgtttaagaatcagggacttttcagactgtacagaaaggagggaagcaggtcttcccctgggaggatgactgaaaggccagtggagaaaagttgtcagcccattgtcaggtcagcatcaggccgttaccgaccctgttggcactaaaaagtaacagatcaagtattcaaaatgtgaaatgtatttattttgaattcagaaattcaaacaacagtgatactgttgtatcacatcagttattcaaaacatgtgaaatctccaaaaaaaagaaaaaaaatatatcaggaacttttaaatctccaagacagttttctgttttatttgaatgaatatccagtggaaaatactgaggaacagatctaaatgacttagggaaaaataagtcataacaggaaaaataacatactaaaaaaatccaaaattttgctcaatgctttgcatttttttccttataacaaaaatcaccaaattttatttctgctctaaaaatattaaaaacaaaccaaaaacttcagtgttcttcctcgtatgtccacttctcaaaggtttacaacttctctaacagtaaggaaacaaaaaaagggactagttattaatttctcaattgcatgagactttgttaggcaaacagtaaattgttacagaagacggtaaatcaaatgtagtttcctagagagactatttttctcatgtgtcacaaactctactgaacctttcaggataactagaaagaactgttacacagaagaatatgtctaatgcaagagaaaagaaagaaaaaagaattaagctgggtgtggtggctcacacctgcaatcccagcactttgagaggccaaggcaggcagattacttgagcacaggcatctgagagtatgctgggcaatacggagagaccccatctctccaaaagataaaagaaaattagctgggcatggtggcatgcacctatagtctcagctacccgggaggctaaagtgggaggatcaccggagcccaggagtttgaggctgcaatgaatcaagattgtgccactgcacttcagcgtcggcgacagtgagacactgtcttaaatttttttaatgttaaaaatagataaataaataaaaattaaacacttctcaaaagactccctaaagggcacaatttagttgttagggaaatgtcaagttttccatttgtggcttcaagtttttaagtaactacaacttgaaaacataacaaaatatactggaaaaaaaattattttatcttccttcccagctatatccgcaaaataaaagaaaaagcaaacaataaggagatgcagttgacaagttagtcatctgtaactcaccttcaggaaacataaaacgtatttctctttccgcagcagcaaagtcattactcccatgaagtgcattccttaggtcatctgtgccataaattgccctcagactaaaaacaagttagagatgacgtccatccaatctaacgtctattccttactttatatgcatgcattccacttaagaattttacaaaagcattgccacttcttacatatgaaagcttcacaatttatgtcaaatttaagcttaaatttaagcttatctatctagataaggatcaaatatatttacgtctgcaggaggaatacactgagaaaataggagttctctggataaaaacgtggtgttgttttgtgagaagtaaaaaagcaatgcacattcaaaagtgcaagaactcaatatcttcttgtttccatacattagcaataatgctgaaaatttgaatttctgttcctgtattaccattattcttttaaaataccattccaatttttccatctaaaaatcctacttcagtggcagtttaaaggttgagagaataagggtaatcaactataaatcagacattctctgttgctttttctggtaggtagtattaaaatagacatttaacactttaaaatgtaaaatggaccccccaggccctgccaccctctgccccccaaaaaagttgattttggaaaacttccaaataaaaaaaaaattcccattacaatgaaatcagatttttttttttcattttcacagatggattccattccctgccatcccccaaaccctgaaaattacctgtctggatgtgtctccttcgctactaagctattatttggtcccaaaagttctaaccaataagagatggctttatgtctagctaatatcatggcgacaagtggtccagaactcatgtaagctgttaagttggggaaaaacatttttccatacttttccacataaaagttactacattgctcagggctgaggcgtagttttcttctctataaaagacacaaagtcaacaaaagcatttaaaatgacagttcaatgatagctcattaaaatcattagtaacttgaaactagtaccaatctgattataacttcaaggtttatctttgtattatgaagaaagaaaaggatataattaaatgtatgctgtaaataagatagtaagaggaattacttagcctacttaagaaaaattatggccgggtgcggtggctcatgcctgtagtcctagcactttggaaggccgaggtcggtggattgcctgagctcaggagttcgagaccagcctaggcaacacagtgaaaccccgtctctactaaaattcaaaaaattagccgggcgggcggcatgcgcctgtagtcccagctactcgggaggctgaggcagaagatttgcttgaacccgggaggcggaggttgcagggagccaagactgcaccactgcactccagcccgggcgacagagaaaaagaaaaattattccagttaggaagcctccctcagcatatgttttgtcagtaacaaatttatcgcatctccttcttaaagtaaataacacttcaattaacaaaactggacttaaaaatattccaaattcatgtttctctatttgtgttactattttgggagctggtctcattttagtacttagaaataacagctaggcacagtggcccatgcctataatcccagcattttgggaggccaaggcggaaggatcgcttcatcccagccaggagttagagaccagcctaagcaacgcaggaagactttgtttctatgaaaaattttaaaatcagtcgggtgtggtggtgtgcgcctgtagtccccactacattagaggtggtgagccatgataacacgactgcactccagcctgggcgataaagcagaccctgtatcaaacaaactaacaaaaaaagtaacatgtagtataatgatgcagtaaaaagtttttcatttgaacgtgtgttctttattctggttctgtcataaatatcttgattcactgtaacattaagaaaaattaggccaggcatggtggctcaggcttgtaatcccaacactctgggaggccaagacaggcagatcacttgaggtcaggggttcgagaacagtctggccaacatagtgaaaccccatctctactaaaaatacaaaaatcaggccaggcgcggtagctcacgcctgtaatcccagcactttgggaggccgaggtgggtggatcacctgaggtcaggagttcgagactagcctggtgaacatggtgaaatctcgtctctaccgaaaatacaaaaaattagccaggtgtggtggcacgcgcctgtagtcccagctactcggaaggctgaggcaggccaacagcttgaacccgggaggcagaggttgcagggagccaagattgcacctctccactccagcctgggtgacagagcgagactccgtctaaaaaaaagaaaaaagaaaaattaggtcgggtgtggtggctcattcctgtaatcccagcactttgagaggacaaggcaggtggatcacctgaggtcaggagtttgagaccagcctagccaacatggtgaaaccccatctttactaaaaatacaaaaattaggccaggcgcagtgactcacgcctgtaatcccagcactttgggaggccgaggtgggtggatcacctgaggtcgggagttcaagaccagcctggccaacatgatgaaaccccgtctctgctaaaaaaaaaaaaaaaaaaaaaaaaaaattagccagccgtggtggcgggcacctataatcccaggtgcttgggaggctgaggcaggagaatcacttgaacccgggaggcagaggttgcagtgagccaagatcgtgtcactgcactccagcctgggcaacaagagtgaaactccgtcaaaaaaaaaaaatacaaaaattagtaaggcgtggtggtgcatgtctgtaatcccagctactcaggaggctgaagcatgagaattgcttgaacccaggaggcagaagttgtggtgagccaagattgagatagcaccattgcactccagcctgggtaacaggatgagactctgtctaaaaaaaaaaaaaattagatgctagtatgtttctcaatctgaaagagtatgaaacactctggacaaatagatgttatttccttcacaaatgagactataaaaattaatcaggtttaaaaaatcatggtagctcagtctaatttgaaactcatgctttctctagaagcagctattttgagtgcttttttttttttttatttttttgaaacggagttttgctctgtcacccaggctagatagagtgcagtggtgtgatcttggctcactgcaacctccacttcctggattcaagtgattctcctgccgcagcctcctgagtagctgggattataggtgcctgccaccatgcctggctaatttttgtatttttagtagagacaggtttttcgctttgttggccaggctgctcttgaactcctgacctcagatgatctgcccaccttggcctcccaaagtgctgggattacaggtgtgagccaccgcgcccggccttgagagcttttaaaaaattatttattactgctggccaggctcggtggctcatgcctctaatcccagcactctgggagaccgaggcaggcggactgcttgagtccaggagttcaacaccagcctgggccacacgcagaaaccccgtctctacaaaaaatacaaaaattggtggtgcacacctgtagtctcagttaatcgggaggctgaggcacgagaattgcttgaacccaggaggcagaggttgcagtgagccgaaatcatgccattgcactccagcctgggcaacagagtgagacttggtctcaaaagaaaaaaaaaattatttattactgctgttttttcaattccactaaaggtgggtgaggagagaaaatgctcaaaatataacagagggattcaaagtagaaatcaaagaacctctgcctgcagtaaggatgatgaaaaatggagatatgtcactaagtgaaggctaaaaatctccatgattatggcagaaatctgtctttctaaaatgtcttagattttcctgagagtaagtgtgaattttaccaagtaactcacctcttaaagccctttccaaaattccgtgtctccgcaggcttcagaaacttggtaaaattgcttggtttgtagcaagggaccaaaccgcccagagcaagaagtttaggaacacgcttacctaggtggcatagctctgctatgaataggacccactggattctcaccagtgaagggccagttactatgaaaaaggtgctgacatttgttctcaaattgaaattcatacagcgattaaataaaagatgtgagaaattacaagagcacctgatttagcataatcctccattctattatctaaaattaagacatgaaactatgattatgcgtattagcgttttttttttttgttttttcttgctgagtttaaaaataaaatctcatctgttgtaatgtaagcccttatctgccacttgccccttaaaaagcaggggaacctaccttctgcaggtatgccagccaatgtagcacaatttttaaaattaagggttcatctttttttttttttttgagacggagtctcatctcactctgtcctccaggcttgagtgcagtggcgcgatctcggctcactgcgagctccgcctactgggttcacgccattctcctgcttcagcctccggagtagctgagactacaggagcctgctaccacgcccggctaattttttttttttgtatttttagtagagacggggtttcaccgtgttagccaggatggtcttgatctcctgacctcatgatctgccgcctcggcctctcaaagtgctgggattacaggcgtgagccaccgcgcccggccttaagggttcatctttaaataaaattgatactaaatcaattattccattggttgctttaaaactggatcaggtgaaattttttgaaattaggttgaatagtctacagccataccaccctgaacacacccgatctcatctgaaattaggttgaatattttcacagagaagcagtgataccaagtactatcagaacagaactcttagtttgtaacaaaggcaacactgccatctactgaaatgacatatcatttttcagcttttcccttaagtgggacaggaaagcctcaagttcattggactcccaagcctattttaaaagcatacagtgcaaaggacaaaacttgcataatttcacttaaattagatagcttgaatagtcaaattcctacagacagcaagtagaatagtggttatcggggatggggaagagggaagcaacgagttagcattaggtagagtgtttcagtttaagatgaaaaggttctagaaatggacagtagtgatggttgtacaacaatgtgaatgtacttaatgcaactgaaatgtacacttaaaaacggttaaaatggtaaattttatgttgtgtatattttaccgcaattaaagcaaaaaatgaaggatgtaccatggctgcctttgctctgaaagttactaactagggaaagtgtcatatatatttacattaaatttttttgtttgtttgttttttctggtctcagtacattgcccagacaatctcagttcactgcaacctccgcctcccgggttcaagtgattctccagccttgcctcctgagtagctgggattacaggcatgcgccaccacgcccagctgatttttgtttgtttgttttttgagatggagtcttgctttgttgcccaggctggagtgcagtggtgaaatctcagctcactgcaacctccgcctcccagattcaagcgattctcctgcctcagcctcctgagtagctgggattacaggctcccaccaccacgcccggctaatttttgtgtttttagtagaaatggggcttcaccatgttggccaggctggtctcgaactcctgacctcaggtaatccacccacctcggcctctgaaagtgctgggattacaggcatgagccaccgcacccagccctaattttggatttttagtagagataaggtttcaccacattggccagggtggtcttgaacttttgacctcaggtgatccacccgcctcatcctcccaaagtgctgtgattacaggattgagccaccacggccggctaatttttaatttataattaacactagccacttaattattaagtttgtcacttttttttttttttgagacggagtctcgctctgtcacccaggctggagtgcagtggcgcgatctcagctcactggaagctccacctcccgggttcacgccattctcctgcctcgtagctgggactacaggtgcccgccactgcgcccggctaattttttgtagttttagtagagacggggtttcgctgtggtctcaatctcctgaccttgtgatctgcccgcctcggcctcccaaagagctgggattacaggcgtgagccaccgcgcccggccgtcactaaatattttttaaaatatggacttttttggccgggcatagtggctcacgcctgtaatcccagcattttgggaggccgaggcaggtggatcacaaggtcaggagatcgagaccatccgggctaacacagtgaaaccccgtctctactaaaaatacaaaaagttagctgggcgtggtggagggtgcctgtagtcccagctactcgggaggctgaggcaggagaatggcgtgaacctgggtggcggagcttgccgtgagccgagattgcgccactgcactccagcctgggcgacacagagcgagactccgtctcaaaaaaaaaaaaaaggacttttttttctttttcaagacagagtctccctctgtcgcccaggctggagtgcaatggcacgatcttgactcactgcaacctccgcctcccgggttcacgccattctcctgccccagcctccccagtagctgagattacaggcacgtgccaccacacccaggtaattttcatatttttagtagagacggggtttcaccatgttggtcaggctggtctccaactcctgacctcaggtgatccacccgccttggcctcccaaagtgctgggtttacaggcatgagccactgcacccgggcaaaatacggacttttaaaaaacttaaatgggacgcctttatctgtatacttcatttattttttctaaagttaatgggtaatataattacaggattcaaaaattcaaagcaagacaaaaaggtatatactgaaaaatcttattcctatccatttcctaatctactcagttcttccttgccctcaataggcaaccctttttaaatgtttatttccccagaattccatttttcaaatattggcaaacatgaatatattactttgtctctatcacaaaaggttggtacacatgattttgtgttttttttgctattttgttctttttgctacacactttgctttcttccgttaacagtacagacaggttcctcattcttctatttacaattagttgcatattatgcaatttgatgggttttccagagtttatttagtcctgtctcccaatctcccaacctgggttattttcaatcttttgttgataagtaaacaatgctgcaaaaaataacctgcatatatatcacttcatattaatacaggcacctactgatgggactaaacagggctctgcgcatgacaggtagtaagagcacaaggaattctataggacagatttccaagagcagaactgctggatcaaatggtaagtccatctgttgtattggtagataactgccagattccctttgataggggttgtgccatttacttttatatttttgccaaatggaatctcagtgtagttttaacttgctttttttcccacctaaagattgagcatcttttcatatatttaaaaaatgtttttccttttctgtgaccatccatctgttctgcccatttttctactaatttatttttatctttttctaggagctctttatgtattaagaagacaagccctttgtctatgagttgcaaatctttttcccaagtttgttgtgttttgactttgcttatggtgtttatttcattgtgcagaaattttttgtttatataatctttttttaaattaaaaaaattttttttttcgagagtttcgctcttgttgcccaggctggagcacaatggcacgatctcggctcacggcaacctccgcctcccatgttcaagcgattctcctgcctcagcctgctgagtagctgggattacaggcatgcgcccccacgcctggctaattttgtattttttagtagagatggggtttctccatgttggtcaggctggtctcaaactcctgacctcaggtgatcaactcaccttggcctcccaaagttttgggattacaggcatgagccaccgtgcctggccttgttgatataatcttatcaatcttttcttccatggctcctagaccttaagtcataacaaaaaaaaaaaaggctgtcctactccaacaacaaaataaatccattatcttttcttcctgaacttacatggtttaatttttttaatatgtagatctcaggtttatttggagtttatcctggtatataatacttgatccaaatttttcagtggctaccagttttcctaacatttactaaaaagttatttacctgagtctttaatcatattaaatacttcctaacactttcttgtgccatccctactctcggactccacctgtcctttgaagctcaactgaaattccgtatcttttctgaagattgatattttctctttatttatttatttattttttgagacagatctccctctattgcccaggctggagtacaatggcgtagtcttggcttactgcaacctctgcctcctgagttcaagcgattctcctgcctcagcttcccaagtagctgggactacaggtgcacgccaccacgcccagctaatttttgtatttttcatagagatggggtttcaccacattggccaggctggtctcaaactcctgaccttatgatccacccatctcggcctcccaaagtgctgggattacaggcgtgagccaccgtacccgccattttctctttatttttaaaaatactgactgaataagcaatatgacactgtataaatgggagaaaataaaaaattggaagttcgaatgagaatactgtaaaagaggcggggtgcagtggctcacacctgtaatcccagcactttgggaggccgaggcgggtggatcacgaggtcaggagttcaagaccaccctggccaacatggtaaaaccccgtctctactaaaaatacaaacattagctggacatggtggtgcatgcctgtaatcccagctactcaggaggctgaggcaggagaattgcttgaaccgggacctggaaggcagaggttgcagtgagccgagatcgtaccactgcactccagtctgggctacagagggagactctgtctcaaaaaaaagaaaaaaaaactataaaagaggaagattaaaaatattcaattctatttgatttatccttaacaatgctatttatattcactttcaaacccctagaatgacaatgtttactaattgcagaacataaggcttaaaacattaaatgttatgccataactgaaaaaagtaccaatagcctaaaattccatcaatagaagatcaagtaaataaattgtagttctaatacacagggaaatattacacagaaattaggaagagtgagatcaattcagatgcaatgatctggaatcctatctgagggactctgtaaaggggtcaagggaaagggactgttctgttttatggggggaaaatgtttataaatgcatagaaaactcctggaagaacagaaagtgttaagtggttgcctctctctggagcctgggacttggggtaaaagaggacaggtgaaggaaaagtccattttatttctcattttacatccttttaaaaactatcacatataacttttatacttagaagaataaacttaaatttaatgctgaacactaagggtttaaatgggtaggcacatttacataagcattttttttttaagggcagagaggaaaaaagcatgaatcatcatacccagaagttacctgaacaatggtgaatccggatctaagaataatatcttgtatctcctcctctttgtcaacaatatctggtttgataatggccagagttttttctacatatatctgaggtggaggcattgatatctccattatggcttttcagggcacaaattaagagtttcttaacaggtatcaactgcaatgacatgcatttccccccacccccatcgcaaattcaatgtaattatgattaagaatagcaatagtaggtacttgattttattaactgatgaaggtagaaactgccatgtttttctatatacagggtctcaataataggattcctactatgtccaaatcgagccccggcttttcgtatacgatgtcaccaaggcaggaaggactatgggctcacataaccagaggccaaggggcgacccgaaggcctggaaccagcaacagccccaggcagcagagggcggtggggcgggtggtgggggctcgagggggcggtagagcgggtggtgggggctcgaggggacggtggctggtgggcaaccacacaccattacagcggcgggtgagcggcctcggccagctgcctctgtgaagcgaccctgtcccgcagggacctctctgtgcatagggtcaggctaattgaaaagcagggcctctaggtccgcggggactttccgggttgcacctgcaaattctgaatttgaccctctctaagtactcacctcagcggccgtcctcatatggtacaacttgttgctaggagacctgaagccccagcgtggggacggtggctgc

SEQ ID NO: 1392 - DNA, 95472 bp, Homo sapiens
tggagttagttagaaccagaactttattgtagcggatacactttctgacctatcatgagtatacacatctgcgaagggaaaccgcgcggcgacagcgtgaggacatcccctgggcgtgagcgtctgtccgctgtctaaacagagcagctacagggacgggacatggaggatggccacacatagcacagccaccagtgtcctcagaactagcagtcagggtcacagaacagtattcaaaatgattgcccacctgttttagaaatctaaaattttacatgtaactaagagcaaagtgctatgtgggttttagaccatgactgtttgtttgctctcctgccctaccaccaagcaaagcagcagggctcctgggggagagggatttcaacccccctgatggcagggggtgctctggggaggagagaggagagaacaggctgttttggaaaattccagcactttgacttcgggccatgcgtctctcctggacgttctgagtacggatcgctcaggcctcctgccgtctccaaaaggagtggtcagccggtctgcaggacacctctcagtttctccttttaccagcaggaaaatgtacatttaagcataaaccacaaggctgcacacggtgagaccaggccactgcccagggagctgctgtcggaggaggagtgtggaaaaggggccagggaccccgcaccccacaccaaattaggaacaggtagaatcccaaaggcaaggcccggccacttgtagctaccctgatccagtctcttgagcagcacagctagaggcctgtggcccccgactcccagccatactcagacctgagcaggggctggggcggggctgggcggggtgggcctctccctctggggtctggggagggaggacccggcgggaagagcccgtgctcagagctccgaacttcactttacattccagtcccgggttacactagcacaaaggacacaaggaatccgatttatttacaaaatattaaaaagtcagttaatcatctacacagtaccccccatcctgccattatttatacatgcactagtttggaaaaaataaaaactttttttaaaaaaagaaaaaaatgattaccgggtgggagtgagcatgttttaccctttgtcaacgagcccagctggcatggcttttctggagtgcgaggggccagtgtcctctccccggggggagactccagacacaaacgcggggcctgaggcgctgggaggcccctgtgcgagccggatggcggccagagaggacgtgtcagctcctcgtgggactgaagagcgcgaccaggcagagggtgggcggggagcctagggtcctacacaccaagcacagcgacgatcgtggcggggaggggtctgcacacctactggccgaaatgactttgtacatcgtggacccttgggactgggagaacggatggcagcagagtcttcgaaagcagaaaccgaggtggccgggggcacgggtcagtagctgagggtggagtcatcccactccagctgctgctgccgggttgcgttctgggggtcgccctgctccccctcctcctcctcgctgctctccgactcggcgctggtgatgtcatcctcttcttcgccgtcctcgctttcctcttcctcttcctcttcctcctcctcctcactgctgtgctggtcctcataggtctggcaaggagaagtgacggccacatgagtccggccctgcccacagccccgtcacctggcattctcctctcgacagccacagaggaaggagaacttgccccagcgtctccctccccagcgacagagcagccaggacggcaccggaagttatattagaagtgaagggaaaacaaagctccagtcagcacccacggagtcacccacatacaaagcagcttgggacagcacctcagctgccccaccagagaactctctcaggattaccatgacccaagagcgccaagccctggcatggctcttctctacacttaaggcagaacggccttgaataaggtctctctcagcctcggtttacccacgaagacacctaagccccaggcttgctgagcagatgacgcgatggaaagcatgtgaacctgaaggagccgcgccgtaccggcttctcggaggccctggcctgtgctgcctctcagtcctggaggtcgcccgcccactcctacctccatggggttgacggtgatggtcagggcagagtcgtcccagtccatctcgttctccttcccggtgtcctgatcccgcatggtccgccgatgtgcggcccggatccgaaatacccccaggataatcatgaacaccaggaagctgacgcacaccacgatcacaactgtcgcagtgctggggacgactgtgggagaatgagggggcgggatgcgaggtcactcggcccagaaggccactgtgcccttgacctcctcggctgtgcctggtcaaaacgggctggacagcacgcttcagctgaacccacaggccaggaggaaataccaggaaaagctcgccatgggcctccaacctggctcggccacgtcctgctccatggctgcgggtgacatcatctgccctcttcgagggctttagtttccttgtgtgtgatggggaataattgggacagggaaagaccggcggtcatgctgagcaggaggctgtgcccacggtggggtgggggcagggcggacggcatggagcatctccgcttggtctccctccccatgtcctacctgcgaacgggtgggggttggccaggttgtggcctgacaggtcaacaaaggagcggtgttccgggtgcacgaactgtggctgggcagccatgtggttggcgtgttccatggggttggccgtgtggattacattcacctatagcagagaaagagaggatcgctggagacaggcatcctgagcctgtccaagaggtgacagtggagtcccgcagctggcatgaccagtgccactcagagtggctcctggaccgcagctgggggcaaacggagctacgggaaaaggacagaaaaaaaaatcaagagtaagcacttaaaaaacaaaaacaaagaaaaagaaacaaaaaccaaacaaaaaagagtaataagcacttagaaactgctataacaatctaatattctcacacattccagaaatgtatcacttttctacttattagtatttgttgagactgggtcttgctgtgttgcccgggctggagcgcagtagctattcacaagcatgatcacggctcactgcagcctggaacttccctgctcaagtaatcctcccacctcagcctctcaagtagctgggactacaggcaagcaccacgcacctggctgcaatccatttttattgcattttataaaagattatgcccaaaacaagagcagaaaaagaagccgatggtccttccccatgggtcgtttgggaagcactggcgtagacctttttcctcaaatcacagccgtgtgaaagacagcaccaatcactgccatggatttcctttcatatctcttaccctttgactcaaacaaaacaggcaccgaatttagcattctgctcttgagttcatggtgatattccattgctaagagtaactttgggtcaattttctccaggccacagagagcctgagcgatgaagcagctgctggataggtctgtagacgacctcagagcaggaggagctaccctctagcctgtgtggcctgtgagtcaccagcgccagcctcagcagcactggtcctgcccgtgcgggtccctgcgtgagcccctctcaacctgggccgaggactcgacttcattcacaggagggccagtgacctggcacagatgcagagaacttttggttccctggatgctgctctttctaaaacagtgtctttggctgggcacagtggctcacgcctgtaatcctagcacttttggaggccaaggcaagtggattgcttgaacctggggggacaagaccagcctgggcaacatagtgagacctcgtctctaaaaataaataaataaataaaaccacatcctcctgtttctctcatgggaaatctcaagaagccccagaggcattaactgccacttgctctttgtcacctccctgcaaagttccttaggctccaactcaggctgaggcagccagggaaaggggagcaccccccaccccagctcaccccaaacacaacttgtcactccaacaagcccaggtgtaacctgcagcaggccccaggctggaaaggcgaccccctagaatgagcctgtatagctgccatcatgaatgctctgaggttggcgtttgtgaatattagggctgcaaatcagcgccctcactcactgctgctattggccctgctcagtgggagccttgtactcacctccaccttaaattcgttgctgatgtagcggccattcagctctgagcagatgagcttaaacttccggtcaagcaaggacctggcatgccagttccgatagcgcagcaggtgcaaaacctcctcgtagctggccatggtgtccacgcctgcaggggttgaaagggggaagattgccgggtggcttagggcaggagcatgggcagggctgcagccgtcagcacaggcaggctcaattagacacccaggttagctaggccaaggggtcacacaagttggctttctagccatgggaataaatgcaatgtgcacaggggcattcttccctctgtgggggacgtgtcatcccacgcctcaaccctccccctttagagagtagtggctacacatccggtacctgtccaggagacaggagtatgcgtgcagccaacaatgatcccagcgaacgtgctccttccccatctccctctaagataactcaacattctcagatggcaggcagcagccagccaagagctctcaaagtcccctcttgcagcctggcccacctgcgtggctgcagcgctccccttacctgtgaaggtcatgcccagttcagagctgctcacttcaatgcccttctgctgcaggcgggccatgtccacctccaggctctcctgctcgtggttcagctcctctccctccaccgtgacctcacaggtatccaggtcgtgcacgatctcctcggacaccagtgattcttgaactgcaaaagaggcccaaccagaaatattaagtaggggcagtggggcccagcgtggcggggcacactggatgccctgccggctcaccccaaacctacatggctctcgtaaggaccaacgacagaagcaagcgagagttgctttcaagaaacggctgggcgcagtggctcacgcctgtaatcccagcactttgggaggccaagacgggtggatcacctgaggtcaggagtttgagaccagcctggccaacagggtgaaagcccgtctctactaaaaatacaaaaattaaccgggcgttgtggcaggtccctgtaatcccagctattcgggaggctgaggcaggagaatcgcttgaactcaggaggtggatgctgcagttagccaagatgacaccattgcactccagcctgggcgacagagtgagactccatctcaaaaaaaaaaaaaaagggggggagtttcatgtgtcctgagcaagaattgtggggacattgtgcctccatgggctggccagcctggcaggtgcaagcagtgtctcccgtaagtgccctcaacccctcaacctcaagccacatctcaaagcctggcagcaaccaggaaaagatgtaagacccctccagatgggattccagagatcaccatgagctccagctcacgggtcagattccagaagcacacccgagagaacaccaacgaaagattaaaacctccccaaatcccacagagacaaagagccccgccaagtacatggggacaatggggtttccggccgaggcgagggagcccgcgccccacagagcacattacctgtggggtcctcagccccgtccccttcaggctccacttctctcgtgatggtgctgatgatgcgaagctcagggaaaaggaacaccccttctgagctttcaaattcagaagctgctcgggcaaaatggtggacgccactcaggctgatcttgggctcctcgggctgtaaaaccatcacgtagccatctaccggggggaccgaaatgcaggtggcctcgttaaaacacctgccagcaagaaatggggaagggtcagggctttgggagccgatcttggagcccacctgtgcaaaggcacatggaggtgggatacagaggcccccactaacacctgccggggccactccaggaacacacttgcaaacaagatgcgtaaatatcactcagctctctgccccacactttctggttacacacgatggctcacctttccttacagaaggggttaggctgtcttaaaaacctaaatatacaagtgtcattgggcaaaacaggccggctgttaaaaatcaggacgtacttgattgtgctggtgattttgagtctgcgaattccgggcgtggggaactgccgggagttcaggtacgagatgtgctgcatggccttatccaattccccgaggtcttctccctccaaggtcaataccaactggctggggtgtgcttggatctgaaatcacaccagccacagagaggagaagaataagccagtaaccgcaggagctgaaaccacagatgcctccacaaaggggactggcctgggttcgatttgaattgctgacttgaaaaagaaaagctcgtttaagtccagtgaacacaactcttttacccaacagtaaacgtatcaatcacagattactcactccctcatcccaccagcctccggggctgtagtctaaggggcccatgagtggtgtgcagtcgagcgctcggtgttacctgcacgcctctgccactgtcttcgaggacctgcaggtccagcccctccttgcaggtatacagacagtcgatcaccttcttatccgcgagtttcccggaacggagagttaagccagccagattgcctcggaaaaactgggtcatgtgcaggtcgccacctttgggtcaggggagaaaaggcgaagtcaggcgtgcaacccagcatcgcccaactcacttctcactcaacacggtgttaccggtgctggcagctcagtggatggacatgcgggttagttcataccaagtcctgttagccttgcaatctacatggaagcgcaatgaagaaattaaaccgtttatgatcatgcacatggcctggagaaagggagagttgggggtgtctcacctgaagccaagaggtcccctgagggtccccacacctctggccactacctggtaaggtggcctaccctgttctcatcaccagggtgcatggtgacacttcctacgccaccagcctctccagccactgccttctcagctggctgggttccacatggctgttttctctacctggcacgccctggggaatgaacccacacaagcgaggcagggaggataaaagggaggcttaaaatactccctgcatggaacggcctatttcaaggatgctatggtgttaagtcccatccttcctgcctcctcctgaggattgctgagaagtgcagatgttacaacgaaaaccaaaacccagaaaatggcccttgacagatgacaacaaagagccagaaacaggttacactaaaccttgttcttaaactgaaaaggaaaagggacaaattttcagcaatgtgtctcattctggtacagaaatcaggcactgtaaatcatgactaggaattgaggtttctaagaaacggctatttgccaggcatggtggctcacgcctgtaatcccagcgcttcaggaggccgaggcgggtggatcacctgaggtcagagtttgagaccagcctggcgaacatggcgaaaccccgtctctactaaaaatataaatattagctgggcatggtggtgcatgcctgtagtcccagctacttgggaggctgaagcaggagaattgcttgcacccaggaggtggaggttgcagtgagccaagaccgcgccactgcactccagcccagacaacagagcgggactccatctcaaaacaaaaaaaaaagagagacgtctatttaaaatttactgtcaatcaggacagaatatctagaaacaagtcttttcctgtctcgtggttcatccacatgacagtcacgaggcggcctcccaaaccctgcctgtaagactgaaaaagcagggagcctcatgcagtggggtcagggtcaaactggatggggggggaagtcccatgcatgcactgcctgagatgtcatttgtcctcactccagctggggtcagaatgggcagaataagggaactccatgaagcaatggggaagcgcaatgcagggaagcagctcagatggtgtccaggaccaaaatgcaactggggcgtttcatgcgacacgtggaatgaatcagtctcatctttaaatgaaacacaatagtgaatgtagggaaaaaatccagcaacctgcagaggccacagtcacaggctcagtttcattgtcattttcaactcctgaaaactctgtggaaaagcaagacaaagacaatagaaaaggactgagaggttagggtcttcaaaccggaccttgaaaaccaggtttgaagcaaccaactataaaacatgaagagaaaattccctcgtgatcccgctctgggatgtacccatctggacgcaagcttgtatttaatcaccttttcccagaagtgactttaccacccccaaccccaggcttcttttgttccaccttcccacatcctccttgccaaaacatatgttagattcaaaataagatgaatgaaagcacacacatggaattcgttcccctccccaatccgtgctatgaagtaggacactccacagaggctgagcctgggctgcaatgctgctcccgatataaacaccaccaagttccggaccaacagcacctcttctcctaatagggaagacactgcgcagacaaaaaggcatagcacacacgtgtcccaagcctggtacacagtaagcatgcggaagtctgtatattttggaagctccaaacaagtttacatctgtctagccattaacctttgggcgacagaggaaagaagacattctcaatcactttttctgaatgagagggagatgcagaggctaaggaacccacctagggaagcatagcctacggtggacctggggaccctcaccaccttcagctcctctagctcctggatccagtgtacagagtaatacaacctaccagaaaggcacacacacagcggctaagcacagaaccaacactctccaggtcatgctgaggggaaaggccactcctcaagccctgcagccctgcagccctcccctctatggtgtgctagggccccttttgggctgcggctgtgcggggctgcatcaaggggcaaggctagaggtgtatccaggtgaagcccatgtgagccacgggcctgtgctacctccacacacaccaagactcccccacaacacgctggtagaagggaatgaagctgctgcccacagcccaagctctccacggccaacgtgtagcaaaagtggcagaatcaaccacaaaaaagaaaaggagatcctctctcctgttaactgaattttaaacaatctgtggggtttttttgtttgtttgttttgagatagagtctcactctgttgcccaggctggagtgcagtggtgtgatcttggctcactgcaacctcagcctcctgggttcaagtgattctcctgcctcccaagtaactgggattacaggcgcacgccaccacgcctggctaatttttgtatttttagtagaggcagagtttcaccatgttggccaggctggtctcgaaattctcctgaccttgagtgatctgcctgccaccgcctcccaaagtgctgggattacaggtgtgagccactgcgcacggtcatctttcataaatttctaaccttactcaaggtacaatgtttccatagggagaaaaaactaatcaaaaagtaattaatgatgatgataccttgaaatgacacagcagagtccagtgcaagggtcaaggtgggaatcatgaacctctggggtaacctgagggttccatgaacttggatgggaaaaattacatgcttatttccactaacttctgaaattcagcatttcctttggcaataaatgtaggctacacaccacagcagttagcaatgactgcaactttgtcaccaatagaatgcactgatatttgcacaccaggccacagctgttgcagatgccacagggatcctcgcacagccctcacaacttggaacttacaccactgttggacctgctgctaaagctggttcttcatttgttaacataaagtaccactggtgttactgtttcacaaatgtagtatttcaggatgttaataactatatttcagtttaactgattacccttgaatcctatgtatttattttgtagattaataagaagggatccattggccttgccagaccacccaagggctccatggcacaaaaaagggcttaaaaccccaggtctgagccaggcgcagtggctcatgcctgtaatcccagtactttaggaggctgaggtgggaggatctcttgagcccaggagtttgagatcagcctgggcaacacagtgagaccccatttttataaaaaattaaaataataacaataataaaaaccttgatctggtgggtctgagtgtgggcccagaatacacaggtttttctttttcttttgagacagggtctcactctgttgctcgggctggagtgcaatagggcattttttttttttttttttttgagacggagtttcgctctgtcacctaggctggagtgcagtggtgctatctcggctcactgcaagctccgcctcctgggttcacgccattctcctgcctcagcctcccgagtagctgggaccacaggcacccgccaccatgcctggctaattttttgtatttttagtagagatgggatttcactgtgttagccaggatggtcttgatctcctgacctcatgatccacccacctcagcctcccaaagtgctgggattacaggcgtgagccaccgcgcccggccaatagggcattcttggctcatgcagcctctgcctcctgggttcaaccgattctcctgcctgagcctctcgagtagctgggatcacaggcacatgccaacatgcatggctaatttttgtatatttagtagagatggggtttcaccacgttggccaggctggtctcgaactcctgacctcaagtgatctgcccgcctcagcctcccaaagtgctgggattataggtgtgagacaccgcgcctggcccacaggcttctcaaagtaaaaaaattcaaaaccctggctcctgattcatcagctgggtgacacctggcttgctgcttctgtgggcctgagtttcttcagctataaaaaagggattctaaggtttaggtgagacaacgtgtataaaggagttggcacacagcctgccacttggtaagtacaggtaagaagcactggtgctctggtggttatcatatcccctctcagcagagacttccatggaatcctccccacacgtggcccttgctgagggtgaacagagccctcgcagccctcctaccaggtcaccaagtgataaacactctggaagagtcctccaggtccaaggcgcacttctacttctgcgtcctttatttctgtgcctgactcttgctgttgcctctttgtccttgtgaacctttcaataaacggattaatttataaaacagttccccccactacacgctccctctgtggaacgctccctcttgggtttccgggaaaggtgacggtgtggtcagtcctatcacctttatggagcacctacagacagagctatgctagctagagtggggtaacggcagtgtccccaaaaaggctgtacacaggaaatggaaggaaaagatccaggacacgagggtaaggctgtaggataccgatcacagcctgctgccaccaacctagtaaagaggtacaacttaattctcgagtcgagggcggggggtaatgacaggtaccttgccagcaagcccccaccacgagctgagtttctatcttggatggatggagcgggtaatcctcagtcacagagaagggctcgtgggacgtgccatccacatagagagtcacactcgggaattctacattgaggacgtagtggtgccattcctcatcacagacctacagaggcaaagggaagcggggaggtgtgagatgtccactttccttctcatcaatgcccatggaaaccaagtcacccaacacaagggtcttcctaggaggaaaaggatgaaaaaaatctaaccacaaaatatctgcaaatacatctcaccaaaagaagccaagcatctctagggcatttccaaactacgggggctgcattgctcactaaccagaggacacagcccaagtagggagctgcccaattctgctctgccaacagtgtggcaccaggaagttcctgtatgggcaagctggatacccaccctcgaaagggttgagttagtttaccactggccattccttttctgaataaaaataaaaagtgcctttaggccgggcgcagtggctcaggcctgtaatcccagcactttgggaggccaaggcgaggagatcacttgaggtcaagagtttgagaccagcctggccaacatatcgaaaccccatctctactgaaaatacaaaaattagccgggtgtggtggtgcacgcctgtagtcccagctacttgggaggctgaggcacaagaattgcttgaacccgggaggcaaaggttgcggtgagccgagattgtgccactgcactccagcctgggtgacagagcaagactctatctcctccccaccgccgacaaaaaagtgcctttaatctcagaataaggcacaccatagtacatgtattttcttttccaactcaaagttgatgatctcaataaatatgaacatcagctccaagggcaccccaaaccaaactgtgttcccatcctgtgatgaacgagtgtgtgaacacgcatcagccagctgcaatgggcccttatctgggtcgtaactcaaacaaattgtaaacacaaaaacatttatgaggctacttgaaatctgaacattgactggctatttgatcgtattagaaattttactgttaggtttttttttaatgtgaaagagtgctgtgattatgcttgtctatgagatacatcatgacatacaggcgggcgtctacaagaatgaaatgctctatttgggatttcttgaaaattattaactaacgtttgagggggtgataaaaattttcagcagtgaataggggtaacaatgaaactagactgaccaagagttggcaactgttgaaggcataagggcacacagggctattctttaatctgtctgcttttatataaatctgaaattttccataatacagtttttaaacagtatatacttagaagaaactaaatatataaatgcagactatggctactataacagaactgtagctaaaatgtccacctatgttgcaaaatatttttccaggactaagcctttctttagttttttgaaaataattaatggtaatagtttctgagaaataatcactcacataaataaaaaaatacaccaataagagatgaatgctacccagcctgaccaaaatggtggaaccccatctctactaaaaatacaaaaattagccgggcgtggtggcgcacgcctgtaatcccagctactcagaaggctgaggcaggaggatcgcttgaacccgggaggtggaggttgcagtgagccaagatctccactgcactccagcctgggcaacaaagcgagactcagtctcgggggaaaaaaaaaagagacaaatgctaccaactggacacccacttcaactttccactatcatatactttttcctttctcatttattctcttttacttttatctatcctatgattatttttagacactattatattttagcaactgcaggcacatataacatatgtcagcttttgtccactaactccatgagacaaataaaatgatgataaggccaaaggtttccttctcatcccaactctacatcaaaagaaaaaatgatctattctgattttaatagagggttctaattttacagtgctctctcgtttcctgtagcacgtggggtttttcacaggatatttgctttctatcacagcaactgctagaaaattagctttgcggccgggcacagtggctcaggcctgcaatcccagcactttgggcggctgaggtgggtgcatcagttgaagtcaggagttcaagactagcctggctaatatggtgaaacctcatctctactagaaatacaaaaattagctgggtgtggtggcatgtgtctgtagtcccagctactcataaaattataaatatacactgactatacacagccatccatgtgcaaggttgcagtacctgcttactctctcttagaagatgacagtgtttttctttttctttggagacggggtctcactctgtcatccaggctggagtgaagtggcacaatcgcagctcattacagccttgacctcctgggctccatcaatcatcccacctcagctccccaagtagccaggactacaggcatgtgccaccatgcccagctaattttcgtgggtttttttttttttgtagggacaggatcttagtaatgttgcccaggctggtctcgaacccctgggctcaagcaatcctcgtgccccagcctcccaaagtgctgggattataggtgtgagcaccttgcccggccctattagtgcgttttcaattcactcacctgattcaacttccagtggaactctgcaggtctgtatttcttctcctcagaaggatcctgacggaagaggaagatcagccggcacccgtggacatagagggagtagtggtgccgattcatatctgcaaaggcagtttctatgggtaaattgccaactaaagatccaaaggagaaattaaagctgtttcttgaatggattttgaagacacaatttcatctgcataaatgaactcttcggctaagccaaggcagggcttagaaacaaatacacttgggctttcctgagaggcggagcctgtgatcaccgtggaccccactgagcaacaacagctaatacccaaatgcccaggccgtggctctagggaaccaagtgccccaggcacacagcatggcacatggcctacgagcaccaggctggcaggggaccctgggaaaggagagggagcctgccgctggcacccaccctactggacactggggcctggcatcgcttgcagagctattaccctacctgttttatcagaactgcaaagaattgtctccttcttcctgccgaatggcccatgtctcatccacaccgagatggtgaacggctctttggggctgaccgacacgacgccatccgggatcctcactgcctgggtgccgttgaactcaaacacctggtcgctgtcgtggccattgtcggtgggcaggcccatggtccagttgagggatccactcggggatggcagcagctcggcagtgcccgcggccgcacctgaagccacagtgctcggtgaaactcatgtgaggagccagaggtcccgcgcacctcaagcccccaggcacgtgcttgtcttacacttaggcaatctgctggctccagtttactttttttttttctttcgagacagagtcttgctttgtccccaggctggagtacagtggcgcgatctcggttcattgcaacctccacctcccgggttcaagctgttctcctgcctcagcctcccgagtagctgggattacaggcgcgccccattaaaactggctaatttttgcattttcaggagagccggagtttcaccatgttggccaggctggcctggaactcctgacctcgtgatccgcctgactcggcctccaaaagtgctgggattacaggcgtgagccaccacgcttggccctttcagtttacttctcttcaaaaatcagggttttaaattacaaaaataaaaataacaaccatggatttgtttaaggaagggaaagggccaggcgtgaacccgggaagcggagcttgcagtgagccgagatcgcacccctgcactccagcctgggcaacagagcgagactccgtctcaaaaaaaaaaaaaaaaaacaaaaaggaagggaaaggaagcatttcttgtaatctgattcaaattataccattttagtataaacacccagtcctcctttggtaaatatacacaaaaatgatgcgttttcttagaaaaatggagtcctggcagggcttggtggctcacacctgtaatcccagcactttgggaggccaaggcacacagattgcttgagcccaggagttggagaccagcctggacaacatggcaaaaccctgtcaatacaaaaaacacaaaaattagccaggtgtggtggtgcatccctgtagtcccagctacttgggaggctgagatgggaggatcacttgagcccaggaggttgaggctgcagtgagctgtgactgtgccactatactccagcctgggcgagtgcgaccctgtctcaaaaatatataaacaaatacaataaaagtggagtcctgctatgtatgtgcataatacatatatattcctagcaatattcttctatcatgtaatttaaactatctgaatagttgttttttttttttttttttttttgagacagggtctcctctctcgcccaggctgcagtgcagtggtgcagcgttggtttaccgcagccttgacctcctgagctcaagcaatcctcccacctcagcctcccaagtagctgggaccacaggtgtgtgccaccatgcccggctaatttttgtgtttttgtagagacggggtttcgccatgttgtccaagctagtctccaactactgggctcaagcgatccatctgcctcagactcccaaagtgctgggattataggtgtgagccaccgcgctcggcctgaatagcatttcattgtacagatacagcatcacctactgaccagcctcccaggtgggcacagaggctgtccctaaccttttcctattataaacctcacctgcatgcacagctttatgtgtctccatgattattcccttaaaataaattcctagaaatgaaattactaagtcaaaaaacataaaaaatgttttccaaccattcttatgtattgccatgttcaaattaaaaaaatttttttttgtccacaggaaaagattttgcaagctccttcttgactaagctattactcggagcagcaggccttggctggaccagcctggcctcttgagtaacagaagaccttggtccaaatcttagctcctgaagctagacgtggtggcttgcgcctgtaatcccagaactttgagaggctgaggcaggcagatcaactgaggtcaagagttcaaaccagcctggccaatatggtgaaactctgtctctacaaaaatacaaaaatgagccaggcatgatggcagatgcctgtaatctcagctacttgggaggctgaggtgggagaatcacttaaacacaggaagtggaggctgcagtgagccaagatagcacgattgcattccagcctgggcgacagtgagactctgtctcaaaagaaaaaaaaaaaccacacacacacactagaacctcagctcctgaatatgtgggcttgggcaagctacttaacctgctttagtctcaattgtttaattcctctgtaacaaggtcaatacccacctacttcgtagacttgttgggaacattaagctaaaacacacatagaagtacctggagtaaggccaggcgcagtggctcatgcatataatcccagcactttgggaggccgaggtgggtggatcacttgaggtcaggagttggagacgagcctcgccaacatggtgaaatcccatctctactaaacatacaaaaagtagccaggcatcatggcacatgcctgtaatcccagctacttgggaggccgaggcaggagaatcgcttgaacccaggaggcagacgttgcagtgagtgagattgcgccactgcactccagcctgggcgacagagggagactgtctcaaaaaaaaaaaaaaaaaaaaaaaaaaagtacctggtgcatagtaagcactcaaattatttctattcttcctaactttattctgctgaaaaaaaattcacttaataccatgaaatgagagacggaataaattttatatattatacttacatgcatggtttaaaacagaaaatgtgccagacctccttacttaaatatatttaggtgacaattatgaatatttggattcagagttgccaaacacccccatatgctcatcattggactgtggcagcataatgtctagttttctactttggtttatttaccacatgataattttcttcttatttattgttttttttctaagacaaagtctagctttgtcacctaggctggagagtagtggcacactcttggctcactgcagcctcctgggttcaagcaattctcctgcctcagcctcccaagtagctgggagtataggcacctcgcaccacgcctggctaattttttatttttagtagagcgggggtttcatcatgttgatcaggctggtcttagacccctgacctcaagtgatctggataattttcaattataaaccagtggccgggcgcggtggctcatgcctgcaatcagcactttgggaggccgaggtgggcggatcacgaggtcaggagatcgagaccatcctggctaacacggtgaaaccccgtttctactaaaaatacaaaaaaattagccgggcatggtggcaggtgcctgtagtcccagctactcgggaggctgaggcgggagaatggtgtgaacccaggaggcggagcttgcagtgagccgagatggcgccactgcactccagcctgggtgacagagtgagactctgtctaaaaaaaaaaaaaagaaaaccagtaacctaaatctcatggttgttatcaggctagtgaaaagactcatcagtttaagaaaatgctccctgaaaagctgtttcacaaaagctttttgaaacacaaaagacccttccaatttatgaagacgctgcttcatttagtgggattttatcaccagtcaactaaatgttcttccctcaacatcttccatgacagccatccatacctcacctcttcttcatttagataaaccagaaaaatatccgcagctgacagtaaagagagacctagccttctggtgggtttcccagtaattctgtctctcaatttctccacacaatattgtgatatagaaaatctattgagattctaagttagatgtggctatctttagttctgattttctacttcatgtttgtcaaaagctattgtattacctatatttttccttcagttctttttgagacaggttctcactctgtcatccaggctggaatgcagcggcgtgatcttggctcactgcaacgtccacctcctgggctcaagcgatcctcctccctcagccccccaagtagttgggactacaggcgtgcaccgccatgcccggctagtttttgttttttttgtagagacagggttttctccatgttggtcaggctggtctcgaactcctgacctcaggtgatctgcccacctcggcctcccaaagtggtaagattataggcatgagcccccatgccctggcctttgtcttcaattcgtaagtaaacatctcatttcatgtaaaactcactccatgtactcctatagaagccctttttggatgattctcagagtatgctggagaaatacttccttcaaatcagtggttctttttttaaaacagggtctcactctattgcccagggtggagtgcaatggtgccatcacggctcactgcagcctcaacctcccgggctcaggtgatcctcccgctcagcctcccaagtaactggaactacaggtccatgccaccatccccagttaatttttcaattttttgtagagatggggtatcgctgtgttgcccaggctggtctcaaactcctgggctcaagtgatcttcccacctcggcctcctaaagtgctggaattacaggtataagccaccacatctggccaccagtggttcttaaaatgcacatatacacaacatgttgaatagacgtttaggagttgatgtccaccccctgccccacccccgaagcccatccagtatgaaaactagccagcaaggcagcaaagttcacttcagaaatgcagattctctgtcacagtttataattatgaacacaacacacacaagtatttccagttgtaaaggtccctcccaccttcaccaaagccagccggatgcaagaacgcctggtctccttaccacagagccggtggagggacttctctgagtaggtgtctcggtcgcagcctttccctatgtggctggtttctagctccactgtggcctgtactgaggcgactggctcgtcacatgtctccaggtggatatttggaaagacggccaacgcgccggtgcccggctcatactcaatcctgttgttccatcctgtgttggtccacaagtcagcaggggaagagagaaggaaaacacacactctaggttgctgccgcatacatcagttttaagagcagatgtgagcgcaggggagagaatgaagctcaccttgccacccaggggtgcaggtgggcttaatgctgatcttcaccaaaacatcttctgtggctcttttcttcccacagtcataggcagtgacggtcagcttatattgatgttctttcccgtagtttaatttctctgtgttttttatataaccttacagagggcaaaaacaacagtgagagccaaaacccatgctggttttacttttgttgtcctaggcggaaagacaaaatgcataggctttaagccctgtaaatactcagccagaaataaacatatgcttgggatgcttaaccctcaacctgtcctccctgagccctaacacgcactaaatccatcctgaagagtttcaacagaagagacggagctacacagctcagtctccacttactctcacagtgttacattgggctttacattaagatttaactgtttacatacattcagaggattaaaaaataataataattcaagtacctcaaatattaaatataagatcgctgatcaaacatttactatattaaaagaaagagagatttcctacccccacctgcttagaacagaagcctgctttttgaacgtggtgagtatagatctctggaaagtgtttgcaatgtccataattccatcaaagattctagaccgtgcattgattaacaatggaaacactgtattatctttttttttctttttggaacagggtctcgttctcttgcccaggctggagtgcagtggcctgatctcggctcactgcaacctctgcctcctgggttcaagcgattctcccacttcagcctcccaaatagctgggactacaggtgtgtgcctgcagtcccagctactagcgaggctgtggcgggaggatcccgtgagcccaggagttcgaggttacagtgagcagtgactgcaccactacattccagcctgggcgacagagcaagaccttccctcaaacaaaaaaaaaaaaaaaaaagatgtcacaggagattctaacttaatggagaacatggccaggcgcggtggctcacacatgtaatcccagcactttgggaggccaaggtgggcggatcacctgaggtcaggagttcaagaccagtctggccaacatggtgaaaccctatctctactaaaaatacaaacaacaacaacaaaaaattagctgggcgtggtggtgggcacctgtaatcccagctactcgagaggctaaggtaggagaatcacttgaacccgggaggcagaggttgcagtgagctgagatcgcaccactgtactccagcctggggaacagagtgagaaactgtctcaaaaaaaaaccacaaaaacaaaaacaaaaaacttaatggagaacagaaaatgagacaaactaaatgtaaaggtcagtctcattcagatgcatgtggactgaaagttaagaagattaaaaaaacaaagccatgtcaggtaggaggatttttatttgattttggtgggaaagcaaaaaagaggtgagccccacaagagaacacaggacttacaggttccagagaagaagttgtcagggaacaaagtagaaacttaaatgtttttacaattaaaagcaaacacacaccaggttaggtctccaacttgtgagttccatgaagttctgacgaagcacagaagctggggtgtaaagtcagtggggttagcagggactgtctacctagctgaaaagccggctcctcgattcttaccatctttgtcaacagtaaagggcacgtctggagtgatgatttcgtagctgcaaatctggctgaactgaggggagcagtcggcatccacggcctccaccctcaaaatgctgtcgtactgcttcccctcgatgaccgtggctttgtaggacttctccttgaacacgggcgcgtactcattcacgtcgttcacctgaatatgaacagttgctctggacaaagggagggagaaaaatatttttctgcttgttttcagtgtgagagagagacagagagtgtgtatgtgtgtttacccaattctgccctactttaaaatttcctgtttctgataccttgtttcatgaaattcatatgatgaagtcaaaaattaaacaagctattcactgcttttcattcaagtgtggagataacagaaagttaaaagagggatttgggtcgattcttccatatcctaagaataaagcaaaaaaccaatcatctaaaataaaagagacttgggtgtttttttttgacaatatgggacaagacaggcagaagggagataaacaataccagacgtctgtttgctctccaattataaagttgaaacatattttgtagcaaaatccagaaaaaaaatagagccaagggaagaaggggtatgaaacagagaaagcatgaaatggtttgattctgagagttcaaacgaattctgtcctacttctagggaataggctggagtccatggcatcacctggtcctgattcaacaaatggaagagttcaggagaggcaggccgttgccacctgccaataccccagctcagttatcaagaaaattagggtgtcatcagacctggctacaaataaaaaaaactgtaggtttcaagggctaatggtcagggcatgcttctgaatcagtcaaggactttggtcaaaatctgaccttttcaagggaaacaataacattacactgtggaaaaagagaagagactcactggggcactgcaccttctgctcaccatgagcctcctcatcccagtgccatcggtctgaccctcacaatgggttatgtgacaccatctcgcccacatacccttctttagtagatgtgctaagtagaaactgagactcagggccgggtgtggtggctcacacctatcccagcactttgggaggctgaggcaggagggtcaccagaggtcagagttaaagaccatcctggccaacatggtgaaactccgtctctaccaaaaatacaaaaattagccaggtgtggtggagcgtgcctgtaatcccagctgcttgggaggctgaggcacgagaatcgcttgaaccctggaggtggaggttgcagtgagccgagattgtgccaccgcactccagcctgggtgacagagcgagactctgcctcaaaaaataagtaaataaataaataaataaaacaaaagaaaaagaaacagactcaacaaaattaaatttgcacaatgccaaagggctagcaagtggtggagaaaagactagagctctagaaaagactagagcttacaatctaattgtagaagacactggacttgagaacaccagcagtccccagcctttttggcaccaaggactgatttcatggaaggcaatttctccacagatgggggtgggaggatggttttgggatgaaaatgccccacctcagatcatcaggcagtcgattctcataaggagcgcacaacctagatccctggcatgctcagttcacaacagggttcgcgctcctgtgagaatctgataccgctgctgatgtgacaggaggtggagctcgggcagaaatgctcactcgctcacatgctgttgacctcctgctgtgtggcctggttcctaacaggccacggaccagtactggcccacgtcctgaggtatggcgacccctgttctatgttgtcttgtccaaagccctctctgctacaactgcagttcctaactggcaggaggtgcagcaacacactcaggattgtggcagcgagccagcctacttccaccagcagtgactaatttttttttttttttgagacggagtttcattctttttgcccaggctggagtgcaatgatgtgatcttggctcagtgcaacctccacctcccaggttcaagtgattctcctgcctcagcctcccgagaagcagggactacaggcgcgtgccaccatgcctggttaattttgtatttttagtagagacagggtttctccatgttggccaggctggtcatgaactcctgacctcaggtgaaaatcacctcaggtgatctgcctgcctcggcctcccaaagtgctgggattacaggcgtgagccaccgtgcctggccaatttttgttgttattgttttttagggacagggtctcattctgacactcagactggagtacagtggcacaatcatggctcactgcagcctcaacctctcgggctcaagcaatcctcccgccttagcctcccaagtagctgagaccacaggcatgtgccaccatacctggctgtttatgttttgtagagatggcatctcctacattgtctaggctgctctcaaactcctaggctcaagcaatcttcccacctcagcctcccaaagtgctgggattataggtgtgagccactgcacctggccaacaatgattaagtttatgcccttaggaattacagcaaaagataaatatgacaacaaaataaccttcctaagggagaagcagactttttcaatttttaatgtagggcctttacttctttaatagagtatttggtgtgataaaattattcactcattcatttattaaaaacctaggccgggtgtggtggctcacgcctgtaatcctagcactttgggaggccgaggcaggtgaatgatggggtcaggagtttgataccagcctggccaacatggtgaaacccgtctctactaaaaatacaaaaattagccaggcgtggtggcaggcacctgtaatcccagctactcgggaggctgaggcagaaaaatcacttgaaaccggaaggcggaggttccaatgagccaagatcgtgccactacactccagcttgggtgaaacagcgaaactccatctcaaaaacaaaacacaaaaaggccaggtacggctcacgcctataatcccagcactttaggaggcccaggcaggcggatcacctgaggtcgggagtttgagaccagcctgaccaacatggagaatccccatctctactaaaaatacaaaattagctgagcgtggtggcgcatgcctgtaatcccagctatgtgggaggttgaggcaggagaatcgcttgaacccaggaggcggaggttgcggcgagccaagatcatgccattgcactccagcctgggcaacaagagcaaaactccatctcaaaaaacaaacaaaaacaaccccaaaaaacctaatatgcctaatgtgagcaaggctcttgctagaaactgtatacaagggtagagagacatgattcctgccctccaagtgtttacaatctaattgtagacacttgagaactatcttctgcctatttcaaaaacagtcttggggagcaggcaatagtcactactattttcgttctgcgcacacacgtttactcggtgggttatgttcactctttgtccagcttacttacttatgagactttttcacgttggtgccatcaggtcccttcccacaatcataggcctggatggtgaatgaatagtctttctgcagctcacagtccagtttctctttggagcgaatgactccctcaccagtggatttatccactaccactgcatcaaaggggacattctgcccgtgaattttaaatccacaaatctcacctagggagtcaaagcagaacaggtaagaattcctaccacatagatcttctgcaccttgccctcctccccccatctccacccccaaagaaaataaatgacaacaatttggcagccaggggtttggagggtccgtggacaaagcaggggcactgtgttttaaacatggggaagttctcgggctttagtaagatgaagcagattctggctttccaagcaacttgtttactttgcatccattcatgcaggaatacaaaagagagagagaagaaaatatagacaggcattccacaggagcacttagatagctcgagggtaaaaggagtctcattagcacacagccaggcctgagaacaccagcgctgccccagctcctgggagggctggcagccagtttgatttggaccagagagaagctaaaacgcagttatgtgttgagagaggaggaagcgtgagatataggatcagcaccgtaattacagaaattctgtcaaaaaaaaaaatcaaaggaaacaagtcttcctgtgcaatgagcctggctaaaattagggaatcaaaacaaactactcaatgagaaaggtagaaataccgactcgtcaggcatccatttcaacagctattttatcatctacgattcagacacagtttctattatgggagggactggctagacttgcctttgtttcggactttatcctatcaaacctgaaaaagacaccagcctgggaacttctctacatctaaattggctcacaacttaattaggagttaaaaatctatgtttccattcttgtccatgggagaacagtataaatgttttgatgtcgatgtgaaactccacaaaatgtatttcacatgaaaataagactgcactccttccacaattccaactaatagaaaattgttataaagcaaatctctgaagttctattaaacaaaaatgtacagtgttatccatacagttcaaatggatgtctgatttccagatatttctaaccaagggtctggttacatacaatttccatcaatatactttaaaatagaaacaaagtaggagaataaataaggataaaagagcatgacagtttctcctgtttaagggctgattcccaattttataaacaaagttagtgggttaatattcataagaggggaagaaagaaccctttatcaccttctttggtgactgtcacctcaaaactctctaaagggagaaaagataagcccatgtcagtaatacaggaaagaatgaagatggaatacactaaggaaaaaagtcaaaggtgcacatattacacatttccacaccaagctcagcgaccggcttctacgattgctacagcaaaacctaatcttcaggaacaaaatgtcactttgaatccaacttaccatgaactactgcataattctgaagttattaatttagggatgaaatactcctacatgaagtgtcctaacaccctcaggggtcattaggatttttcttttttttgagacagagtctcgctctgtcacccaggctggaatgcagtggtgctatctcggctcactgcaagctccgcctcctgggttcaccattctcctgcctcagcctcccgagtagctgggactacaggcgcccgccaccacgcccggataattttttgtatttttagtagagacagggtatcaccatgttagccaggatggtctcgatctcctgacctcgtgatccgcccacctcggcctcccaaagtgctgggattacaggagtgagcccccgtgcccggcaggatttttcttttaatgaacactctagtgacaaaccatgaataagtacatctatttgttattttgcagttttcagatgttcatttccaacctaaattctctcagctagattctggtaacattcaactcatcagtagatttaatgaaacaaaaatttggagcaaaaggtttttttttttttttgagatggagtcttgctcagtcgcccagactggagtgcagtggcgtgatctcggctcactgcaagctccgcctccctggttcacgccattctcctacctcagcctcccgagtagctgggactacaggcgcccgccaccacgcccagttaattttttgtatttttagtagagacagggtttcaccatgttagccaggatggtctcgatctcctgacctcatgatccacccgcctcggcctcccaaagtgctgggattacaggcgtgagccaccgcacccagccgaacaaaaggttttaaccctttgttcttgaactgaaaaaaatgacaatatttttctaatccaaagtacccaaccaaggcaacaaatataaacccctctgctaatggaacatctgcttaaatgtgaatagaaaccagattcaaaactaactgtagggatgctacaacagtcactgttctcattacatgaaagctctgttctaccaagtcaatatatatcctgcttataaaccctttactatggaggagtggaaatgtgaagagatcaggaatttcgctgcccctcaacacactgggccctcactggtggcaccttctctcccccaaaggtaacacgacctgaattcccttgctttgctaatagtgctaccatttattctccctgaacagtgttgtttcattttgcttggttttaaggttttaaaaatggtatcacatggcatgcagttttttgtttgtttgttttgggggggggtgggaacggagtttcactcttgttgcccaggatggagtaacaagatctcggctcactgcaacctctgcctcccgggttcaagcgattctcctgcctcagcttcctcagtagctgggattacaggcatgcaccaccatgcctggctaattttgtatttttagtagagatggggtttctctgtgttggtcaggctggtctcgaactcctggcatcaggtgatccgcccgcctcggcctcccaaagtgctgggattacaggcgtgagccactgcgcccagcccacgtgcagtttttatgacttgcttctttttctttttttgagacagagtctcactctgttgcccaggctggagtacagtggtagcatctcagctcactgcaacctccactttctgggttcaagcgattctcatgcctcagcctcccaagcagctgggattacaggcgcctgccaccaagcctcgctaatttttgtatttttagtagaaatgggatttcaccatattggccaggctggtcttgaactcctgatctcaagtgatccgcccgcctccgcctcccaaagtactgggattacaggcgtgagtcaccgcacctggccatgacttgctttttcatgcaactttgtgtatctaagatttattcatccttgctggtataggtagctatagtttattcattttcactactacctaacagtgagaatccacgggtcaaaacatgtaaagtgcttaaaacattgcctggcggaaagagagcacttaacaaatgtttgctattattacaatcattttccactgtgtgaaaatgccatcagttgttcctgctgtttaaaaacaatggtgtcatgattatttcggtccctgcttgctgctgcacgtctacaagagcctctgtacgcctgtgctgcctaacatggcagccactagccatgtggggctgttcaaatgcaaatgaaaattcaagctaaaaatcaaacaatgtgaaaaatccagttcctcagttacactggccagttctcaagggcccagcagccacatgtggctggtggctgctgcaagaagacaatggacgcagagtgctccccttggcacagcaagtcccactggacagagttgctttgaattaggggtctgcaaactgccgtttccagaaagtccaacctgttcctgattttgaagagcccacacactaaaaacaatttttaatagtacttcataacatgagaaaattacatgaatttcaaatacaaatacagtttctttttgtttgtttgttttgagatggagtccttgctctgttgcccaggctggagtgcagtggcacgatcttggctcactgcaagctccacctcccgggttcacgccattctcccacctcagcctcccgagtagctgggattacaggtgcctgccaccacacctggctaatttttttgttattgtatttttagcagagacggggtttcaccgcgttagccaggatggtcttgatctcctgacctcatgatccgcccgcctcggcctcccaaagtgctgagattactggcgtgagccaccgcgcctggcctcaaatacagtttctataaatatatttcactggaacacagacatgctcatttgtttaatgtatggtctctgctttcacactgcaagggcagaggttgttgcagagttacatcattgcgaaagagatccgaggggccccaaagcttaaaatagtccctatctagttcttcaccgaaaaggtttgctgatctctgctctagagagacacccacgagtaaaactgcctggtatcagatgtgtccaaatgttttccaggatgtgctaactcacaatattacatgttttgatgcatattaatactgcataatacattttaaagtaatttaggttgcccagctttaatttggataaaacttctcagtttttgacttgagtttactgtggaatagcgaggcagttccacatcatctgaactgacattaatgacagtgactgtggtgtgctttcctgacacaggtctctccataggtaagtgcagatttcctgcttgttggttggttgttttagagacagggtttccctctgttgcccaggctggaatgcaatgatacaatcctagctctcaaaataatcaatattctgagtattgacattggctactttaatgagttccaccaacaggatatggtgcctcaaatccaccagtacttattcaattgctagtcaggctggctcctttacctacaaggacttaaaaaaccaactcgccaggttggtagttcaaggtggcaggtgcagtgtgggctttgcaaaactcaggcagacctgggtcttccacaccagccttgcaaccgagcccatcactgcagagcctgctgagccatctgcagggtcagccagtacgcctacctcaaggggccatttgtgcattcaacctaaaactctacttttaataaggaagacggatcggactggagcaagacaggggctaccacagtacctctgatgagatacaatgagggctgaactaggcactgtcccaaggagacatttaagggatttttaggggaatagatgggacctccacctcctgagttcaagcgattctcccacctcagcctcccgagtagctcagaccacaggtgcatgccacccattcccgggtttttttttttttttttttttttggctacaggtgaggtttcaccatgttgcccaggctggtcttggactcctgagctcaagtgatccacctgcctcagcctccctcagagctgggattacaggcatgagccaccacgcccgccccagttcatggtagtcaaatgcatgctacggcaccatcacatacgaaggtgcagctccaccactcgctatcctaaactcagcctctctcaaactcaaacaacctcatccgttgcagggaaggacctctcagaattgcctctcacatcccagttcctttctgccctgctccctcccactcaattcagctggctctgttacgcaaatctacctaaaaccctgcttttatcaagctgaagacacccaaccaggtttcccagacaacctctccagttaggctctcctaggaatgggccaaatccttcccagtctctttccccaaaccttcattcccctaggagatcatctaaaatggtcaaaaggaactttacttaagaaatttgaggagcaggcctggtaggtcacacctgtaatcccagcactttgggaggctgaggtgggtggatcacctgaggtcaggagttcgagaccagcctggccaacacggtgaaatcctgtctctaccaaaaatacaaaaattagctgggagtggtggcgtgtgcctgaggtcccggctacttgggagcctaaggtgggagaatcacctgagtctcggatgttaagcctgtagtgagccattatcatgccactgcactccagcctctgtactctgggcgacggagtgagaccatgtctaaaaatttttttaaaaatttttttaaggaatttttaaagcaaaacataaaaatatgaaaaatggatgaacccaacaaagtatggatttgacttctggatatccaaagtcacgtgcagggttctcagctgacagcactttgccctcactttcctcatctgtgcctttgacaaaccccagctttaggctggccctgctgttctttcgaagtcttcttcctaatctgaggatggcccctcctacacacgtctcccagctctcaggggaccctgcccttatattgcaaatgtttcctttgctccttacgtataacagctaaggttctctgattgtaagcaacagaaatcctttctaggtaacttagcaaaaggaaactgattggaaaactatcaggaactcatggaactgactgtaggccagagaaagggacttggaaacaggtggaagccaaggcggctggagaccaggaaacaggaaccgcaacagtcccactgcagaacagcctggacagacagacccgaaccgcaactattcttagcatcgctgtcgctccactcaccattcaaacttcagggaggggcacctgttcacttggctaggggaagctgggtaacaggttgtagatccactgatctgtgcccaatgggaaacggatcacggggctgtaaagaagagaaaatgggccgggtgtggtggcccacacctgtaatcccagcattttgggaggccaaggtgggtggatcacctgaggtcaggagttcgagaccagcctggtcaacatggtgaaacccgtctctactaaaaatacaaaaattagccggacatggtggcaggcacctgtaattccagctactcaggaggctgaggcatgagaatcgcttgaacccgggaggcagaagttgcagtgagccgagatcacgccactgcactccagcctaggcgacagagcgagactctgtctcaaaaaaaaaaaaaaagagaaaatggacacttgccaagcagcgactatccacttctccccgctgcactcggccttggtgcccacactcaacggctccgctccactcggccttggtgcccgcactcaacggctctgctccactcggccttggtgcccgcactcaacggctgggtgtccgggctgtccctgacgttgggtgacctctggctttcttgccaagcagcgactatccacttctccccgctgcactcggccttggtgcccgcactcaacggctgggtgtccgggctgtccctgacgttgggtgacctctggctttcttgccaagcagcgactatccacttctctctgctccactcggccttggtgcccgcactcaacggctgggtgtccgggctgtccctgacgttgggtgacctctggctttcttgcttactggtccaggctagtttctggaatgagctcatacgtgtctctaatcagcagttttttcggggtacctttttttttcttttttttggagacagagtctcgctctgtcacccaggctggagtgcagtggcacaacctcagctcacagcatcctccacctcctgcgttcaagtgattcctgtgcctcagcctcccgagtagctgggactacaggtgcacaccaccacgcctggctaatttttgtatttttagtagagacagggtttcaccatgttggccaggctggtctcaaactcctgacctcaagtgatctccttgcctcggcctcccaaagtgctgggattacaggtgtgaaccactgcacccggcctaggataccttaaatatatgtaacaataaccacagactccaagagttacgctctcgcaagttcctcactgactacagcagtggctctcaaattctagtgtgccaaaaatggtctgtgacgcttgttaaaaatgtggtttccaagctccatccccagaaattctgacttggtggttctaggggcagagcccagtgatctgcattttgagcaagcactgccagatgactccaacacagacagtctgcagacctgggaaggtggcccattgggggtttgcaaacctagctggctggtatggatttctcaggtgccactcctggaggtacagactaggcagctgagcatggagctcaggaacctgcactctacaccagggccccaggtgatccagacatagcattggaaaaccccatgcatccattcagcctagcaatggaaaccatgtggactcaagttgacttcaatcctgtgctcctctataccccacgccacacaagctgacctggtcacctaccctgggaggcccttccagttcccacctctgctcccacctctcccctctcttcactgcctatgcaaactccacccaccctttacaggactcaagccctgtaaaccactgtagaaccacttctgggctatctcagcccattcagtgttgctacaaaggaagacctgaggctgtgtaagttataaagaaaaaaggtttctttggttcacacttctgatggctggaaagttcaaggttgggcatctgcatctgatgagggcctcaggctacttccactcactgcggaaggccaaggggaatcgtgtgtagaaatcacatggtgagggagaaagaaagagagagagagagagagagagagggagagagagaggtgggtgggggaggaggaggagcaaccacaggctctttttagcaatgagctcttgtgggaactaaaagagtgagaattcacccactaccccccaccccaccacctcacccccatagccagggacaacattaatctattcatgaaggattcaccccctgtgacccaaacacctcccattaggccccacctccaacaatgggatcaagtttcagttaggggcaccatggctcatgcctgtaatcccaacactttgggaggccaaggcaggtggatcacttgaggtctggggttcaaggccagcctgggtaacatggtgaaaccctgtctctactaaaaatacaaaaattagccaggtatgatggcacaggcctgtaatcccagctactcggaaggctgaggtgggagaatcgcttgaatatctgaggcagaggttgcagtgagctgagatcccgctgctgcattccagcctgggtgatgaagtgaggctccatctttaaaaaaaaaaaaaaaaaaaaaaaaaaagtttccacatgaggtttggaggggacaaacatccaaactgcagcacttgcctccttagcccacaccatcgttgcctctgtcacttggggctgaactacaagtttcctagtatcctttgccaatcttggtttggccctcttacccacattatcagtggctttgaaaacaggaaccaacttttacacttttttttatcatctctggaaaacctagcatagctacctagtatttaatcattactgatcccaaactcttcctgggtggtgtctacatccaaaatgggtccattcaagtcaatcacggttaataagaagcacctgtcctaacattcagctacttacttaaaattgttactcaatgcattattgccttcgattaagctgaagcatgtgaaatgtcatttttttttcaaataccttaatatttcaacatttaaaaaaattgggccaggcgcagtggctcaggcctgtaatcccagcactttgggaggcaggcagatcaactgaggtcaggagttcaagaccagcctgaccaacatggagaaaccccatctctactaaaaatacaaaattagccgggcgtggtggcgggcgcctgcaatcccagctactcgggagactgatacaggagaatcgcttgaacccaggaggcggaggttgcggtgagctgagatcgcgtcattgcactatagcctgggcgacaagagcgagactccatctcagaaaaaagaaaaaattggcctggtgcggtggctcaatcctgtaatcctagcactttaggaggctgaggcagggggatcttgaggtcaagagtttgagaccagcctggccaatatggtgaaaccctgtctctactaaaaatacaaaaattagccgaaatcacttgaacccgggaaacggagactccatctcaaaaaaagaaaaaaaaaaatggaggccaggcgccgttgctccacctgtaatcccagcactctgggagactgaggcaggtggatcacctgaggtcagcagtttgcggccagcctggccaacaaagcggaaccctccctctactaaaaatacaaaaattagccgggcgtggtggcggcgggcgcctgtaatcccagctactcaggaggctgaggcaggagaatcgcttgaacccgggaggttgcagtgagccaagatcgcgccactgcactccagcctgggcgacacagcgagactctgtctcaaaaaaaaaaggcaatttcatgcaggtcaaccaattcactgctgcaagcacaaggtcagctcagttacatgtgctaaaaaagcaaaactgggcagtgaaatgcagcagttaaccccactggccaccctcagggcatgtgaatcacattcataacaaagaatacagacaagagtatcacagggctcctcggtgggctctaactgactatcaatgaaaactaagttcccattcttgccctgaaacttcttttggattctatttgtatcattatggttcaaccaatcttgtaaaacatccatacttaatctggaaaagcaggaaagagattgctagaacaccaccacctcctagaaggaggagctctgaagaggaaacaagaagaggaggcacggcttctgacaagaacagaatgcatcatcttcaaggccccaaccctgtggcccacacatgaggctcaagctggtaactctccacgaaatatataaaatgtaaacaaaataggccgggcgcggtggctcacgcctgtaatcccagcactttaggaggccaaggcggaggatcacttgaggccaggagttcgagaccagcctggccaacatggtgaaaccccgtctctattataaatacaaaacattagctggctcgtggtggtgcacgcctgtgatcccagctactcgagaggctgaggcatgagaattgcttgaacccggaaggcagaggttgcagtgagccgagatcgcgccactgcactccagcctgggtgacagagcgagaccctgtctcaaaaataaatagataaataataaaatacaaaaattgttttctgacccatgactactcaggctttcagcagattaaagagaaggcgcagaacaagaaactgaatcatttaaatttcctaaaacacttgacaaataccaagactctgtatcagaatttcaccccaaggaaacaatccgggcgagactggatcttcattgtgaatgtctgattagtgatgacttacaaggagcttcaatgactaagctcccagcattgcatgtgcattcatttcagagctctaacaagtgaactcctgtggctacccacacacacatgccttgtagtgggatcacactatgaactggaatgttcacacagtgagctgggcccagaggcggctctgtcacttatgagctgtgtgatcctgggtaaactcatctcctccctctacaaatatctatggagtgactgtgttccaggcactgacggaggttttggggataaaatggaaaacaaagtagcttctcctgctgtcacgcagctggcagacacgctgagcctggttcctcacctggagaacagggacagtgggcatgtctactgcgtaagattggagaagagaggctgggcgcagtggctcacgcctgtaatcccagcattttgggaggccgaggcgggcagactgcctgagctcaggagttcgtaaccagcctggggaacacggtaaaaccccgtctctaataaaaattacaaaaaattagccaggcatggtggcatgcacttgtagtcccagctactcgggaggctgaggcaggagaattgcttgaacccaggaggcggaggttgcagtgagccgagatagcaccactgcactccagcctgggcaacagagcaagactccatctcaaaaaaaaaaaaaaaacctgctgaaaagaatcggagaaagtaacccacaccgggccctcagagcaacctctgccacactgcaggcactcaataaacgttagatgccaccaccatcaccaccctcctcctcaacatggtgcgaaattaaactcaatgtcatcacccaaatcaatctaagatgaaaataaggctccaggtctagcctctgtcttatccaaaaaatacttaagaaagtctgtaagaaaatgcaacactataacgacttttgtagaaagatgaaaaaatatttctcacaaaatgttaagtgaaaaaatatttttaaaagattctattagtagtaataacagcagcggcaaatactgtaggtggtaattactgtaccacccactgtttaaagctcttcacacgtatgaataaagaagctaacattcccccaaaccaatgaggtctgtgacattaatgaggtctgtgacatcttatccttttacaaatgatgaaatggaggcacagaaagggtaagtaatttgcctaaggccacacagccaataagtagcagagctacgattcactcactggtccctcggctctagggtctctgttcctgacctcccttgctcagtctcatagggtcctgttctgtgctgggtggcaccatgggggcggggttgtcctggacggcaccatgggggcggggttctgtgttcggtagcaccatagggatggggttctatgttgggcaagatcatgggggcggggttctgtgctgggcggcaccatgggggcggagttctatgttgggcggcaccatgggggcgggattctgtgttgggcggcaccatgggggcgggattctgtgttgggcggcaccggggggcggggttctgtgctgggcggcaccaggggggcggggttctgtgttgagcggcacaatgggggtggggttctgtgctgggtggcaccatggggttggcgatctgtgttgggtggcaccatgggggcggggttctgtgctgggtggcaccatgggggcggggttctgtgctgggtggcaccatgggggcggggttctgtgttgggtgacaccatgggggcagggttctgtgttgggtggtatcatgggggcggggttctgttaggtggcaccatgggggtggggttctgtgctgggtggcaccatgggggtggggttgtgttgggtggcatcatgggggcggggttctgtgttgggtgacaccatgggggcggggttctgtgttaggtggcactatgggggcggggttctgtgttgggtggcaccacgggggtggggttctgtgttgggtggcaccaaagcaacagaagagggagggagggaggaagcaacacagggagaaagtaaaggagaaagggaaagagggagggagggagggaggaaaagggggaaggagggaagaagggatggaaggagtgagggaggggggaacagaaggagggaatgagggagagagggagaaaggggaaaagggagggagggagagggagggagagaggaaggaaaggacagagggaggaagcgaaggagggaaggagagagagaggaaggaaatgagagggagagagggagggaggaagggagggaaggaaggagggagggaggtaaggagggatacggctgcaggtcaggtgctccctcccccccatgcagctgcccactcctccagcagaggaccccacgcttcagtcaaggggatcagttgcactcctgtgtgtatactaaaggactgaaaacctatgtccacacaaagacctgtacaggaatgttcacagcagcatgacccataatagccaaaaagtagaagcaactcaaatgtccatcagtggatgaacagagaaacaaaatgtgatctactcatagaatgaaataatatccagcaacaaaaaaaggaatgaggggctgctaggcacctaacacaggtaaactgtgaaatcaccatgctgggagacgcccatcacaaaaagccgtacagtgcatttacatgattatccagaatagagaaatctgtagtggtagccagggcttgggagtgaaggagactgagggatgagtgccacttggtgcaagggttcctttttggggtgatgaaaatgttctggagttagacagtggttggcaggtgcatggtttttggaacattctaaaactcaatgagctgtacactttaaaagggtgattttttggcagggcgcggtggctcacgcctataatcccagcattttgggaagccgaggcaggcagatcacgaggtcaggagattgagaccacggtgaaaccccatctctactaaaaatacaaaaaattagccgggcgcggtggcggactcctgtagtcccagctaatcgggaggctgaggcaggagaatggcgtgaacccgggaggcagagcttgcagtgagccgagatcgcgccactgcaccccagcctgggcgacagagtgagactccgtctcaaaaaaaaaaaaaaagggtgatttttgtggcatatgaattatctccaaaaaagaaaaaagaaagaaaaaatattatatgagtaactgtgcttcccccatgaaaatatccaaaaggaaaatattgacttatctatccactatggcaaatacaaccaagttaccactataattggatttaaattgcttttctatacagttaaaatacatatcacaacatataatttttgtacatcagtaaaaaaaacctgagaatctctaaaaaataaacttgtataagtattatttcatctagaatatcttaagtttgagaaatacacaataaaattaaatacagtaagaaaaaaatatttcattgataagactttttctttcaaagttaacactcggcgtacatttcatttcctacttccttgtgaacttcgtgcagttaaagatgtagctacgtcatcgtagcaggcagctgtcccgcctgggctggagccctgcctctgcaccccccgaccagctacacgcccagagcaatagcttaactattctgtgcctccgcttcctgcctttaatgcagaaaagcgtatttattatcttatggttattggggattaaatacaaatttatatttgtacagtacttagagtagtgcctgggacattgctatgcatgctttataagtgcatgcattattggctgggtgtggtggctcacgcctataatcccagcacttcgggaggccaaggcaggcgcatcacctgaggtcaggagttcaagaccagcctggccaacacggtgaaaccctgtttctaataaaaatacaaaaattagcagggcatggtggcgggcacctgtaatcccagctaatgggaggctgaggcaggaaaattgcttgaatctgggaggcggaggttgcagtgagccgaaattgcaccactggactccagcctgggcgacaaactgagacaccgtctcaaaaataaaacaaaacaaaataaaataaaatagtgcatcaattattaacaacatagtaagatcacactgcacgaacaacaggactgctgatacttcaaaaggcaaaggaggacctgagggagcaaatacacaagcctggactgcaatcacttcttgaaatgcgtaaaacatcagtaatgtatataaaactgctcaaaaacataaactaaataattctgttaaaatgatctatccactagcactttgcaaggccaaggcaggtggatcacctgaggccaggagttcgagaccagcctgaacaacatggtgaaacctcgtctctactaaaaatacaaaaattaggacgggcatggtggcttaagcctgtaatcccagcactttgggaggccaaggcgggtggatcacaaggtcaggagttcaagaccagcctggccaatatggtgaaaccccatctctactaaaaatacaaaaattagctgggcgtggtggcaggcacctgtaatcccagctactcaggaggctgaggcaggagaactgcttgaacccgggaggcagaggttgcagtgagctgagattgcaccactgcactccagcctgggtgacagagcaagactgtttcaggagaaaaaaaaaatgtgggggaaaaagcaaaaataatcaccctggcaactggacaaatgctgtgtgtgtgttcacggcatggggtactgcctctactgtccttttcatcagaattctctctgaaaattaataaacacacaaaacaacttgggaggctctatctttacagcacaagctggttcacgggtgactgtgctgaaaatgtgatgtggcgcctaaacagaatgaagtacaaatttatttttcaaatagttcttcagaaacaaactcatgtttatttccttcaacttactatagtaaaattaacatatgtttcatacaaattcatccaatttttcttatttgtccctagacaaatagaacacttttttttttttttctgagacagagtctcactctgtcgcccaggctggagtgcagtggcgcgatctcggctcactgcaagctccgcctcctgggttcacgccattctcctgcctctgcctccggagtacctaggactacaggcgcccaccaccacacccggcttttttttttttttttttttttttttagtagagacggggtttcaccgtgttagccaggatggtctcgatctcctgaccttgtgacccgcccgcctcggcctcccagagtgctggcacaggcatgagccactgtgcccggccagaacactctttaatacgagaagtttttgtttgttttgttttttgagatggggtcttgctctgttgcccaggctggagtgcagtggtgcaatcaaggctcactgcagcctccacctcctggactcaagcaatcctcctgcctcagcctcccacagtgctgagattacaggcatgtcactgtgcccagccgtgcaggagaagatctgatctggaaaaatatgcgaaaacaactcttaaaaattaactttacaatgtcaactccaactctgaggcagaaaaaaggtggcgcagcccattctctaccagttaaggacccaacgtgaagccagaacagctctgacttggaaaatgctattaagtgttagcaatgtacacggttattacagtatgaaaatctccaaagcaatgctacaggtttgtctctataaagactgaggctacaatctcatgtctttaaaattcactgaaggtaaaatctatgccaaaagcattcctctataaagaccgctcaacttcttcaagtaagtcttctcaggtcattgaaatctaggtaatgcaaggaacccctggcgctgtgattctccggctccatgccacttgaggaccagcaacaccagcagtacctaggagcaggtgagaaaggcagaatctcaggtcctcccagacccgctgtctctacattcctcaggtactccgtgtgcaccctagagccagggatgcactggtctaggagttatctggctacattaagataaagaaaaaaattatgcaattaaattaaacagtttgtttttcaactataagaacaggcctttttgtcagctaccccaactattaaaaggaaaaaaaaacatgctacaaaggacgctacaaataaccctcagctatggagacattttcagaaacgctcagcattacccaaatgggatgtgcagaatgcttcctgaccaggcccgattcatcaagagtcaatgaaagccccgttcctacctgcaaatcgcagaggcgcatctttatccagcgcgatcagtggggggtcgaggagcacggtgttgtcgttctctgtgactatgccgtggtaggtgggctccagccagggcttgtgcttgttaactgtgtttaaaacaagagaaaaaaatagacaaggttagaaatattattttcaactccactacttttgaagacacacacctgctattaaaataataaaactctcattaggcttgaagacagtgctcacagttctgtcgcaaaatttggtatcaagacccaaatgagatgaaattctaaattccagaataagtaatgttgaaattatctgaatccatgaagcaaccagaaataagaaataaattgctctagaaatcaagggaaaaaaaaagactgatggctacgggaagactatctctgttttcagcctatcactgaaaagttacaaagaaaggtattttcacttctttatgattttttgagacagagtcttgctctgtcacccaggctggagcacaatggtgtaatcatgactcactgcagcctcaacctcccaggttcaggtgatcctcccactcagcctcccaggtagctgggactatgtgtgtgcaccaccatacttgacttattttttttttttttttactctttgtacagacagggtttcaccatgttgcccaggctggtcttgaacccccgggctcaagtgatccgcctgccttggcctcccaaagtgttgggattacaggcgtgagccacggcacctggccccagtattattattattttttcttttttctctgttgccaaggctggaatgtagtggtaggatctcagctcactcactcattaaaccaccgcacccagctgcccaatattaattttaaatttgtattacaaataataatgtaaagcaaagatgcaaaacacaataaagtattaaaataaaactctgcagaatttcagaaaaacccaccacttgactgaaaacaagagtgtttaagaataatccatccgggcgtggtggctcacgcctataatcccagcactttgggaggctgacgagggcggatcacctgaggtcaggagtttgtgaccagcctggccaatatgttgaaaccctgtctttactaaaaatacaaaaatgagccaggtgtggtggcacacacctgtaatcccagctactcgggaggctgaggcagaagaatcgcctgaacctgggaggtggaggttgcagtgagccaagatcacgccaccgcactccagactgggcgacagagtgagactccgcctcaaaaaaaaaaaaataatccacttttgagttaggcttggggtccaattccagcctccctctattatgagctgtgtgaccttaattaagtacattaacttactgccggaaaagggtcccaatccagcccccgagacagtgttactgaacttcatgcagtaagaattcggggcaagtccacagagtcaagtgaaagcaactttattaagaaagtgaaggaagaaagaatggctactccacaggcagagcagccctgagggctgctggtcggctatttttatggttatttcttgattacacgctaaacgaagggtggattattcatgagttttcccggaaagatatgggaaattcccggaaactgaggactcctccccattttagagcacatacagtaacttcctcacgttgccatggcatttgtaaactgtcatggtgctggtgggtctcttagcatgctaatgtattttaattagtgtataatgagcagtgaggacgaccagaagtcacttttgtccccatcttggttttggtgggtttcggcgggcttctttatggcaacctgttttataagcaaggtctttgtgacctgtgtcttgtactgacctcctacctcatcctgtgacttagaatgccttaacctcctaggaatgcagcccaatagatctcaaccttatttcacccagaccctattcaagatggagtcgctctggttcaaatgcctctgacaaactgatctcaagttcctcgttcgtaaaccagggacacccccaccctcctctcggtgatggcccggatcactggagaagtgctatcttgtcccttcttgattgggactctaccagaactgctacttttgcttttctggccgctgctgacctcacttccctgagaagatgatcatttagcccctgtctgctttgctttgcctggggctcggctcctaagtgtcgatgtcagacgtcctcctggtagccatgaatccctccctgagccagcagtatctccacacgcacactgggggccctgttccacagctcaaatatttccattttccttttatgttcaccttaagagggttaacagcttccattataacctcagactatgaatgaaccaggggactcctcgattaagctgatctgaaaagatggaaagaaatggcttgaaaacgttgtttccaagtagacggggcctacttattgaatgaaccactcaggttctgttaagtgtgagtcaatccagaaggatcttcgtgcaacattccaggatgtgatgctacctctgctgtacctgcactttccccagagtggcacccagggaggggggtcacgctcacgtgtaaggctcagagtaggcgtgtgaaggcttgcatctggaaggaagacagaccagaacaaagctgcctcctctcttttttttttttttgagatggagccttgctctgtcgcccaggctggagtgcaatggcgcgatctcagctcactgcaaccttcgcctctcaggttcaagcaattctcctgcctcagcctcccgagtagctgggactacaggcgctcaccaccacgctcagtttctgtatttttagtagagacgggatttcaccatgctggccaggctggtctaccaactcctgacctcgtgttccgcccacctcgcctcccaaagtgctgggattacaggcgtgagccactgcgccaagccgctgcctcctctctaattaatgaaacatttaccagacatttgtacacactacatccaagccaagagcaaatccttctggcttcacttcctaaataaacccagaccccggggagttgttgtttaatgggtataaaatttcggttttgtgagatgaaaggaatttggaggttggttgcacaatagtgtgaatgtacttgatgctactgaactgaacgcttcaaaatggtagacaggaaaattttgctgtagtttacatttaaaaaaaaaaatccacatacacacaaactcagacacagccatttcttacctccttcctgaaaggtcacaaaagccaagtaacaagcctccctgtccttatcccggcacttactcggcagccagagggaagcttctacaacaatgggtcttcaactttggggtctcagaacccctgtacaccaaaaagttactgagggacccaaatagcttttgtttaaatggattggtcagtcagttgattatccatccatccacccacctatctctatctatctatctatctatctatcagcatttatctatcatctatcagcatttatctatcatctatcagcatttatctatctatctatctatctatctatctatctatctatctatcagcatttactacactgaaaattaaaaccagtccaggagcagtgtctcatgcctgtaatcccagcgtgttgggaggctggccacacagatcacttgaggtcaggagtttgagaccagcctggccaacatggtgaaaccctcctgtctttactaaaaatacaaaaattagccgggtgtggtgacacgcacctgtagacccagcttctcgggcggctgaggcaggagaattgcttgaacctgggaggtgcaggttgcagtgagccaagattgtaccactgcactccagcctgggcgacagagcgagactgtctcaaaaaaaaaaaaaaaaaaaagcctgggagtggtggctcaagcctgtgatcctggcactttgggaggccaaggcaggcggatcacttgaagtcaggagttcaaggccagcctgaccaatatggtaaaatcctcctgtctttactataaatacaaaaattagctgggcgtggtggcacacacctgtagtcccagctactcaggaggctgaggcaggagaatcacttgaaaccgggaggtaaaggttgcagtgagccaagatctcgccactgcactccagcctggacaacagagcgagactatgtctcaaaaaacaacgacgacaacaaaaaagataattttaatacttattaactcatttaaaaaacaaacacattatataatacattcacataaacaatatttttatgaaaataactttttgaaaacaaagcttactaagaagagtggcaacagttttgtttttgcaaatctttgttgtccaccttcacagaagacacctgagttctcgtctctacccccgctccccctgcactcagcctgctgccttgctccccttaacatagtctctagaaaatgccacagtgcagcctaagaggatgagaaaacggcaaataatgtcttaatattgttacagttctgccctctcgcatcctgccagggtttcagggactcagtatctcactcgggctctgttgaaaaggtccttcctgctgctctcaccaacctcgctctgtccctctgttccaacacctggggagaagacggcaggggagggcactggagcccagtgcccaaaggcctgggtgggacctgcctgggctccaaagggcccgcgacctcagggccttcgcttcctcatctagaaaatggggacaataatagtccccatctcataggtcgttgtgtgattaaacatgcaatcacagttcattacatataaaatgttcagaagagtgtctggcactcagtaagtatcaaaaggtggtggtgttatttctcctccccaacacacacacacacacacacacacacacacacacacacacacacacgcagactgtgagaaagtggccttttcattctctaattcccagtacctggaattatgcttagcacacatgcaggaactatttgggaaatgagtatataagaaacctcaaatgcgcaaatcagatcagttgccctgatttatgaattctctcatggagaagatagctttggagctgggaattcaaaagatactgcgaaggtgtttttttttatttttgtttgtttctccaggtggatgttctgagcaagagagctagaaaatctagagacaacgcacgaaaccaacaggtcaaaagacatcagtctggaaaaggttaagttatggaaggttagattacagagggacttaatatgaaatcaaacccagaccataaagaccaaaaataaaagtgtctttgaaatccgtcttctccccccgtccataggctgctctgaaacaagagactggctaagaagagaataaggggccggatgcggtggctcacgcctgtaatcttagcactttgggaggccaaggcgggtggatcacctgaggtcaggagttcgagaccagcctggccaacatggtaaaaccccgtctgtactaaaaaaaaaaaattacaaaaattagccgggcgtggtggcaggcaactgtaataccagctactcaggaggctgaggcaggagaatcgcttgaacccaggaggcagaggttgcagtgtgccaagaccgtgccattgcactccagcctgggagagaagcgagagacttcgtctcaaaaaaaaaaaaaaagaagaagaagaagaagaaggctggctatggtacggcacctttctcctgcgagcctccctggagcagcagggggtctgccggcaggaggtatgtgtgaggctgtctgtgggagctttacgcacagactgcaccagcatcaggtctgaaacggctctctgagagaataacttgactttgcaatcaggttgaacactttatctaaccactgaaactcaacatcctctccagattatctttttaaaaaaatttttaggacgggtgcagtggctcatgcctgtaatcccagcaccttgggaggtcaaggcaggccaattacctaaggtgaggagctcaagaccagcctggccaacatagtgaaactccgtctctaccaaaaatacaaaaattagccaggcgtaatcccagctactcaggaggctgaggcaggagaatcgcttgaacccgggaggtggaggttgcagtgagccaagatcgcaccactccaacatggagaaaccatggagtttgactccagcctgggcgacaagagtgaaactctgtctcaaaaaacaaaaaaaaaagtttttttagttgagatgaagtcttgctatgttgcccacgctggtgtcaaactcctgagctcaagcaattctcccaccatggcctcccaaagtgctgggattacaagtgtgagctacaacatccagctcaggtatctatgaaaataaaccatgctatgatgtaggctggaagaagcttagagttacagatgtaagataggccattttaaagaaaggactccaaaaactccattgtttgttaccaatctttcactttctttttttttttgagatggagtctcactctgtggtccaggctgaagtgcaatgaatggtgcaatctgggctcactgcaacctttgcctctcaggttcaagtgattctcctgcctcagcctcctgagtagctggaattacagacgtgcatcaccacactcggctaatttttttgtattttaagtagagatggggtttcaccatgttggccaggctggtctcgaacttcagacctcaggtgatctgcctgcattggcctcccaaagtgccaggattacaggcatgagccacggcatccggcctccaatctttcattttaaagcaaaaattgctagttcaatttgccactaatcaaattaatattcgattccaatttggcttcatactttaaggttttattaataaaattacaagcactataaatactaaaactaaatattcttctaatatttgagtccataaaactcctgagacttaaactaaatgaatttatgtctttatttagcccaacggggatgtaaaaataccaggcagagcacattacagaaaacccatgatgagtagtaacgtaaaatgtgtgtttctgctgcccaaatggaaaggcctgcagctgaaatggttaagggttcggtggaaaaataactgtgtaactatgttcccagtattccaattttataattcaaattttctaaatcgctcttaagctggcagtagaatgagatctggccagttccaaacactgaacttttaaatatttaatgagtgatatttttaatatttcatcacattcaatttgcatcataaaacatttacagaaacaagtgaccgatgtttctgtcatcatcacaaaaaaatggcaaagacaagagactactggctgcaagtctaggaacgtgtcacctatgtcggaagtctatacctgactcatttcatcacattctaggaggttttaaaaaacaaactaaactgcttctcctgcctcccttggcctcagccatggcgagtagccgtggcagcgaatccaaatgcggtgcgggagaccatggacaggatgctgaataaactgtgtgttgtgcacctgcatcttgactttgatccatcacatgaggtgtggaattttccactgtggtgtcatgtcggtgcttaaaaagtttcggattttggagcatttcacatttcaggttttgggattaagagtatccaacctgtactaatcacacattctgcttgagatttcaagaatttagaatgctggcttagatatggaaactcctatttgtgtacggctttgtgaacaagaaattaacccagaagctttatcatcagttattaaggagcttcgcaaggctactgaagcactaaaggctgctgaaaatatgacaagctgattttctggggaaattctgatgagatatgtcaagctctgcaagaggatttaaagattgcactgtagtcgagaatgtacaatgatactgaatgcagcagtgtagaaaaattttcctttttaaaagaattataaaaccatagcattataaatcagtggaaagtggcttacagacagaactatcagatgtgtttacatcacatcttattcttttttttttttttgaggcggagtttcgctcttgtcacccaggctggagtgtagtggcgtgatctcggctcactgcaatctctgcctcccgggttcaagcgattctcctgcctcagcctcccaagtagctgggattacaggagtgcactaccacacctggataattttgtatttttagtagagatggggtttctccatgttggtcaggctggtcttgaactcccggcctcaggtgatccgcccaactcggcctcccaaagtgctgggactacaggagtgagtcaccgcgcccagcttattcactttttttaacggctctaatgcttccacatcgccatgttcatatttatgtattctttatttatagctttgatagctttaattttctaagcagtctatcagatgtgcacatctgctgtgcctgtagtggaacccatcagtagtaatgtgtagtagttgtgacttgttgacatttccactataaattttaactttgaattgtttatgcattataactgtggatttatattgtattgggctgaaagctgacactatttcagccaccattggtgaattctgatttagattcattatgtatgtcggaatcttgttttttaaaataagagcatggaaaacatttcttgcaatctgatctttaacaaagaatacttagttttttaaacagtttgttgggcagctaataatgtgaaccaggtcatttttgtattgagtaaaaatttaaacttctagaaacttagattttaaaagtaatgacaatgcttaggttagtattatttgcaattcgaatcatttacagctaatgagaatgttttcttaaagttttataccctataaatggaggcctaaaaaaatgtgtaaaatgaaacatagcaaacatgccaaactcctgtttacttttcttacataaaagtaatttgagtccttgactaataaatcttgaatggttatttaataagttattaggtaagtaatgtgtttcaaaaaaaaactaaactttgaatgtattaatttaaaactatgcaaaagcaaagctggcaatcaaaccttctacaagtgcaggctgtagctaggcacacacctatcatttcaggatatgactcattttttagggttatggtagatttcagtcattagaaattatttgatttttaagtcaagatgaaaaaaatacaataatcaactttaggattaacatgaatataagctatgctgccccagcacaacccaactctgtgggctaaagagaggctagacccgggccgggcgtggtggctcacacctgtaatcctagcactttgggaggccaaggcaagcagatcacctgaggtcaggagttcaagaccaacctggccaacatggtaaaaccccgcctctattgaaaatacaaaaattagccgggcgtggtggcacacgcctataatcccagctacccaggaggctgaggtaggagaatagctggaacctgggaggcggaggctgcagtaagctgagatcgcgccatcgcactccagcctgggtgacagagcgagactccatctcaaaaagaaaaagagagagagaggctggacccatgcctaagtctcacaagtaacggggatttcagcaggttggttgcagagcccagacgccaaccacaggtcccagggtggccctgatatcagtcaacccagtacacgaacagttcctttccggtttattcactcatatggatggttccccacttacagtggctcaacttaggatttttagactttacaaagatgggtttatcagaagataaacctgattgtaagtaaagaagactttgtaactagaaatccacggtttccagccaggcgcagtggctcacacccataatcccaacactttgggaggcccaggtaggaggattgcttgagcctagaagttcgacaccagcctgggtgacaaggtgtgatcccgtctctacaaaaaaatgttttaaaaaattaggctggacacagtggctcacgcctgtaatcccaacacttcgggaggccaaggcgggtggatcacctgaggtcaggagttcgagaccagcttggccaatgtggtgaaaccctgtttctactaaaaacacaaaaattaggccaggcacagtgtctcgcgcctgtaattccagcactttgggaggccgaggcaggtggatcacctgaggtcaggagttcgagaccagcctggccaacatggtgaaaccccgtctccactaaaaaaatacaaaaattggccgggcacagtggctcacgcctgtaataccagcactttgggaggccaaggtgagcagatggcctgaggtcaggagttcgagaccagcctggcaaacatggtgaaaccctgtctctactaaaaatacaaaaattaaccaggcgtggtggcgggtgcctgtaatcccagctacttgggaggctgagacaggagaattgcttgaacctgggaggcagaggttgcagggagctgagaccacactattgcactccagcctgggcaacaagagtgaaactccatctcaaaaaataataataataataatacaaaaattagctaggcgtggtggcagatgcctgtaatcccagatacttgggaggctggggcaggagaattgcctgaaccagggtgacggaggttgcaatgagccaagattgcgccactgcactccagcctgggcgacaggagcgaaactctatctcaaaaaaaaaaaaaaaaaaaaattaaccaagcgtggtggcatgcacctgtaaccccagctactcggaaggttgaggcaggggaatctcttgaacctggggggcagacgttgcagtgagcagagattgtgtcacttgcactccggcctgggtgacaaagcgagattccctcttgaataaaaaaaaaaagttagctggcatggtggcacatgcctgtactcccagctactcgggaggctgagacaggaggaatgtttcagcccaagagttacaggctgccgtgagccaagatctcaccactgcagtccagcctcagggagaacaagactatctctaaagaaaaaagaaacccactgtttcaaacaagagtgtgatgtgtgcctcttatcatgacacgtaggttggtcatgtctgcccttaaaaaacaacagctaaatattgcaagagactgttggcgtctcacctataaatcctagatgatgttacaggtttcatttgcagattcaacttttaaaccttggtctatcataagaacctgcaattaaggaacactgccagcaggtggtgacaggtgcccttgcatgctccaagttctcaggctttgattttaaaatcctgctagttaatttccaaaggcgagctagtaggcccttgttaaagatgacatgggtagaaaagtatcttaaactctaagtttaaaatctccagctgattctttttttcctcaaaaaagcatttggaacaggtaaaatattcacagttttaaaatcaaaatataaaaaggcattatctctgggtctctaagtattgtccctagtcataaattctttttttttttttttttgagagtcttgctctgtcacccaggctgaagtgaaataaaactacaatgtgtgccaccactcccagctaatttttgttatttttagaggagaggggttttcaccatgttggccagggtggtcttgaactcttgacctcaggtgatccaccgtgcctggctaatttttgtatttttagcggagacagggtttcaccatgttggccagtctggtctcaaactcctggcctcaagtgatccgcctgcctcagtctcccaaagtgctgggattacaggcgtgacccactgcacccagctgtaaaacagattttttaattactcttatttttttttttccaaagactgaacactgccaaagaatctctgtatgcacaggtttaaggatttcttcatcagaatcccaaacaaactaaattttaaagggctgattgaaacaccaaatacatagcttagacattatttagatcagggtttctcaacagctggacactctgggccagacaatgtttagctgtggggctgtcccgtgcattgtgggacgttcagcagcatcccggcctcaaaaccactggatgtccgcggcctccccaccaagatgtgccaaccagaagtgtctccagacattccccaagatcccctgggggcaatcctcctccctcctcccttgagaaccactgactgacatccaccccgttaaggaaaaccaatgatgtctacatgaaaatcacttgtacactttaaaagagccactttaataatttgtgcattacattgatgtgaatttctttttttttttttttccgagtcagggtctcactctgtctcagaggtgtgggacaccccacccagcttgaagttaatttttaaaataaaaacacattaaggccgggcacggtaggtcatgcctgtaatcccagcaatttgggaggttgaggtgggtggatcgcttgagttcaggagttcgacaccagcctgggcaaaatgataaaaccctgtctctacaaaaaataggaaaaaattagccaggcatggtggtacacttgggagctacttgggacctcccagctactcgggaggctgaggcatgagaatcgcttgagcctgggaggtggaggttgcagtgagctgagatcacaccactgcactccagactgggtgacagagcgagacctgcctcaaacaaacaaaaaacacacacattaagtgtcaaataaattcttaagctaacagaacaattgagttttttaatagtacagtgaaactttccctgcatttattcacttttcccaggacaagcatcataccaccacatactgttacacacaatgcagctgttctacgaaaggtgaggctgggcgcggtggctcatgcctgtaatcccagcactttgggaggccgaggcaggctgatcacctgaagtcaggagttcgaaaccagcctggccaacatggcgaaaccccgtctctactaaaaacactaaaaattagccaggtgtggtggtgggcacctgtaatcccagctactcaggagactgaggcaggagaattgcttggacccgggaggtggaggttgcagtgagctgagattgtgctattgcactccactgcagcctggctgacaagagtgagactccgtctcaaaaaaaaaaaaaaaaaaaaaaaaacaaaggtgagagctgtttgcaagctctgcacatctggatccactctcttgctcacaggctgggacacctgcctgtccgccaccaggcggtctatggctgggcatgggctcaccactacccagctcacagggcctgagagctacatcgggctcctcgtgttggggagcgcaaggcatgcatggtggcatcatgagaaaagaccagggaatgagcaggaacagatggaggaggaacccctatgtccttctccctggtgcacatcccaccctgaacactaagaaggaagcaaggggaccagaccctgcacatgagcctcagggtaggatgccaggagagtcccaagaacgaagttgggggtgaagaggtggctgcaggggtgagaagagaaggggaaggggctgggctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaatgccaaaccactatcagaacatttccaactgttgaccgtatattttcattcaccaattaaatgttgtttgagattgagtctccctctgtcgtccaggctggagtgcagtcacgcaatctcagctcactgcaacctcctcctcccaggctcaagcagttctcctgcctcaacctcccaagtagctgagatcacaggcgtgcttcaccatgcctggctaatttttgtatttttagtagagacagggtttcgtcatgttggccatgctggtctcgaactcctggcctcaaatgatctacctgcctcagcctccgaaagtgctgagattacaggcatgaaccaccacgtctggccttcaattaactcttacgatccaagccaggcaggaatctagctacacaaccagggacgtgccatgatttccttcaatttcctattttgcaatgttatcagaaaatatgggctaggtctggccttttctttcttctttatcatgatcacatttgtcttgaattaaaaataggacagggcaccatccttaatcaaaacataacagaccaggggtaatttccaagttctgtatgtgttttttgtctcctgaccttcacatacaatggaaaactttatcatatatagttcaaaacagtccacacagtattcaaggcctgatggcattcattatcaatgccaagttcttaacagctgttacccaaaatactgtcaccaactgactaggattgtctaataaatccatgaaggctaatcagaaaaaaaaaaaagaaaaaaaatcaagattctgtctttgcacccctattttttttgcttttattatttacattcctaaaataccaacaatagcaagagtaatgcttttacatagaattcttacatcatttataaaacaaatattaactttttttttttttttgaggtggagtttcgttcttgtcgcccaggctggagtacagtggcccgatctcggctcactgcaacctctgcctcctgggttcaatcgattctcctgcctcagcctcctgagtagctgggattacaggcatgcgccaccacgcccggctaatttttgtatttttagtagagacggggtttctccatgttggtcaggatggtctgaaactcccaacctcaggtgatctgcccgcctcagcctcccaaagtgctgggattataggcataagccaccgtgcccggccaaatactaacatttttagagcaacagaaaacaaaaccgctcaatcttattctgccactgagtcactgaagaagcatgtttatttttattaaaaagggcagaaccaatagaagcataagagaactacagtacaagattggggaagacatgaaggaaaaagaaaaaaatgtactttccttaagttattttaaggaaataaaggacactggctgggtgcggtggctcatgcctgcaatcccagcactttggggaggccaatgcaggaggatcacttgaggccaggagttagagaccagcctgggcaacatggtgagaccctgtatctacagaaaaatttaaaattagccaagcatggtggtgcatgcctatagtcctggctacttgggaggctgaggcaggagaactgcttgagcccaggaggctgaggctgcagtgagcgatgatcacactactgcactccagcgtgagcaacagaacaagaccctgtccccacctccaaaaaaaaaaaaaaaatctgaggctgggcatggtggctgacacctctaacagcactttgggaggccaaggtggccggatcacttgaagtcaggagtttgagaccagcctggccaacatggtgaaaccctgtctctactaaacacagaaaaattagctgggcgtggtggtgggcgcctgtaatcccagctactcggggggctgaagcaggagaactgcttgaacctaggaggcagaggttgcagtgagcggagatcatgccaccgcactccagcctgggcgacagggcaagactgtctccaaaaacaaaaaaaaaaacaaaaaacaaaacaaaacaaaaaaaaaaaaacaggcatttgacctggcatctcctaacttcctggtgactgaggacaagatggtgaaatggaaactggatgaaaataaagatgggtgggccaggcgcggtggctcacgcctgtaatcccagcactttgggaggccgaagcgggtggatcacgaggtcaggaaatcgagaccatcctggctaacacatgaaaccccgtctctactaaacatacaaaaaaaaaaaaaaattagccggacgtggtggcaggcgcctgtagtcccagcaactcaggaggctgaggcaggagaatggcgtgaacctgagaggcggagcttgcagtgagccaagatcacgccactgcactccagcctgggcgacagagcgagactccgcctcaaaaaaaagaaagaaaagaaagatgggtgaattatttacaacaggtttaatgaccacctaaaaggtcactgaataataaacccatggaaacctgcaacggcctctggtaacctttcaaaggcatcatacttggttggctctgttcaaccattacatcaaatttgaaaataacacgaagccagaatgaacagatggaatgtggagtcaggattcaaaactgcttgacggagcagagtggagagtcagatacggcaagatgaaatgcaacagagataaatgcagagactcacactagaacaaaacatcaagcttgaagatgagaagcatggttaaacactggtgcgtggtaggggtacttgggggttggagttaaataaaatgcagtgtgacaaggctgctgagacacttagacaagggaatgctagccccatgctactccaaggctgtccttgagtcaggaattctgttaaaaccttggccccatctgaaaggcatccaaagagaaagaaatcaagctggactcaggaggctcaggcaagaggacccttgagcccacccaagagtctgagtcctgactgggcaatgcagtgagaccctgtccaaaagaaagaaaaggtggggagaggaaggggaagtgggggagggagagggtagaaagaaaatcaatcaggctggccatggtggctcatgcctgtaattctatccctttggaggctaaggtggggacaatcacttaagccagtagttcaagaccaacctggtcaacattaatgagacctcaatctctacaaaataaatttttttaaaattagcctggcgtggtggtgcatgtctgtagtctcatctacttgggaggctcaggcgggaggatcatgtgagcccaggagttggaggttgcagtgagctatgattatgctactgcaccccagtctgggtgacaaagcaagaccctgtctcaaaagaagagaagagaaggctggctggtggagattttggaaacaaagtgacatgaaaaacagctgaaggaacagaggaggcttggctaggaaatgaaagaagctgatacggagagagagaggggaggacaaggtaaattccctttcctggcaggaatgttaaaatattgcagctactgattggcggttcctcaatcgattaaaaatagaaatactgtatgaggcgggcagatcacttgcgaccaggagttcgaggccagcctggccaacatggtgaaacctcatctttactaaaaatccaaaaattagccaggcgtgggggtacatgcctgtaatcccagctactcgggaggctgaggcaggagaattgctttaacctgggaggtggaggttgcagtgagccgagatggtgccactgcactccagcctgggcaacagagggagcgagactctgtcaacaaagaaagagagagggagagagggagagaggggaagaggggaagaggggaagagggagggggaggggaagagggagggggaggggagggaaaaagaaagaaaagaaaaactatatgacccagatattccactcccaggtatacatccaaaagaactgaaaacaggtactcaaatacttatgaatgaatcatcacagcagcactattcacaacagccaacagccaaaaccatcctaaaacctgcatcaacagatgaacggacagacgaaatgcagtctatccaaacaaggaaccataaaaggaatgaagtactgatatccacaacatgtacgagcctcaaaaaattatgaaactcagaacattcagctaagtgaaagaaaccagacataaaaggtcacgtatcacatgattcccccacttatatgaaatagccaaaataagtaaatccatagagacagaaagccgattagtggttgccaagtgctgggggcagaagggagtagcaaatgcctgtttaatgggcatgaggttttcttttgggatgacgaaaacattttggaactagatagaggtggtagttgcacaatgctgaatgtactaaatgccactggattgtacattttaaaatgtgatgctggggcttccagtttccagtacagcatgttaggagattagaagttgctaatctgtcctaataacaagtaaaaaagccaaagaaactgaaaaatcaagaactattcttagatccctaagagaagtgagatcacaaggcaattgctgccccccaaaattggagacaggctgcgtgtgatggctcgcacctgtaatcccagcacactttgggagggcggggcaggaggatcacttgagcccaggagtttgagcccattctggcaacaaagtgagacctcatctcttactaaatcaaaataaattagccagacatagtggtgcacgcccatggtcccagctactcagggagcagagatgggaggaccacttgagcccaggaggtcgaggatccagtgagccctgatcgtgccactgaactccagcctgggtgacagagcaagaccctgtctcaaaaaagaaaaaaatacataaattttaaaaattggagacacaggcaaatacacaaggaatcacaatttacagagcagaaacctccatgggaaccggtgccagggtaggaaaacctaagctgtaatcgacaaactgctggagttcaatgtgcagaactctgagagttaaaaattccagggagccgggcgcggtggctcacgcctataatctcagcactttgggaggcagaggcgggtggatcacgaagtcaggagatcgagaccatcctggctaacacggtgaaaccccgtctctactaaaaatacaaaaaattagctgggcatggtggcgggcgcctgtagtcccagctacttgggaggctgaggcaggagaatggtgtgaacccgggaggcagactatgcagtgagccgatatcgcgccactgcactccagcctgggcaacagagcaagactccatctcccaaaaaaacaaaaaaaaaatgccaggcgcggtgactcacgcctgtaatcccatcactttgagaggccgaggcaggcagatcatgaggtcaagagatccagaccatcctggccaacatggtgaaaacccgtctctactaaaaatacaaaaattagctgggcgtgctggtgggtgcctgtagtcctagctgcttgggaggctgagacaggagaatcatttgaacccgggaggcggaggttgcagtgagccaagatcgtgccactgcactctagcctgggtgacagagcaagactccgtctcaaaataaacaaacaaacaaaaaaccacacataaatgtaacacgtggatcaacaaagaaatatcgaggagttttaaaatgttttgaactaaatgaaaaagaaaatataatttatcaaaatgtgtgggatgtagtgaaagcagtgcttagtggaaaacttaagcatttaatacatatattagaaaaaaagaaagagctaaaatcaatcatataagcttcaaccttaggaaactagaaaaagatcagcagattaaatacaaagagagcagaagaaaatgaaataaaaactgaaacaaaaatcaataaaactgaaaacaggaactcaatagagaaaaccaacaaaaccaaaagctggttttttgaaaagatcaataaaactgataagcctctagccaggctaactatgaaaaaaaaagagagaagacacaaattcctagtatcagaaatgaaaacaggaacaccgctataagaccccatggattaaaaagatacataaaggggctgggcatggtggttcacgcctgtaatcccagaactttgggaggccgagacaggaggatcacgaggtcaggagatcaagaccatcctggctaatacagtgaaaccccgtctccactagaaaaaaaaaaaaaaaaaaaaaaattagctgggtgtggtggcaggcgcctgtagtcccagctactcaggaggctgaggcaggagaatgacgtgaacccaggaagcggaccttgcagtgagccatgatcgtgccactgcactccagcctgggcgacagagtgagattccatctcaaaaaaaaaataaaaataaaataaaataaataaataagaaaaaaaaatacaaaaaaaattggccaggagtgtggtggcatgctcctgtaatcccagctattcaggaggctgaggtaggagaatagctggaacctgggaggcggaggctgcagtgagccgagattgcaccattgcactccagcctagacaacagagtgagactcagtctcaaaaataaataaataaataaataagaggctgggtgcggtggctcacacctgtaatcccagcactttgggaggccgaggcagatggatcacctgagatcaggagttcgagaccaccctgaccaacatggagaaaccccaactctactaaaaatacaaaattagctgggcatggtggcaagcacctgtaatcccagctacttgggaggctgaggcaggagaatcacttgacccaggcggcggaggttgcagtaagctgagatcgtgccattgcactccagcctgggaaacaagagcgaaactccatctcaaaagtaaataaataagaaatattatgaacaactctatgcctaaaaatttgataacctagatgaaatttatcaattccctggaagatacaatctgccaaaactcacccaagaaaaagcaaacaatctaaatagacctgtatctcttagagaaactaaatcaacaattaataaccttccaaaacgaaaagtaccagacccagatgggttcactggtgaattgtaccaaacatttaaggaagaaattacaccaattctctacagaagcaaagggaatacttcctaactcattctgtgaggtcaccattattgttcgtttgtttttgttgagacagagtttcgctcttgttgcccaggctggagcgcagtggcacgatctcggctcactgcaacctctgccttctgggttcaagtgattctcctgcctcagcctcccgagtagctgggattacaggcatgcaccaccatgcccggctaactttctgtgtttttagtagagatgcggtttctccatgttggtcaggctgatctcgaactccggagctcaggtgatccgcccacctctgcttcccaaagtgctgggattacaggcgtgagccaccacgcccggcctcggccaccattattctatcaaaaccagacaaagatgttacaagaaaactacacaccaatatctctcatgaacacagatgcaaaaaccctcaacaaagcaagcaaaaaaacagcaaacacatgtttactatagtgttctaagtactttacaaaattggttcaatccccccacccactctgtgagaggggtattattatcatcatccccattttacagatgaagaaactgaggcatgtagagattaagtaagatgtccaagattacagagctaatgagccgcagacttggggtctgaacctcaacagtttagttcagagttcatgctcataactgctccactatgctcttgcagtgacaacatttaggcagaactgagacccaggactttctgacaaggaatgcttccctccaaaatagaaagatgctctctgattagaagaattccagcagggcctggctaaattatatcaggccacactgtgaagaggatcctacgtcaaaagctgccccagccagaccatttctaaagctcttgtcaactctgcaactgtgatttcagcagagtgtgcaaatttctgagatgttcacattaaaaagtgctacaaattttcaaataatgtgactttgttaacaggatgtactatccatccagattttttaaactccactctaattttataatctactttcctgactcaactgtacatgagagaggtacagactcacccaaatgtatgctttctgaatattttctattatagggaaacagggttaaagacaccccagaccagatcccactgttcattctactttccctattctgaactacgaaaatatcacactgacgacaatggcaacttcacttgtttcctctttggtaaaatgggctgcctgggctaaatgatttctcaagctccttccatttctagaattctagccatataattaaggagctgattttcttagatttttttttttttttttttgagacagagtctcactttgtcgcccaggctggagtgcagtgacacaatcagggctcactgcagcctcaagctccagggctcaaatgatcctcccacctaagcatctcaagtaactggggccacaggcacctgccaccacacttaggtaattttttattttttgtagagacaaggtttcgctatgttgtccaggctggtctcaaactcctggctcaagtgatcctcctgcctcagcctcccaaagtgctgggattacaggcataagccaccacgcccagctaaaagtacttaacattctaatgcaaaaataatatacaagcaaacagagcttacttaagtgggaaggcacgctgccagattctaaaagcaaaggattctatcataaaagggaggaaaggattagataacctctcaaggggaaactggatttatgggatatagtctaggcaaaaaccagatcattggtaatcaaggataataccaaaacaaaccaacaaaccacccaaaacagcagctctcaacctctcccatcaaggcagacagcccaggtacaggcccacgcacagatattccatgggtaaaaccagattctgagaaaagctgaaaagatttttcataaaaataaagcaaacagtagcacaaaggtcttttatcgtggtagttataaaaatgttttacggccgggcgcagtggctcacgcctgcaatcccagcactttgggaggccaatgtgggcagataacttgaagtcaggagttcgagaccagtctggccaacatggtgaaatcccgtctctactaaaaatacaaaaattagctgggtgtggtggtatatgcctgtaatcccagctacttgggaggccgaggcacaagaattgcttgaacccaggaggtgaaggctgcagtgagcaagatcacaccactgcactccagcctgggcaacagagcaagactccatcttaaaaaaaattaaataaaattaaattttttttaaaaagtgttttacaatgacatcagccatttaaaggtctcaaaaaggccatcttgtgaggaaaaacgaaagtggtaatctttttcaactactgaacttttgttaaagccttgatctttttctagacctcaggaaaatattaatatggtgaaaggatacactaccaaagaataagcccaaataaacctgattttaacgtttacttatatttttgtacctattcttgcctttcccttattaaaggcgaggggccgggtacggtggctcacgcctgtaatcccagcactttgggaggctgaggcgggcggatcacgaggtcaagagatcgaggccagcctggccaacatggtgaaacctcgtctctactaaaaatacaaaaaaattagccgggcgtggtggcgggcgcctgtagtcccagctactcaggaggctgaggcaggagaatggcatgaacccgggaggcagaagttgcagtgagctgagatcatgccactgcactccagcctggcgacagagagagactccatctcaaaaaaaaaaaaaaaaaaaaggcgagggtaataatccacaagcacgcagatcctgactgcacatgggaatggacaccacctgtccacctgtgagggcctccctgggagcagcagcaggtgctctatgttatgggcaattccaggccatatggagttcaataatgaactccacccagcttctccacttaagaaagcaaggagtggcaggagctgtggctcacaccaatcatcccagcactttaggaggccaaggtgggcggatcacttgagcccaggattttgagaccagcctgggcaacacagtgaaatcccgtctctacaaaaaatacaaaatttcaggcaggcatgtagtcccagctattcaggaagctgaagtgaaaggatcacctgagttcggaaagtcaaggctgcagtgagccgagtttatgccactgcattacagcctgggcgatggagtgagaccctgtcttaaaaaaagaaaggccgggcacagtggcttatgcctgtaatcccagcactttgggaggccgaagcaggagatcacgaggtcaggagttccagaacagcctagctaacacagtgaaaccccgtctctactaaaaatacaaaacttagctgggcgtgctagtgcatgcctgtaatcccagctactcgggagtgaggcaggagaatcacttgaacctgggaagcagaggttgcagtgagccgagatcgcgccatagtactccagcctgggagacagagcaagactcctctcaaaaagaaaaaaaagaaaagaaagcaaggggcaatgtaaactatgaagagacataattccaggaaaaagttgaactaactctcatttcgtttttaagcaagtaaatcactagtaagctttgctttgttacttcaactattatttagaagcaaattactggtgacatgtcccctagttgtatcttgacatcaatgactgccctagagcagcagttatcagagcgtgatctaaggactcctgcgggggcagggaggaatccccaaagctctctctttcccaactatatctgtgtgaagctcagttttcttcatctacttcaaacagataacagacaatgcagaatctagctgttttctcttaagttggacattaatgagattagcaaaaacttaaaatgccagtcttcttactaagttgtttctggtttttggaaaacagttaattttcactaaaaatgtgttatttaggttgggcacaatggctcacacctgcaatcccagcactttgggaggccgaggcaagtggatcacctgaggtcaggagttcaagatcggcctggccaacatggtgaaaccccatctctactaaaaatacaaaaattaaccaggtgtggtggtgcgcgcctatagtcccagctactcaggaggctgaggcaggagaatcgcttgaacccaggaggcggaggttgcagtgagccaagattgtgccactgcactccagcctgggttacagagcaagactctgtctcaaaaaaaaaaaaaaaaaaaagttatttaagtcaccatgcaatgggtttatcattgctattttaaataatttaataattacattatttaataggttctcactttttatttctaataaatatccatagataaaacccacatatggctgagcacggtggctcaagcctgtaatcttaacattttgggaggccaaggcaggtggatcgcttgaggtcaggagttcaagaccagcctggccaacatggccaaatcctgtctctactaaaaatacaaaaattagctgtccatggtggtgggcacctgtaatcccagctactccagaggctgaggcaggagaatcgtttgaacccagggcagggggggtggagggggggaggttgcagtgagctgagatcacgccacttcactccagcctgataagagcaaaactctgtctcgaaaatacaaacaaacaaaaacacataaccacaagctctttaaagtccatggtaatttttgagcacaggggtcctgagaccaaacaatctgggaaccctaaagggttaggttgggttcaattctactacatccctctaagggattagtttacacaccatacctggggcaaatgtctgctgaatgaatgactttaagagaatgttacaaaataccctgtagaatatgactgcattttgtttaaaactttatgtagttaaatttgtacaaagaaaaaaatctataaaaatagacacgaggccgggcgcggtggctcacgcctgtaatcccagcactttgggaggccgaggcaggtggatcacgaggtcaggagattgagaccatcctggctaacatggtgaaaccctgtctctactaaaaatacaaaaaattaaccgggcgtggtggcgggcacctgtagtcccagctactcgggaggctgaggcaggaaaatggtgtgaacccaggaggtggagcttgcagtgagctgagatcacaccactgcactccagcctgggcaacagagtgagattccgtctcaaaaaaataaaaataaaaacagacacaaaatgtttacactaatgatgtcaaagaggcagtcttttaagtctttttaccttactttcattctattttggactaactgtgttttcttgttctacagtaagggcgtgggggggggtctggagcagcattgcctaaagtgtgttccccgggacactggtgccacaggtgcggcagaaagagtcccaggtcaagtgagttggttttacccccggctcagcaattcctccaagtgcactcaagcctgtgagaagccctgcagtaacgaaacctgtttaacgttaacagcgcttcccaagcttacatgaccgagacctcattgacctaacagcacctgtccacgtcacacacctagggagacccatctctcatcctagatgagtttcaaggggaagcctgcagttggtcactacatccttaccattagaagtcactacacggactacgtcaccattatttacaaacgacaacttctagcaaagataatattaaatgatacatgatacatcccactggaatagctgggagttacatcaaatacattttttacactgactttagtaaaatgcctctatacaagggagtaaatttacttcatatagatttaggaacttggtaaattcaagtaacaattttaaatagcaatatttcagttaaattctttgatgaaaaacactaagcgcgtctggccctaagtcattcctccacacagcgtacagcagtcagcatcccctgaaaggcgtggccaccgtgaagaggcagggcctgcagaggcggctgcttgcagagggcccaccgcccccggttgtggctctcctgcctctcctccacctcaaaacctttctgcccttggaggccgtgcctctgcctgggcatgggggcccctcctccctgggcttcctgacgtgcttctgcagatcccagtggcaggctactctctccctccttttcttctcactggctcggtcacctaggaccccaggaactaggcttctgcctccttcacaacccttctctggtacctcggcctcctagccccttcatcccaggtgggggtcaaggggccactgattgtggctgctgcccccacagaatcctgcggcgctgccactccaatgcctcccaccactccaccttaaccagcgcctcaccgctggtttacagaatgacagcagtccctctgtatccaccagggtagtggttccaggacgccagtctacacctgaatccacacatactcaagttgttggtcctgcaggacccaagtattcaaagagtcagtgcttcccatatgcgggtgtcacagcccacaaatactgtattttccattcacgtttggttgaaaaaatccacttataagtggacacatgcagttcaaagccatgttgttcaaggctcaacagcactgtactgcaacgtgggtgagcgtgaacgcatgtgcatgcatgcgctggaatttactgccaatctacccaatttccacttgttataggttaaatatgtttctgacagtcacttttggagctttataagcattgtttataacaaatttccacggggaagatacaatttgggttccaacttgaactccaaaccgatcaatatgagttacctttccaaatcagaaatggcttaggtaccaggaaacaatgtatcaagacaaagctaggttgaggcagtttgccagtaattactagacgatcccatgagcggaggtagtcaggaatttcagcaaggggccagttcggtttacccaggcctggggacagactgagtggagaaataacacgtgcccgagctctcaggaaaaaggcctcaatctgaccagaactagcacggactcacattggttggccactgctgtgggctgctcagatgccagggttccatcactgctctctgcaccagcttgccccagcttacctgtctgtacttgggtttccaaacgataagagtacagccgggactgctctagcctgagccaaggctgctgtcccaaatcctcatctggtctcctgcattctagatataacagaaacttcaggaaacccttttccccttctccttcaggcctaagcaacaaccagatttggcccaaggggcccatgtttgttctccctttgtccctggcttcactgtccaccagagtgaaaacctcatacgcagaaaacacccacaacccaagctgaggggaaacaatggccctccaggctctgcccttattctctgccaagacttacacctctggccttatgctgtcactgtccgctggccacagatgcctcccagagccctccctgagaagacacaggatgtgagtgacagcccatcagacacacaccccccagcctccaggagtcactctgaagcgcccgcccaaatgcggatctgccttactcgcctgatggtctgtcctcttcctgggtcagcacccaatcctgaataattcactccttcaatctctgcagtcaggctcctgtgcacaccactctgcaccgtgcattcctgaagataacatgaacggcctcttaatcaccaccccacctgcctctcctcggtactcatgcttgcattcacttctctaaaatctaaactgggccaggcagggtggctcatgcctgtaatcccagtgctttgggaggtcaaggaggctggatcacttgaggtcaggagtttgagaccagcctggtcaacatggtgaaaccccgtctctactaaaaatataagcagtggctcacgtctgtaatcttagcattttcggaggcctgggcaggtggatcatgaggtcaagagttcgagaccaacctggccaacatggtaaaaccccatctctactaaaaatacaaaaatcagccgggcgcggtggtgggtgcctataatcccagctactcgggagggtgagacagaagaactgctggaacctgggggacagaggttgcagtgaaccgagatcacaccaccgcactctagcctgagggaaagagcaaaactctgtctcaaaaaaactataaaaatgataccagctacttgggaggctgaggcaggagaatagcttgaacctgggaggcagaggctgcagtgagccaagatcatgccactgcactccagcctgggcaacagagggagactctgagaaagagagagagagaaagagagagaaagagagggagagagagagagagaaaggaaggagggagggagggagagagggaaggaaggaagggagaaggcagggaggaaaggaggggaaggaggggaggaagggagggaaggcaggcaagcaggcaggcaggcagggtatggtggctcacgcctctaatcccagaactttgagaggccgaggcaggtggatcatctaaggtcaggagtacgagaccaggctggccaacatggtgaaaccccatctctactaaaaatacaaaaattagtcaggtgtgggagtgtacacctgtaatcccagctactcgggaggctgaggcaggagaattgcttgaagccgggaggcagaggttgcagagagccaagatcatgccactgcactccaggctgggcaacagaatgagactctgtctcaaaaataaataaataaagactggggacactagctcacgcctgtaatcccagcactttgggaggccacagcagatagatcacctgtagtcaggagttcgagaccaggctggccaacatggtgaaaccccatctctactaaaaatacaaaaattagccaggtgtggtggtgtacacctataatcccagctactcaggaggctgaggcaggagaatctcttgaacctgggaggcggaggttgcagtgagccgagattgcgccactacactccagcctgggcgacacagtgagaccccaactcaaaaaataaataaataaaattaaaaataaataaataaataaaaataaaatctaaactgttgaccacatctacctagaatgcctcattccacatacctccggatcctctctcctctctgttctctgatcaattctcttgctcctgggaccctcacaacaatgtatgatatactttatatgcaacaagaaaaatgcaatcaacacaatctgttcagacccactgccatatgcattactttaagtagcagttaaaaagcccaaaccttctaagaacactcagaaaaagtctagaaaaagacaaagttaataaactttaccaaatgaatctgcaaatatatattaaccactggtattaatggcctaaaacattatttcattcaaacaaacagtaatgtcgtagttgttattaaagtcagcagaagggaggggaaaggctatgttatgaagctatcccagtggtacttactccaatttagaagaagttttaacatgtcagatttcatataaaaaagcatttaagccagtatttattttctattcaaggctctgaatgtttagaagacatgtattcgctgcttcctaggtaaacaagaggcggctctcgtacacttgggcatggactttttaaacccttgccaaatgaaaatgttttctacaggaatcatgagctggtatcaatggatatttacagacagctcagaagcaagctctgaccttgccaacttagggctttataatcagtcaggattatcaaggtccccttccaactagtcacaaggcactagtaactgaggggctcaaaaactcaaaacgactgtaccccacctgttactccccacccccactgttcctttaataattttagcccagagtgagagggcctaaggagaaaatgaaattcaagtcagtgtgttttactatttacttagtactctgacaaatgcttgaaatgcatggcaaaaaaaaaaaaaaaaagagtagggattatccaagaattttaatgatttgttatcctttttactaattctgtaagtaataagaaactagcatcaattagtcaaatcattttaaaagtaaacataggccaggggcgatggctcacgcctgtaatcacagcactttgggaggctaaggtgggtggatcatgaggtcaggagactgagaccatcctggctaacacagttaaaccccatctctactaaaaatacaaaaaattagctgggcgtggtggcatatgcctgtagtcccaactactcaggaggctgaggcaggtgaataccttgaacccaggaggcagagcttgcagtgagccgagatcgcaccactgtactccaggctgggcaacagagcaagactccgtctcaaaaaaacaaaaaagagtaaacataatctgcttaacagaagggctttagtcccccagatcatacacaaccctagtcttctgtgagcctctgtctaccatcggttctcactgtccactgagaacggagtagagcctatcctttgcttgttgctgaggatggaaagatgaaggggaaacttgcaccctgaagccacttagaataaaaggcaggactcttttcccaaggggaaggaggagcattggccagagatgcagctgacaagagacacagaggacaagcagctctggtgaaaatctcaggccctgggcccacaatttgactattaatactctgtcatctagttttatcaatactcagggccagtttcctgcatgtgccaggagccaggcatagaagggccccagggttggtttaaaaacctattgctggctgggcacggtggctcatgcctgtaatcccagcactttgggaggccgaggcgggcagaacacctgaggtcgggagttcaagaccagcctgacaaacatggagaaaccccatctctactaaaaatacaaaattagccgggccagttgtggtgcatgcctgtaattccagctactcaggaggctgaggcaggagaatcacttgaacccaggaggtggaggttgtggtgagctgagatcacgccattgcattgcagcctgggcaacaagactgaaactctatctcaaaaaaaaaaaaaaaaacaaacaaacctattgctgaccaggtgaggtagctcagcccataatcctagcactctgggaggctgaggtgggaggatcacttgaggtcaggagctcaagaccagcctggccaacatggtgaaaccccatctctactaaaaatacaaaaattagccaggcatggtggcgggtgcctagtaatcccagctactcaggaggctgaggcatgagaatcgcttgaacccaggaagtggaggttgcagtgagccgagagtacaccactgcactccagcctgggtgacagggcaagactctgtctaataaacaaaaagaaaaacctgttgccatcttgatattttttataatttttgggacagatgcagtggctcacgcctgtaatcctagcactttgggaggctgaggcgggtgaactgcctgagctcaggagttcaagaccgtcctgggcaacctggtgaaaccctgtcgctactaaaagtacaaaaaattaaccaggcttgctggtgcatgtctgtaatcccagctactcgggaagctgaggcacgagaattgcttccaccctgaaggcggaggttgcagtgagctgagatcatacctctgcactctagcctgggcaatacagcaagactctgtctcaaaaaaaaaaaaaagaaagaaagaaaaagaaaaacatttttaataatttttgaacaaggggccccacagtttgttttgcattggccccttggattatgtagctagtcctgtcaatcttcatcattaactacatctgaaatatgcaaaactcagtgagactagagtctgcatttcagatggaattcattataccctttaaaagccacttaatagacaaccttatacaaatcattctgaagtttcacatttcttcaatttaaatttatgacattcaactattttgaagtggtcctcaaaagtactatataagaaacatgttggctgggcgcggtggctcgcacctgtaatcccagcactttgggaggccaaggcgggaggatcacaaggtgaggagatcgagaccatcctggctaacacgatgaaaccctgtctctactaaaaatacaaaaaaaaattagccgggcgcagtggcaggcacctgtagttccagctactcaggaggctgaggcaggagaatggcatgaacctgggagaaggagcttgcagtgagccaagatcacgccattgcacaccagcctgggtgacagagcgagacactgtctcaaaaaaaaaaagaaagaaaaatgttaggctgagcatggtggctcatgcttgtaatcctagcactttgggaggctgaggcagggagattgcttgagtccaggagtttgagaccaatctgggcaatatggtaaaaccccatctctaccaaaaaaaaaaaaaaaaaagccaggcatggtggtgtgtgtctgtagttccagctattcagggggctgaaatgggcagatcgcttgaaccttgggaggacggagattgcagtgagctgagatcgtgccactgcactccagcttgaataaaaatttctttgctatactttaagtatgtaaacaaagaagatattcatttttactgagttttaaaattcactttgaatctaaagacatatttctaagcattttatatgtttgaagattgggtaattgaggaatagttaaataaaatcaaaggactagaaaaaataatttactttttaacaaagcacatttttagccaactagcataacaaaaatgtaatgaatgaagaaatgtcagctggacatggtggctcacgcctataatcgcagcactttggagggccaaaaagggcagaatgcttgagcccaaaagttcgagaccagcctgggcaacataggaagatcccgtctctacaaaaattttaaaattagccaggcatggcggtgtgcacacctactcaggaggctgaggtggaaggatagtttaagccaagggaggttgaggctgcagtgagctgtgattgtgccactgcactccagcctgggcaacagagcaagatcctgtctcaaaaaaaaaaaaagaaaaatgtcacttttctaaactagttgtagtttgaaaattctcgtgttttttccagtccctttcattaagttaagccctgctcctggaaccaggatattgactctgcatgtgtctgggtggctgtcccccaaacactgcatgtgtagccctgtgctaggctcagatttcctaagaaatctacagaaatcaaggcctaggcctcagtgctctcagtctctcttaatgtgtgaggtggtaaaaacaacagactgtaggcttggatgcctgcaaaaatacaaaggcgtgataaaatttagtcctcaggaaagctgaccaaaggctcaatgtttttaagaaaagggttgctctgtgagctaccaagagccccacagcagcagagttcaaacagaggctgaatgatcaacacacaagaacatatgaggaaatgtctgttttacagggaaggctatttaaagtatagaggaaagaactttcaaagttcctttcaactcaaagtctaaagtccagagtagaaattatatgagagacaatggcaaaggaaggaattggttggatgaaatgccggtttgcacctagactaggaaaaattcaacttaaaattctaacaaactagaaaactgtgaaatgtgtatttgattcgaaaaatgctcctgtgagtgactatggaggtcaagtggatacaggatggtgcagccactttgtacaaccaactggtagttcctcaaaatgttaaaaacacaggccgggcatagtgctcacgcctgtaatcccggcactttggaaggccaaagcagctggatcacttgaggtcaggagttggagaccagcctggccaacatggtgaaaccccgtctctactaaaaatacaaaaatcagccgggcatggtggcaggcacctgtaatcccagctactcgggaggctgaggcaggagaatctcttgaacccaggaggcggaggctgcagtgagccaagataacatcactgcactccagcctgggtgacagagtgagactctacctcaaaaaaaaatttttttaatttaaaaagttaaatctaagagttaccctaagacccaacaattccacttgggtatacacccaagagaaatgaaaacatatgtccacacaaattcctgtacaaaaatgttcatagtaatattttccaaaattagctacaaagtggaaataacccaaatgtccatcagtgaataaatggataaacagaatgtgttatatccctacaaggatatattatttacctatgaaaagaaacgaagtcctgatacatgctacaacatggatgaaccttgaagacatcatattaagcaaaagaagctagtcacaaaaggccacgtatgattccattgatgtgaaatgtccaaaataagcaaatccatagacagaaaatagactaggggttgccaagggaggaggagaggaggagggagatggagaatgattgctaacagatatgggatttcttttgggagtgatgaaagtgttctgaaattagatagtggtgatggttgtgcaactttgtaaatatactaaaatcactgaattgtatgccttaaaaggttgaattttatggtatgtgaactatacctcaataaagctgctttaaaaaaaaaaaaaaaaaggagtggatgcagaaaaaggtgggtttttttgtttgtttgtttgagacaaagtcttgctctgtcacccaggctggagtgcagtggcatgacaaaagtggtctttttttttgagatggagttttgctcttgttgcccaggctggagtgcaatggtgtgatctcgactcactgcaacctccgccccctgggttcaagcaattctcctgcctcagcctcccaagtagctgggattacaggcatgtgccaccacgcccagctaattttgtattttttagtagagatggggtttctccacattggtcaggctggtctctttctcccaacctcagatgatccgcccacctcggcctcccgaagtgctaggattacagacgtgagccaccgcacccagccggtggtcctcctttgtcctacacaatgactcagagaaagtacagatcaaggtaggcttgaaaagtagcagactcaacagaagttcttgtcatgggagaatcagacagaacgaaacagatggctgaaagatgattcttcggccaggtgcggtagctcatacctataatctcggctctttgagaggatgaggtgggaggactgattgagtccaggagttcgagaccagcctgagcaacacagtgagacgccacttctattaattctttttaagataatgattcatgtctgaccaaagaagtaaaaaagaaaaaacatgactcttcttttgatatgctatcacatacttcttattggggttccggaatgggaaggaagctttcagatttttttctttttttgagacggagttttgctcttgttgcccaggctggagtgcaatggcaccatctcggctcaccgcaacctccacctcctgggttcaagcaattctcctgcctcagcctcccgagtagctgggattacaggcatgcgccaccacacccggctaattttatattttttagtagagatggggtttctccatgttggtcaggctggtcccgaactcctgacctaaggtgatccgcctgcctcggcctcccaaagtgctgggattacagttgtgagccactgcacccagccaactttcagatgttttataggcatttaagctgctttaaactctgctactttgaagtacgtgaatctctgccaagaatctttaaaaataaaaactttagtaacagatcttgtgaaaatttttaatctaataataatatcctaaagctaaatcaaaaaatgagcaaaaatatacctaaaacataggagagaaagaacctatcaaatcagggacaactgaaagcagcattctagttcccgggtggtggcagctcttagggaaaagacgggtattgtatgtcaggctgacacagtggggaggctgtcgccatttaagggttcctatatatggcctttgcatagcctcaaaatgtcacttttgagggtctgttagtttggcttttttttttttttttttttagagacagagtcttgctctgtcgctcaggctggaatgcaagtggtgtgaccttggctcactgcagcctcaacctgccaggctcaatcagttctccagcctcagcctcctgagtagctgggactacaggcatatgccaccatgcccagctaattgttttgtatttttagtagagatggggtttcaccatgttgcacaggctggtctcgaactcctggactcaagcagttcacccatcttggcctcccaaagcactgggattacaggtgtcagctaccatgcctggccgtttgggtttttttttgtttttgtttttgttttttcctgagactgagtctcactctgtcgccaggctggagtgcggcggtgtgatctcggctcactacaacctccgcctcccgagttcaagcaattctcttgcctcagcctcccaagtagctgggactacagatgcatgccaccatgcccagctaatttttgtatttttagtagagacagggtttcatcatgttggccaggatggtctccatctcttgacctcatgatccacccaccttggcctcccaaagtgctgggattacaggcatgagccaccgcgccaggccttggttgttttttaatgcacgaacatgacattgcataaataatttccaccaatcttgaatctgtagtcctgaaacactactaaaatccgtattttgtagcaaatcaacattttaaatttcacttataaagacatatttcttcaagcaactctttttttttttttttttttttttttttgagacggagtctcactctgtcgcccaggctggagtgcagtggcgcgatctcggctcactgcaagctccacctcccgggttcacgccattctcctgcctcagcctcccgaatagctgggactacaggcacctgccaccacgcctggctaattttttgtatttttttttagtagagacagatggggtttcaccgtgttagccaggatggtcttgatctcctgacctcgtgatccacccacattggcctcccaaaatgctgggattacaggtgtgagccaccgcacccggccccttcaagcaagtcttcacaccaaattaagacccactaaaaaaacaagttttaatgatctaagccctcaaccagaatacataagaaatagactcttggcggttttttaggataatcagatctctattttgtttcaactcttataaatgaaaactacccaaaaaaattaaaaaacatactttcctgtctcagaaagcaataataaaaataactcagtactttttttcctttgttctaaaattttaacctatctcagcttcctcattttaaacatttagacttggtttaataagcttcactaagtcctgcagctagtgttacgaaattacagcattttctattttcaatgtaatattttatatcccacaaaaatttcattttttggtcatattcttcataactaaaactgaaatattatttgcgtttttggcttgaatatcaaatactggcacagataatgtatgttatgacctcctaaaccttccttttgaaaaataattcctataaaactgcttggtttcatgctttttctcccaaaagaaatatccagccaaaggacgaattccagctaactgaaggttccagttaaccgagtgaatgctctaaaattggaatatattcaaaattgttcgtattttattatttcttcagcagttataggtctcctttgagaaataaatgttatttactttcagtattaaaaatgttagactatgggtaatactgaggtctatattcgaacgacttttttccacatcgttacttctgaaaaaacgaggtaacaaattaagaaaccatcttcccaaaaaagctgaaaattatagtatttttaaagggactaacaggggtagccacagagctacagccttcaaaggctgagacagagtttcatgatctaatatccccaatactgcaaccaacagaattgatccttgaactttttttttttttttggtatttttgtagtgacaaggtttcaccatgttgcccaggctagtctcaaactcctgggctcaaacaatctgcctgcctagttctcccaaagtgctggaattacaggggtgagccaccgaggctggccccatgatccttgaaaatttacccactaatgaattcccatatcgacactgcagaatttaagtttgggccgggtgcagtggctcacacctgtaatctcagcactgtgggaggcagaggcaggcggatcacttgaggtcagaagttcagaccagcctggccaacatggtgaaaccctgtctctactaaaaatacaaaaatgagcccagtgtgatggcatatgcctgtagtcccagctactggtgaggctgaggcagaagaatctcttgaacccgggaggcggaggttgcagtgagacaagatcgcgccattgcactccagcctgggtgacagaatgagactctgtcacaaaaacaaaaacaaacaaaaaaaaaacttaagtttgctttacactatgtaatttttttcagtatatagcatttatctgtaaagtgaaaattaggatgcaaagctactacgctgtctaaactgaaatgctgttatccatccacccattcattcattcaatcacacaatactggcatgcctctggtgtgctggtgacgggaaacatatgcaaagcagatacccttccatcttggggcatatgttctactgaggggaaacagacgataaacaattcaataagtaaacaacaaggcatgttagaatgggctaagtgctatgcaaaaagaaaaagtgttgcagggaaacaggatttaggggttcaggaagagaaattatttcaaataggatggtgaggggaggtctcactaagcctatgtgcaaatggaaaagtaacagtgaattttatgtattaagtggcttcgaaatgcattacatggttgcattttttaaatattcatataagctttctattttctctgcttcactgttctatttcccgatctccatgaagaaggcaggtagctgaaggacatgaccgtccagggcatgccaaagatatttcttctaatattttggcttactgaatttgtttttaagatggagtcttgctttgtcacccaggctggagtgcagtggcgcaatctcggctcactgcaacctccgcctcctgggttcaagcaattctcctgcctcagcctcccaagtagctggagttacaggcgtccaccagtacacccagctaatttttatatagttagcagagatggggtttcaccatgttggccaggctggtctcgaactcctgacctcaggtgatccgctggcctcggcctcccaaagtgctgggattacaggcgcaagccactgcacccagctctactcaatgttttttgagaactacagctataattaaaataaaatttgagggtctctacaaaactaagagtcaagatgcaatttatattagaaaatctatcattttctgcagcagtctgtacgtaatctaacattaacaatgattaaaggtagctacagcatgaacaggagttcatgtcgtactgccttacagccgtaaaaaattcaattagttgaaatgatctcttaaaacgagcccacagagtgtctccaaactgtaaatttacatatgaaattcacttgtaatatttcaaaatgaaattgtttattagcatttcgtgtaattccaagacattttctaacttgcaacctgaaaaaaatgcatacgaataactgatgtgtaaaatgtctttattccgaagactaagaatcttgaactactgtaactgcaccaagaaaaacttagagaaagcaaattacaaatgactcaactagccaacacacctttcacacaagatttctgtcggtctcaggtaatgaagatattcaaagttgaaatgtatgctgtttaagtaaccaaggcaattaaataatgactaacaaatgtaggtgctatttaagaaagcaccaattttaacaagaaatggtatcactgactaaatatacttaaactgttcccaaaatacccaatccaagcacatatttttaaaatgtgtgggttttccccaagagaagcaaaacttttgacatttctcttggatatattagagtttcagacctccaacccacatctggaaagaacatttcaaacttagcttgatgttacttttaaaaatcaaatggccagcaatgagatacttagtgactaagatctgaatttgacagagtcaacagaatgttagaaatgaaataaaagaagtattcaaagtttatcatcctcgatgtttagaaaggaacatggaacaaaagatgcatttgccgcctctgccctttaattcgtgaacaccatacttctctccttatgtcacgccagggaagggaaaataagaatttttaaaaagcttgctaaattcaaatatgaccatttcatctagatttctatcaatcctcctccccaaaatttcttttgattaaaaaaaaatcagaacaacagatttaagcctacagtagattctacagactacacctagattactctgctctaaggccaaggaaaatgtttacgatttcaagatccactcagaagcaaatactgtatctgcaatgcgtaagcttttcgttggcaagaccagtcaatagcagaggcatgcaaggtttaaaaggttaagtggatgaaggttaaaagctaataataaattagccaagaaatactacttcccaccgagccataaaataatttcggtcctacaatcctaaaaaaccagagaggtttctcgtttttgtagagaacatctaaccctccacggtctaaatgaccgtcagaaaaacagcaccaaggcaccaggggtagcagagacggagatttctaacactgggtgagcccgcggtcgcaaatctcatcgcgatttcacctttgggtgaaaaggtgggagggaagcactaagtttcagcctcggctccactggaaacagacaacgtctgaaggactctgggaggaggcggaaaggggcgaagtcgtggtgtccgcggtgcagcaacacagaatcgggatcttggaaacgggatgcggaggagtgggctcttatgtaagcacacaccaaaactgtgcgtgcaccccccgcctgatgcacatctgagcacacgtacacagagcatctcacccaggggtgcagccccagcctgcgtgcgccgctgagcagggcggactgacccttcggcccgtctgcacgttcccccaaatcagcgcagccaccaccatgggctgcagtgggggcagcccaggctcaggagccccgcccgggacggagcctggcttccccgggacgcctgcagcgcgcgcccacagtctcctgcgccctggccccggctccgcgagcccgacccccaacccgaaccccacgccctgacccggctccctgcgctcggacccgactccccgcatcccggctcgaatcccggcatccggccctactcccgcacccggacccgaatccccgcaccgggacccgaatcctgcacccggacccgaatcccgcaccgacccagcggcccggcccagccccggggcttacctcgcgcggcccagaccccgccgccgcacagcagcccggccagcagcagccgggcggccggggccagcgcgggagcggggcggcgcagcatcgccagcccggggcgggagcggcagggaggcgcgcgggacgccgagcggagctctcggagctctcggggctctaggggcctggggctagctgctccgcggcgcggggagctccgggggtccaaggaggagccgccgccgccgccgccgtgacgctgggccgcgcgctcaggacgcggcgccctccccgcctcagagcagcgtcttgctgaaggcagcggcagcaactaagatggcggcggcgctctctctcgggtccggcgagggtacccggccgggggcggggtggcggcgggaggggcggggatggggagcgacgcgaggcgcgcgcgcggcggaccctgggagcgcgcgggcccgggaggggcgggggagaggagcggagggagcgcgcgcggcggacccggcagcgggcgcgcgcctccgagcccgtcggccccgcctggagcgcgcgcccgcggggacgcgcctggggtgggttccgagcggccgggaggggcccgggggactgtatccctttccctggccgcagatggagagcctcaactccgcgtccctacgcgcgctcccgggctcctaaggccgggtgagcggtacccggggacccgctcctccttctccaccccgaggactcatccttcccacccgctccgccgaggagcgcagaccccggcggagcagtgcggcccaggacccttgtcacttcgggcaggtcgcgtcgccccccagaacctcggggtcctcgtctccccagtagaggt

SEQ ID NO: 1393 - DNA, 95472 bp, Homo sapiens; identical to SEQ ID NO: 1392

SEQ ID NO: 1394 - DNA, 621806 bp, Homo sapiens
tgctagttcacagaaagaccatttttaatatgaaaagagaaaaacaatttgaaggccccacaatttgttgtgtaacaacataatttcaagtaaagtgaatgtgattaaaacatcttgatttcacaaagccattcagaggaggcttcgacaaacgcaaagcgacccaaaccctggagggtcacatcccggctgctacaaacctcggcggggcggccccgctcttgcggccgggacagcgcagcggcagcaggggccgcaggggacccgcagattggcacgccgctccccatccccgcagcgcgtctgcaccggagactctgcggggattgtagccggagggcgggccgggctccgaggcgctgctcaggcattggggtttgtcctcatgagctccacgtcggcgtgcaccatctccctcaccagctcctgcaacacaggggtgggcgtgagggaggagcttctgccactctctcctggtgacaccccaccccgggtgtcggccccagagaggcctccgcgtccctcgttccagctcccctcacttctcccgcaccccgccttccgggctttgggcatcgcaggcgcctcaggcgcccgaccctgagagctgccgccctgcagcccggggccccgcagcgggcggcgtgcgccctaagagatactcacatcgaaagcgacccggggcttccagttcagcttctgtttcgctttggtgcagtcgccctgcagaaagtcctagggaagaagagggggagacgaagcaggcgtgggtcgtgggggtgggggcagcaggtcccgagccccgggaactcccaccgttccgctccctctgggcgcacaaggctccgggtttccctgctttcggtccctgctgtgcgcgttcagttgcggctctcggcgccgtaaatcactaggtcgcggttaagaatgtgctgtgcggacccgtgaggaccgtgaccgcgatccacccccagctacctccacacctcttctccccaaggcgtcccttgggctcttaatgctttttttttttttttttttttttttttataacatgaagttgtcagggacgctcctatgagaactgtttggaattgctgcacttctctggctaggagggaagtgagtaaatcaccaggcgcccctcccagctgcccgtgtccctgcgccgctcagctcctgccgcagggctggccgcgccaagcgcgcgtcctacccaaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcagtgccttcctcctcccgctttccccaactgctccactcgaggaaacaagggcatttcatctccatcgacttaagaggcttccctggaaggaaggctggctaaaagaaaaccagcggagaagaacttaatcctgctctcagcccctactcaccaatgtctttcttacagctctgtgaagactgactgacatgaaggttgagatgagaatttcaagatgaattacaaaataggaaagaaggaagaaaggaggaaaggagaaagggaggaaagaaaggagggaagaaagaaaaaagactttgagatacataattgctagaagtgagataaatatttagcttttgcatacacaaatgtactcgtcaaataacacatcagatgtgattcctcgaaataaaccgaacgcaaaggccgtacgaaaatagccgatctttaaaggtgagaaatactcgatcattctatttcagctacatacaaattaaagaacagcctaaaaggagtttcatcgtgtgaaagtaacagccagtcaagctgccactgaaagcctttcctgcttattttcttcagacttccctgaaacttggcaggtggggaatttgttctagattcatgatggtcgagagggcaggggtgggacctgctttgccctgggtttggagctcaccttctctgctgagccttctagagcagaggctgtctggatcctgctgaatgtctgcaccgtgggcttgcaatggggctgcagcagtacacgcagcgactctcgctgtcgttctcatcatccatcactactttttcaaacgctttgcatttcgcaatacactgaagtaccagtttcctccccagagtgttaatagtactaaaacaagttatttctgctggccctaaaagtccatatacagattcttcaggaaaagtagaatacaaaaagtagtaattagcaatttaacatagcgctacaaggaaatagcaatataagcagaaaaacgaagtaatttatttttctttcccctccctaaataaacttgtatatatttctacaggcttctattttgctataagcgtcacacaaagatactcattctttttccccagaggaagctgtgcaatgtggagtcatgcagcccatccctcccctctctcaatcctatagcggctagacggtgtggagaaacatggttattgtttaatcacatcacactggctgtaaatcaaccagcacgacataggatgcatttcatggctgtgaactcatagtcagcaaaaccctaaaacccagtttggcttcaaataatcttggtaggcttgggaaatggagctttgtattgtaattatgtttcctgtagttttctacaagtagctcacaatataaaaacaaccagggaactacaattaaggaaaaagaaaaatgtttttcaaaggcttagaaacagaccttgctaccatacactgtaaaagtatttcattgaaaccagagacgcacccagttaaacttctcaatttagttttgagcctagctccaatactgcagtctagctgcttcctttaaccttctgccaaggctctgtctccctgaaatttaattagaccaagagaccttgggaagaaaaaggatgaggtcccctcagaacaaaacattggctctctatgccagctgttcctaggctgacatctggactgggcagtaagcttatgttccaatcaacttttaaggaaagactacgagcatcccagcttgttttacacttaactgttcctgaaggaatttcttacttcttcccattgtgtcatttatagaaaagatatagtcaatggttcatcctgcaaggttctaggcacaggacatacttaaagggtggcgtggggagggcctgtgtgggaaagcgcacacagctctagaaggagagcaaggatgtggattcccttccttaaataaggcttcctctgggctgagaaggaattaggtggtggcaaatgctcatacaacggggtccaaactgctgtgctcagatacagaactgtgaggagtgagaggggagcgtgggccatgatacacgtccctttaatctttacctccctcttaaagatttttgaacttccacaaatcccctccaatagggtataatcagctcctaaggacaagagagaagaatgagcttatctactgtgctcttttcttcttttttgacagttcgtttccttcattatacatatgcttacagccttagtatgacaatgggggcaaaagctgaattaaagtgatgattttatgtacagcttcccaaaaggacttccaccagtgcaactgggtggtctggagcttttcttgaaaaaagagaaaataaagctttgagaaaaatttaaagtatttctatgtgaatatgacatttcctgaactctggcttctggtgtcttcactgttttcattgctattccttaggtgaactatacggtttcaatatgtaatttataattgtcaaattcaattaggtttcactgagcatttcacagcagcaaaacagcaggagcaatgtctccgtccacacagccctccagatttctgactcacggactgtgtgtattcatttgaccttcgggagttgtcctttagctgtaccatccaggcatacatttacagagctgcaaacagcagcatggaggagggcatgtttggctgcagccattttttaggctttcctggcttacgttcttgttaaagtgaactgataaagcgccagaccaaatgctggaaaagtcattaagcctgtttctgagcccacagtagttaacgcaaactccagaaaaggagagaccatagtgtgccattatcttctaccctaacgacaggtccctttcctcagatctctcccatctagataacaacgcagctttaaaatcacactggttagttttcattccttcccccgatgttattttgatccttctttaacacatttattgcctgggatcctcccacctccatatcactttctctaaaaccattgtggggaatgctattcaacagactgtatcacataggatgattttttgaggttcacagtctcatttcattttctccccttttcactgagtttgctttgggaaaactttaatatttagttcaaactaggtgttggatgccacatttcctcaacaggtctgcttataaggtttgcaaagaacatctgtttaggtggagaaatattctaagagtatgagatcttttggcagattattgttaaatttctaatgtacatcttggaagaaattgactcttgatgccctaaataggagaagatgtatggacagggatgttaataaggaaagccgagactgatgaaagccttggcgaaatatcttcaggaatttaagatacagagctgtgaggggcgcttaatattctttttttcccttctacttttcttagaaaagcaaaattgaggaatagctcaggttccaagggaataaaagaatgccagtgaatttggttcttgatccaactttctgctagtgtagagtgaataggaaagcttgactcttggggcaatgtttctttttcagaaaggcagagctgctaaacaacaacaaaaagcctcaggaaaaagctctcaagtctcacagagtatcctagtcaagattccagatagttgagaataagactgggaaataacaaaaaatgaattctgaaagatcccccagaaaatttgcaatatacgacatctcttcttgggtgtagcttgaagccttacatgctcacgaatttatcctttggtttaatccttcccaaagagggagcgaatgtccgagcagtaagaaatgctgtggtgttaacagcggtaatgaacatttcccctctgttcccttactgctgtctatccacacaaactgaagtggaagtcagacctctcctttcatgacaaggggcaataagagaggagaagaaaacagcaggcggtcctgtctgctcaggaagcgggactcggtgggactgtccgtaggcagagctcaaacaatgctcaggcagcctcagggaaatggagtcagtcagcactggcccgaggagggtgcaggcagtggagaggaagtggcagagggaggagcaggccctgcaccatggcctcgtccgtggccacccttatggaggctgccgtgtggcaatcagcgacggtgtagacttggaataaaaccaccactggacactcccactgtcgccactgtcacctctgctgggagcctccttagatgactccggacgtgcggtccagtcctcctgcatggtgcctaatgggcactttaaaatcctctgaccacccctctcgccgatcccacttttctgatgggatctcggtagaatttgtcatttgggatcagcggctgttaagcactactaaacaaatggaaagaaatgcatccatccgtatgcatgccccagaaaccagcgacaaagtccggctagtacagtagagctttcgtggaaagtaaatgagaacgtggtcttcattatatgcctacttgtcaataaagcttagggtggtaaaaaaagttacaggtgttcacttcaggaaaggagaacttaatggcatgtatagtgcaacctacatataaatggatcttttttcatttatattttaaaaatatggttgacatagttgacataaaacaagaattgtagttaagcaaaaagggctcataagctacacagacaacataattatttaggagaaatacaggatttaagcaagttaacttccttttaaacaaagttttaaaacatattctggagaaagccctttctagcagacatgctggagatgtgtggagatgagtgcggcggtcctctttcctccatgggacgaaccgcatgtggcctatgcagtttatgccaccccaaagcttgttcctttccccagaccaggcggttgccctggctgtgtccgcctgcccattggctgcctggcctttgactgggacagaggagcatgctccccacctcctgagtggggcccagcccaggaacatgcccactgtctgccctgtccagccctgtgcaactttgaggccttccccgttcaaccaggcagcagtctgagccagctgagcagaggaaagcacttctcagaggctgcgctgggaagcttttggggagctgcctactcataggtaggtgtctaacaggtttctttaaatgaaataaccatataagactttggggatgtcatcttgcatcatacctatttacaaggtgctgcgtctgtctgtacctgttctacatctgaattgcaatcgtggagttaattttttgtcagctttatttcttgatccggtgcttacagtagcatcagcctggggaaagctagattaatgactgtaactagagccctcttggttccggttagttcactgatctccactctgacgagctgagatggggggtggctgactcatagttgtgatgcgggggccatttaatgaaaaggagataaggttgtcagtgacctcagcattccaggcttcaaagccagcaccatgttggtcggaaattactggttactgttaataactggatctagggtgtaaagatttacccatgctggaaggaggtggcaaaaccccgaggacaggagataaagcgcctttgagtggaccgattagggactcttgtgacatcgctggcaagtggcaccctggatacaagaggaaggccgctgtgctcttgccacttagggctttctaccctcaaagcgctttatagacatcagctaattaaaccacaaaacaatcacatccaaaatgcaacttaagagattttgtatctgttgcaggtggcctctttcctagagatgaaagttctgtgcaaagcaaagtatctcggaggtaaaagctaaagtacttgtcatctggcttatctttaccccgcaccttctcatctaggaatgcctacctaggccacaggggatcctgaattgcataagaggaaggtaattttccttaagcttgtttccttctagtttgttaggaaatctacccacctcttagaaatgtccccccctccgccccaccaccactgcttcggacatgagtactacacagtacaatgtagatggggtttttttcctttgtggtttttctcaatgtatacagtatattaagtcctccaattcaacacacctcacttcaataatccttccttcctccctccctccctcactccccttcctccttctccccaatccaaatataaataacgtaacagggtcattcaaacagggtctatcaaacatatacccacaggctcctccaaatattcattccctcagccacttcttaagcaactcaaggcctagccaaacacctgaccacatccagattcttgctttttggccatttctctggggacttttatattggagaaaagattaagacaattactgtgatatctgttagcaaatttttggagaggtatggagaggagatgagcatgatgacaactctttaggtttactataattctgttatcactcatttggccacccatcatcacaggaaggctcagagggttttgtcaggtgtctatactacatggtcacctggcattccttctttacatcttcatgagaggaacaaagtcctataccgaaatgtatctgcagaggtatttcagccaagtacttgagaatgtcacaaagtcatctagtggtcaggttctgccattcctagtccagcagtcacaacactcaataggacaaaaccctctgtagaatgtgttgtaaacaatacactttacacacattaatttgagtggcaaagaggtctctaagtaatagatggtatcaacacacagaaatatcaacttaatgctggatggaaactgacacagaagagtccatattgtacatattgtatgatttgctgtatgtgaggtcccagaagaggcatccatggttatagaaacgagactggaggacaggggaggagtactgactgggaaggttcaccaaggaactttctggagtgaggaaatgctccttatatgaataggagtgtcggttacaagagtgtgtgcgtttgtcagaacagatcaaactgcagttcaacatttgtgcatttcacagtatatagattttatctcaacacaaaaacgtggccaggcatgatagctcatgcctgtaatcccagtgctttgagaggctgaggtaggaggactgcttgaggccagaagtttgagaccagcctgggcagtatggcaggaccctgtctctacaaaaaactttaaaaaattagctgggtgtggtggcacttgcctgtggtcccagctacttgggaggctgaggtgggaggactgcttgagcccaggagtttgaggctgcagtgagctatgattacaccactgtactccagcctaggtgacagaatgagacttcgcctctaaaggaagaaaaattcgtggacacaaccaacatggcggcattgctggagagacctggaatcacaacgtggctcaaccacttaactctttcttaataactctgagattcaggttttaaatctgtaaaacggggacagcaaggcttgcaaagttgtgtgagaattcaaaattgcacagctgcttttaacagctagaaccatttctaattcatcctatacaggctttccattgaggctattatttatcactaaaatgtaggaaaaacgattcttttcatttcttgcagtaacatcatggatgaagatgtaatatttttaagtgggctgttttatagtttttctttgatacttacatgcaacttttaccctgcaccccaacccttcctctaattttagataatcattttctgaatagctgtaacagagtgtagaagattttgtactctgctgtccctcaatttctgcaaacatttcacagtctcttgcttgcttgttgccacatatttactgctttaagccttggagaagcaaacgtggacaagagaaggccgtggctgtcatgaagcccatgttctagggtctggcagcacaagagttggcggagacctgagtttcggctgatgggagtgcgagggagcgactgcagagggggctggcttgttggagggcgggagggcactctgtactggctgggcggggaaggccttccacagaggtcactggatcagagatctgcacaatgtgcacgggccggtcacagaaagatctggggtgtgagggtctcttggggacactgcaggtaaaaaggccttaagggaaccccggagagaaggctgctgtgactgggcatggggagtgacggggagaggagcccatgaccacgaggctgggagggacacagaggcaggcactgttggcctcccgggtggtttctgccatggagcccaggcctttcccagcaaagccacgtggtcacaaggctctgctgtctggtcacagtgactgccttggagtatctaccgcctgcaggctgtggctggaggttggaaagctggctacctcaacctgatggagcttacaattctgactttctggtgccaatttttgaaagtatggaactgactataaactgtcatttagctgtgtgtctttttaaaaaggtggacgagtcgttcttgccctgcatggcccaactctaatacataatccctcttcccctggaaaatctgccactctttgatgtgcttggtccacctaacctaaaagcacctggcgactcaggtgctggccactgcagcgggactgcacccagctggccctgaaagacatggagactagggatcaccagaggcagtaacctggccatcctattccagcacctgctagggtgtgctgtgatagggctgtccctcttctggccaaatgaggacacgctcagcctctgaaggctactgagatgccgctccacccttcatttcctcctgcctgaagtgaagctgtgaccctgagctccccttgctggttaaaggccttctcctttcccagtagctctcaagaggatgaggcacagcactgaaacctgtctgtgttttgaaaacatttttaccatactcttgtgtgtatgtgtttttctctgtctctctctgggtgtgtctctctgtgtccatgtgcactatgtaaaagtccactcgtttacagtgagaacccgctcactttgaactccatcctttaccggcccagcacatccaatatggagtctgggctttgcttagagccacagtggggttttaagtgctgggggcatatgctgcgatgcatgagttcaaagatgcctgcagatgctgcctgtgggttagaaagaggggcaagagcaggggagagaccagctaagagactccagtcacagatgtggtgagagacgatggtggcctggacacgaggggtggggaggggacatagcgacggaaaggcgtgggtgaacttgagatgatcttggagaaagagcagaaaaggcctccctggggttggaggcggtggtgggggaaagaggactgacagagaactcctaggattttcatctgaatgagaacgtttttattgctttcaaagacattctacgaatcaacaatgccagaagcgaagttctcctagtggagtctgcgtgtgcctctcaccacagccctgccagcattacgtgtcatctcctttttcacgatttcaagattagagaacagggactcttccaaaagattacttctagagaatcacctgtgatctctcatatcattccatggagcacgccttcttgttttgatcctgatttgaggccaaagcctctctgctgagcaagtctgcttagctctgggaaaggggctccgtttcacatgtcctggctatgctcctgtgaaaggcaggctgaggggaaacagcttgtcttcttccgtgaccctggtccacgggacaggcgaggaaagggttaaggcaagctgtgtccactgcgcaaccaacatggcccactttcatcctccggctgcagcaggaggaagtccgagagggggcctttcacatgacatcataaaagcctgatttatcgccggccaccaaacatctagaaaatcataacatcctttcaggaaaatgcagtggaaaataatcaggctgactttgatgggagctttggtggggactccgagggcgacactgtgcggcgacccttggcaggtgctttgtttgccgtcggggccagcctcactgacaaggctgagggtctgtgctgtgcaaagcccaccggggggtgtggccctcaagtctgcagatgcaaacgagagcctggttcatactctgccaacttgcctaaaatgatactgcggtggatgtgaaggcgctttggaaaagacagctctatccaaatgtgagaaattactgattacagccttgtacataacccacagccactccaggcaagcagggcccagcctcggcacctccagcactgcgtctgggagctgctcttctctgctctcagctggggctatctttaggacactactgtttggttagagccctttcctcacaaggcacttttcctacgtcgcatttccagagtaacctgccaccgtggcagccctcctcatcacaaagaggactaggagacgacagaaaagagacattcccagaatgtcagcggaaatagaaataaagggatgagatccgcgtgccacgaggaatctgttccaggaatgtctgcatctcttcggtgcttctcttgctcagtaatttgatgaaaccaccagcaggaacctcttctttgatgtgcacaacatgctctccaaataaacacaggaaagagggacaagggtggcctagagtgtgggatagttctagaaatctggccacatcaattctaaaaagcctgttggcgtagaaagtaggcccatctttgcaaagtaatgcccactctgaaggtcttgggattcctgagtttggagaagacagacaatataaagattgagccagggctgacaaagggctagcctgaggctgaagttgggcaaaaatcaacccttggactcaatcaaagttactttcacttcatttaactgttatacaaggaagcgtgcagcatgaagatcactcacaagatgatcaagagactcatgtgagaacacagccaccaacacctctctggccgtcctgaaggtgcctggaaggttggtgctgatgcggcccccatggaggaacgggctcccatggagggatgagcccccaggatggagagctcagggcctagcctgacaccatgagcctaggattgggggcactggctgccacacaggcagcccttaccacgctacggttatgtccttgcaagtttgattcttacccgtaccagtgggccccggaaggtctgcccatgcctcacctgcccaaggttctgtgcaggaatgggaatggcgtggaaggcagcagggaggagaggtgaggcctaggcctggccctgtagcacaagctctgaacctgggcttgcctcacctgcacacgggggatcgctgggaccggaagaactctaacggcccctctccaagctactgcttgccattctgccaggcctgctggtgctcgcataacaccttgagactgcttcttgccttggggaccccgcactgtgcctcctagcccagcgccaggcatggctccaggcagctgtggcagcagagtggtaggactgaaggtgtcccagctgggctccatctggctcgttgtctgcactgagtctgagtcaagccaggtgtctgggggagctgggtgactcagcagattgtcaggtggcaaagggtggagaggcctcccttggccctggtctccctgcacctctgcccagtaaggcctttccaggcatctctccaggcccaggagccccgcagctgggcatgtgcttcccggccggccccgcagacagcacttgtgaggaggcaggtggcctggagggcagaggtctgactcagttctggtgtgctgaacaaggccccgaggaaactactgcttcaaactctcccccgtgaaggcacggctggacttccggggagctgtcacctgtgccaagtcaggctctctgggtgcttatgctctctcgtggctataaagcggacacttgtggcaccttattgccctgggtggagcaggtcactgaagcacttgcatcacacataaataatggcacaaggggaagcacgttccgcaccagcacagatcataaccaaatgcctgacctactgcagactgttgtggggacagaggcctccatgcagaaggctcccaaggggagttccctctgcagtgggccagtcagtccctgcactggctgttcagaatgggttttttaccagtttagacaagggttccccgagggcccttagaccagcagcaacatgccccctgtccttcagccttctaacagtcctacgaggtaggcaaggaaacggcggtgctggtaagtgggtaacttgccgtgtgccactcgaggtggatcctggattcaaacccaggcttatctgactccaaagactaggttactagcccattaacctagaccacctcccctgagggtcttctctctttagttatgtgtgctgacacttggtaacaataaatgcaaagccatgcgttcaccaccaggtagaggctgaggtgtgtaaagaaagcatttgccaacaacacggacagaagagagagaatgtgcttctgcgctacaggggtccagattagattagagcagagacaggaatggaacctaagagttagaaacaaaggtggggggcatgagagacaccaggcagaaatgagcatggtctcttcatgtcaaagccccacactaaaaaagcctgatgccgccctgggtttagagcaaaacaaaaattccactgcttttctccagctggagatgaatggtttcacagagggaaccctggctgaagaaaaagcatctttgatttggttaattaacgtagctttctcgaaaacactgatcagctcctcgagtgccagcaggatggccatgatcctgaactttatacttatgagcagcttaaacacaggccactggctgtgtgcccatggattcattctatgccccacccccccaacccccgacactatgaggccgtgagactcccagacttcctcaggcaggactgggctctggggggcattattcaaggaagtattgcctttgaggatggcaaggaacactcagagccacctgacatgggaactctggggtttgggatactaccaagggacctttgcttggtatctgttcccttcagagcactcttttctatgaaaggaacccaagtcacagaattagaaagaactctctgggtcttattaatgctaccaccatgactactaacagaaacacaaatattccttagggtgtggagactgagggagaccatgttttcaggtcaatgggacctgcatgagtagagtgagtctggaggtacataaagactttatctacaactacttagctcatgagtctggatagtgagagtgcagaaagaaagagacaccttgaaatcttcttattccatcctggccaacattcgttcatacatgcagtcagcccagaagctcaaggtcagtgatggagactgacatagatggtgatctccgacaggtacctgtgtctgcggcaggcaacaagggcaggctagcagataaggaggtgggtgcctgtggatacggggagagggctcaggcttgaagaggagcaggagcggaggagagagggctgtgtggtggcctccacaacgcaccatgttaaggatgccactgaggcacttgcagaaacagatactgggtgacgtgcctagcattttcccactgggggaagtggaaggattaagctaccttcacagtgggacgcaggaggcgctcacaggccagtgaagtgagggctcttgggaaatacttcccagagaagatattccctgagctgggttgtgaggaacgagcagaaggtagggagacgaagtgcaaggctaacagtccagatgcagacagctgttcaaggacccagtggtgttagagaacctcccagaactgccccgtttagtacggctgggggccaagtggaactctctcgtttgctgaatgtggaccccccaggtgcaaagcagtcatcgccagctgagcatgagctttggagtcagatccaagctgaggccgggcacggtggctcatgcctgtaatcccagcacctgggaggccaaggcaggtggattgcttgagctcacaagttcgagattagcctgggcaatatggtgaaagcccatctctacaaaaaccagccgggtgtggtggtgcatgcctgtaggctcagctacttgggaagctgaggtaggaggatggcttgagtccgggagacagaggctgcagtgagccaagatcataccactgcactccagcctgggtgatagagccagaccttgtctcaaaacaaaacaaaacaaaatgaaaacacagatccaagctgaattccagttctgccacttacttcctggatgccctgaacctcactgggcctaggttccatgatgtataagcctgttgaatgatatcgaccaatgctaaagatcagagataaaatcagtgcctgatgttgggtaagtgcccgacagacagcagctcctgccactgcacagtcagtgacggctctactggggcccaggggatgcagttagaccccagaaggatgtaccagtccatggcaccagctcggcagcactgttgcccaaggctcccccacatcactcttcagttctagcaatctgctgccctcctcatgcagttggttcccgacagcctggaatatgcttcctcttcttcactgaaactgtgcccgtggagaagcacatgggatttagggtcacagagacttaggttgacactagattcaccacgtttgaggtggcttggtgtcctcatcctcaggcatgccacacctgcaggtgtgttatgcacctgtcacggggtaaggccttccacgtatgctcgctctcctcctgcctcaggtccctctttaagtgttggccactccccagccttgaacctccctgacctctctgctgagcggctctctgaggctatcccatgcccgtggaacatgctggatgtggctgtgccttctaggtgcccgttttggagagaatacatttcttataaacagcagggcaggctgtctcaggtgtggttccagagcacatggaatgtgcccttgcatccccacagcgcaggcccagggctgccgacacagcagccaaccagacacacggggagctcatgttctactgtgggggcactgtcagtaaacaggcaatcaaggaaacaatcaggtggttacaaggcctctgataaaaagaaaattgggtaatggggggggtcacgaatgccaacacggtactgtttaggcagagttatgattgacagtgggggctgccctgggtaaagcttgaggtggagggagcaggctgggctagggccctgaagggccggctggttagaaaccctgaagtccagagtgaccccatggggctggggtcagggaagctgttacaggtggcgttggctccacagctgtgagaattatttctggcttcctcaggaaagatccctgtatatatttcttcctctgggtgctcattagaccctttgcctgcagatggtcttaggagttcccttggggaaactggtggctactcacatgctggagattggactggactcattttgggacatcctgagacatgctgtcattcaggggcttctggggctcagtgaggtcctcatccattcctgtgcaccctggaggtcctgaaggatgtaattcaggggctagtcttgtgttcctcagggacaatctatgtcactgtcacgttagtgaagataaatggagagaaatatgccctgccagctggtggcactcagaaagtgccatggagcagcacagcctgcgtctcagaatggacaggaaaaaagctttatcttcttcctgtcaaaggagggaaataccttgtggaaggtcagggtgccgtgcacctggcaagtgcctgcctgaccccagcctgtggcagaacctgaagggccactgcgatctttatcaggtgactcagtgcttagcactggggaagggcggagcatggagcaggcacagaaggtcccgtggagaggccctgagcagcccagacaggagcgctccattctgctgctcaaggcattacctccagcagtcaggcgcgtacagctcgcgtctctcggatgatttctctctctctctctctctctctctctcttttctatccctcttctctctccctttccttcttcaggatttaattaattgaaagtcaggtttttaaatattggtcagcctcctgttggatatttggggtctgccctggggctcccccacgcatctctctgacttaccttcatgaaaggtgaagcggaaataccccaacaactcggcacacttcttttgtcccaaacagtggaagcacactaggaagttctcagaaccccgaagaaggccctcgtttcacctgctccttcaggatgcccctgtcctttcctactggcccctggctcagaaagatcgccctgcgtagcactctccttttcatcctgtcctcgctcacttggaaccctgctcttcagaaactaaggggagcgcagcaagcctcaattctcttgaaatctgggcagtttccatctttttttttttttttttttttttttaagaaaaaaatagagtctcactctatcgcccaggctggagtgcagtggtgtgatctcggctcactgcaacctccacctcccaggttcaagagattctcctgcctcaggttcccaagcagctgggactacaggaatgtgccaccacgcccggctaatatttttgtgtctttagtagagacagggtttcaccatgttggtcaggctagtctcaaactcctgacctcaaatgatcggcccacctcggcctcccaaaatgctgggattacaggcgtgagccaccacacccggccagtttccgtctttaaacctaccccaaaggttctataactgttgctcagatttgtctgaaaattttggttttgtcagggagaaaataaatttctccttcaaaatctccaccttccccctaaggtgaaggtcaacctggtctttgtcctctaggttggagaacggggttccatggtgaccatcgtcctgagtccttatgcataacagacgtggagtaatattttgactttataaagcctgcttcatgatggcttcttgtgtctttgtgaatagcacaggtgggcagctgtgctggtcccatgtgggcgacaggcaagctgggcctggacggtctgtctctccaagtccaacaggaagatcaggatgggcctcggatctctgctcctaaagccgggccccacgaagccccttccctttactccttatggagtccccttcctcactgagttttttcccctattttaaaatagctcttcacagagaatctttgggggcttttaaacagccctggtcttagcagagttaacacaaccacatcatgagggatctgctgacgaggggggcatcctgcagagccggtccatacttccttttattttcttatcctgagtctcttcccctgagtctccccagagaaactggtgattctcaacacatcctgtggagtttgtgaaaagtggagcttggtgaggtcctcagccaggtgagatgtgccggaatctccaagggtgccctcatagaaggtgtctgaggattgattcaccagaccagacaagtgtggggggcagggacagcatctcactcagcttggtgtccctgagacccagcccatttggcaggacacacaggcattgtaaggaaatgcaatttccttacgccttcctgaaaacgaaccctgactgcccacggggcagctgagcccccgaggctctgttgctgcaactgtgctcatctccaggtggctgtcaaggtgctcatgccttcctcggctcccatggcataaatgaggcaaggagagccttcgagagtccttttagtagagtaggatgtggttaccagggccttaggcagttgtggggatgctggtcaaaggatacacacctatagctaggtggggacagcggaagttcagaatcagcagatgcatagagacaggggtggagaggtgaccacctgggccacggtgggggggacactggggactgctaatggttatggagtttttgcctccggtgatgaaaatgccctagagttgattgtggtgatggctgcacactgagcagactaaaacccattgatcatatactttaagtgggtgaactgtatgatgtgtgaattatacctcaataaaattgtttaaaaattaaaaaaagttgaaagtctcttcccagctcccctcccctctaaaaaaaaagtccttttaaaaaccctgagaggaaacaaaggagcaaagcaccctgcaggtgggccctctctagaggccaagcctgactcctcagctgacaaggctcccagggcggacggcccttacccagcccccgttgtccccagacacctcccctctgagccccagggcccagcgctgtgactgacattgccccgtgtcctcggcctgctcttctggcaaggaacccccggtctgaggtaggtcagcacggcacctcagcctgcagatactagtagcctgcagccaccagtatgaggatccactcttcctccagggacccacgcggggagggccctccaccgccaggggagacccctgattccacccgagcgaacgtgtgaacgatagcggatggcactgcagctgtgactagggcctgtcaggtggactgcagattgccacctggaagccctctgctgggcatccaaacctgccctcaacacagccagagccttcctgccttcctgttggcgtctcaccattgccataaataggctgcatatgagccgctaggctgcactccccacaggctcaaaactttgctgctgcctgcactttgctcctgcctttctcaccaccttgcactttttcctcccttcccaagttccccagctgaaattctctccactttagaagaccaaatttgtgctctaagtcagccaacatttctcagcatctcctgtcgggaggagccaggtaccgtcccacagggagctgctctaatccctgctgcccgcccaggaaggagatcccaaggtccctgatttatggcgaagaggagggactgtgaggttttctggtgaccacagagccagggttcacggccacccccactgccgtttcttgcacctgtactgtgagccttgcacccactgcaagctctgacagctttggctctcagggcctggccagcacctacattctgcagatgaggaagctgaggcttagtgagtaacttgcccagagtcacgaggttaggaagtggggtgtatcaggatgagattcagactctggtcctttttttttttttttttttaaacgagacggagtcttgctttgtcgcccagcctggagtgcagtggcgtgatcctggctcactgcaacctccacctcccaggttcaagcgattctcttgcctcagcctcatgagtagctgggattacaggcatgtgccaccacgcccagctaatttttgtatttttagtagagacggcgtttcaccatgctggtcaggctggtctcgaactcctgacctcgtaattcacccacctcggcctcccaaagtgctgggattacaggcatgagccaccgcgcccagcctgcttgattcttataccctgtcatccagcacacttccttccccaaactgaatgcaagccccccatgggcagagaatctatggtgcccattttcagtcacccgtgctgtgcctagcatagcttcctgcacccatcagcgctaaaatatcccacggatgctgtcttgatggcagaaggcacttttcaatcactgtgcaaatggcgccttctacccccatgatggcatgtgcacggcatgctcgagtgcccggggacgctcaccctgtcctcctggaggtccggagccctcgcctggtgttccctgtgctgtccttgccttgcctcacttgctcttttcctcccactctccgggtccaaccttggctttagtgtctctgctttctgcaggctctcctggggcgggcccctttctgcagacaacttcaactatggcctctatgtgaggacatcactctatcttcagcctttgcctttctcctggattccagggctgcattcttctttccagcctgacaactgcagccagtgcccatggccaccgcagcgtcaccctgtctacagcaagcatctcctgtgagaagtctccacatgcaacttcgcttctctctagcacagtgtccctctcatttctctgaggacttgttaacaatctgtggttattttgccaatccacccactaccctgtcgtctgcctccctagaacatcagtgctgagtgcactatatggacctctgtcttcaggacctggcactgtgcctggcacgcagaggcactcgatcggtatttgcagaatgcctcaagggatgtttaaaactgaagtcaatgtatctccccccaactaaatgcaattgttcttttcctgttgcactgttaccattcctctcactcactcccatccttgagatttaaaatcttagccacctttagctccttcttctctattttgccacttccagtacctctggcacccaggctttccttgcacctcttctgcatcactgctgtggcccaagccctcagttcccgtgtccttggaggatgacagcatcctcccgcttcacagaccagccctcccctgctctggggtccgtgctcattccacctagggcttttctgtgacagtcccttagtcaggaccctccattacttgccaaataaaagccaaactctcaccctgacctccaatatctgaccactgtgttttgagacagggtctggctctgtcacctaggctggagtgcagtggcacgatcatggctcactgcagcctcccaagcagccgggactacaggttcatgccacggcacgtagctaaattgtgttatgttttttttagagatggatttttgccatgttgcccgggctggtctcaaactcctgggctcaagcaatccacccactttggcctcccaaagtgctgaaattacagtcatgagccactatgcccagcccagtatctttcaatatgatcccaacctccttttccaggtttatttcccatttttttccacctatatcctgcattcaggaaaagtcagattaaccaggaatcaggcataggctgaagactccccacttctgcacatttagaaaactccctgaagaggaattcattgaatgcctgggtcctgggcaccccatgtggtggggggtggggtggggaggttagttcaaaagccaggtcagagggggcctactgggctcactcagtctcttacaaaaagaccaccttgatggctcctgtgggcacgggtggtagccaggcctcttgccccttccttgccctggctagggaggaaggatggcggaaagggctggactgctttgcataaaggtgacaagggctgctcagggcagctgggcaggtgcagagggagaagaactccatcccctcccagaggaaccagtgttctgcaagaaacaatgaccaggaagcttcgagaacaggcctgtccacgatgtggctttaaagtggtttcttaaccaagacataacccctccgctgaacacctgcagttatagaacatcttatttgctgtggaacgtaggaaatggaggctgcagggcattcggagtttcactggagccaggtgattctcagagctactggggagacatggggtttcctgctggatgggaacaggaatttaagcagcttctccccacccccaaatcctaaaaaaagagtgtccccagcaggctgaagggtctggaagctgatacctgggatactgaaataagaattaataccttcagctataccagaggatatggtcactctctcaagagatatattttgagtactcactacaggcaaataggtactagactctgaacagggtggctaatgaacaaggtcaaggggacacagacacatatgccagtaactgccatgtagtgtgacaagacactgacttagttcctgggcacagtggaaggaaagtaggaaagggtgtgagtcctcactcttgtgtggaacggaatgctctggagagaaggagtcatctgggctgagtcctgaggaatctcggacacattctcaggccggagtgggggaaggacaagcccttccttcctcctggaatgtccttctcagcatccggacctaccgacactgtactgatccctccagtgccagccgaatgccacctcctctcagagtacaacgatgctagcggtctggtcttcccttgaaccacagctgttctcatctcagggaccagcacagttcccacatccctgatgctcgggtgctctgtacctgcaggggcttctcgacggtaaaggaactcggtcttgttcattagccaccctgttcagagcccatacctatttgcctatagtgaggactcaaaatatatctcttgagagagtgaggacatcctcgcctaaagctctttctcctgattagatggaataggcctggggctctgtaatttgggcaatggcttatcatatcctctctcctcaggatctcctcactattactcttcagaagtgacaatataaacagtgtggttgttctgtgtggcagatagcagtggaagttacgctggatacatttcatgtttccaatatatctggacatttcaggttctaccttggtcggaaggaaacctttctctccagcgtcatgctttctgatgtagctgcccacttatttgaagctgcctatgatctgtactcagtaacacaagagactctaaagattattttacatcaccactaagggcagctccataaagtatggcttaatttcacaactagcctcacaatgctactgtaatttatgtggggaaaacttagaacaagtatcaatagcaaggaatcattttgaacacgtaaagaatatgcgatgaagtcttcctctgcacacaaaaaagcatggctcttgcctccttctttgcaaagagaactgtcagatccgttagtttcataatactttaatcatacattgtctagctaattaccactcccaaataatgaaacgtaactttcaacgatttagaatgccacagttttttgtaaaatagctccgttttactggtctaagtttaaactattacggcgatcactggcctgctgcctccctgtttgatttctccactagctgtcccagagatcttgctgataaaagatctaaaacatacagtcttccgagagctcttatttgacttttttgctccacatttccagatataatggttctcaaggcaacactatacagaatcagagagagaacatgagcttacgtttaaggcagtcattcacatttacacacatataattacaactcttatttttaaaaagtgtaaatttatgacactgtccttcaaatattattcatacatcaggttttgggttatgctgcaaatcacttgccagtaagtctagggttcatggggcaggaatgacacgttaaccctgtctagccactgggggtcctggtttggaataatactgtgatgtactgtcaggaagtaagcttgggtactaggaagacattagccgattactcttttggggttttatacagtcttgctgtgattcacctcaacccgtgtttcaagtgtatgtcattaactcttcacagacaggaaaactcagtctcagaggtcaatgacttgcctttagttcaaattgaggtcagaatatctgataatttcccaactctaaatttaactcatgatacttatgccatgaacattaaaactgactgtacactgtgcatccagcctatttcaggacacatttaataatacactttaattttgctcataatacgccattaaagcaagagtcctagaggaattgaaatctgctatctttgcaccttgtaacatgaaggcacgttatccaaggcacagatgcactagatccaaatgctcctgccctaattactgcatctttatgtgcaggccaaagggcatctttttccctttgctacattccaactcattctcaaacacaaggccaatgaccccaggttctttccaaactgtctcttctttagttttaaagaaagtttattgcctccttctccaatcaagacatttttactgcacttcgaagacaccccttagatatcatgctcctgacagctctgcaggaaaacagttttaggtgacttgtcactttatgagggtggccagtgcctggcttcacagttttctaaatccctctgtcaagagaggccttgaaagagcagactggaactttccagcagtctcctggccagtgaatgtgcaccttgccttctgaaagtaacttccgaagtgatgatcttgccgtctgaccttgggcaagcaacgacttccacggcctcagtttcttcagctgtaaagtggcaatgctggccgtaatcatctaggttccctcggccacgcagctctgagatggcctccttttcctttcctcatctagctcgtggggactggtgccaatactatcagcaactgcatttatcgtaccaagagttttaactttcagggcagccgtgagcccagcaaagactgacaggatcatctcctgcccatggctctgacagctctcttttgatccaactcatgcccaggaaaaaaaaaaccaaccattaattatatgcttatttcttcctttaaagacataagagactccttaggttctcagccctcctggtgtgtcccatcagatggcttggtacagtggcaccttttaagaacgtgtgaaatattccagtccgttcagattcaggcagaatccaaatcactcaaagccttctcctaccaattcttcgttcattttaatggtcaagcacagaggaaaaaccctcttaacccttactgtctactgattaaacacatttatttacttatttattttgatatagggtctcgctctgtcacccaggctggagtatagtggtgtgatctcagctcactgcaacctccgcctcccaggttcaagtgattctcccacctcagcctctcgagtagctggattacaggtgtgcatcaccatgcctggctaatttttttttgtatttttagtagagatgggggtttcgccatgttgtccaggctgatcttgaactcctgacctgaagtgatccacctgccttggcctcccaaactgttgggattagagccgtgaaccactgtgcccagccaattttctattctcatcctctgactcttaagattaaatgctctaaagaataaaacagtcttgttagattgaaaagcaaatgagtagatgaatgaaacagaaaagtactcggcaaccctgccatgtcccctgagaaggcagggccagctctacagtgaagattggtgagtggttttcctgggccctgcatgggaggaaaattaggcttgtcctgagtgggtgcacctgccctgctgagctgctatctggatgacgatggccatgctgggccgcagctccaccaggagtgtggcattgtgcttggtttgatggagcagcccacaccagtggcagcatgcaccccttctcactgggtcatcagctcacacccatcatgctggtttggaaaattcaatgacaagttcaaagagtccggctggtgtgagggagcagcctggcatggctcactaaggcccagcatggtgtctcacaggaatagttctgtgcacactgtcctgggactggcatctcaaccttcctggcaaagaacagggaagggaggtagatgttctcctggagcctccttctcagatgctctgtgcatcttcacttccagggctggtgtcaccagggtcctggccatcccatgggcacaccctcctttaactagaagaacagttgttgggggccgcacccagggcgtgggacatacttggctcatcctgtccaggtctgaagctagacttttgccctggccctcatctctgttctgggagaaaacagattcagatgtgagcctgtggttggcatcacacaaatgtgactgttcagtttttaccatctttgaggtgatctccgtgccaacctctccatccttagatagacccatgagccctaccccacagagttgtaaggaagtaaatgagataatgtgtatgcaaaagccctacacctggcactcgataaacaacaatattcgcttgttcctatttaaaagtatagctgcccaaatgccttgtttttcaagggtgctttagagatagaaacaatgaacttcaacatcacacactcagtcgggtgtctcctgcactggcacgtgctggggaatgaaagttccttgtttgatgttttctctgctggcagcagtgcagaactcagaaacgttaatctgagctttctcttggtggaactgagagagctaagatcagaaatcttctaagattatccttaacaggccgggtgtggtggctcatgtctgtaatcccagcactttgggaggcgaggcgggtggatcatctgaggtcaagagttcgagaccagcctggccaacatggtgaaaccctgtctctactaaaaatacaaaaattagcctgctgtggtggcaggcacctgtaatcccagctacttgggaggctgaggcaggagaatctcttgaacccaggaggcagaggttgcagtgagctgagatcgtgccattgcactccagcctgggtgacaagagtgaaactccgctaaaaaaaaaaatatatatatattatatatatatatatattatatataatatatatataatatattatatatatttatatattatttatatataatatattatatatattatatataatatatattatttatataatatattatatatatttatatataatatatattatttatatataatatattatatatattatatataatatatattatttatatataatatattatatataatatatataatatatattatttatatataatatatataatatatattatttatatataatatatataatatatattatttatatataatatattatatatatatatatatatatagagagagagagagagagagagacagacagacagacagacagacagacagacaccttaataaactggatttctttctggccagctcagacactgaggtctccctcctgtccggacctgctgtttgtcctgcttctgcttgtgggatgtgtacaggctgccacactcatgtgtgcttgctggccttcttcctgccctcctgggtcacgtgtgtctgtgtatgtccctctcgatccctcaggcctgcattgtattttggccttccgggccacctgcagtcacccaggtctccgacccactagacacctggcccgcgtggctcctgttgtctcccacaggtcctactgctcggcagccttgaggagcacagatgcatgcctccctccacagacccccgtggcacgtccccaaggtgccagtgtcacttcccatctacactcttatttgtacaatttgtcttattgtttaaactggactgtacactgccgtaggaaaaagattaaattatttttccatgaccacatatacttcacttacaagtacttcacttataataggccttcaaatgcaagttgcaaaagacaccaataaatgcaaagacaacttgtgttcacggactggaagacttactattgttagggtaaagatcattacacaaagtgatctacagattcagtgcaatccctatcaaaatcccaatgatgtttttgcagaaatagaaatccatcttgaaatttacatggaatctcaagggactctgaatagccagaagaattttgaaaacaacaacaacaaacaatagcaaagttggagagctcacatttcctgatttgaaaactacaaagatacagtaatcacaacagtgtggaaccagcataaagacagacgcggatacgaaggatggaacagaaaacccagatgtaaaccctaatatacccggccaattgattttcaacaagggtaccaagaccacactacggggaaagaacagtctcttcaacgaatggtactggaaaactggatatccacatgcgaaagaacacagctggacccttaccttacatcgtacataaaagtcacctcaaatagattgaagacctatacataagacttaaatctataaaactctgagaagaaaacaggagaacagcttcatgacattgggtttggcaatgatttcttagatatgacaccaaaagcatgggcaacacgagtaaaagcagacaaagtggactcctacaacttaacaacaacaacaacaaaagaaagaacaagcaaataagagagtgcccaacatcgctactcattagggaaatgcaagtcaaaaccaccatgagataccatctcatacccattaggaggtttactatcaaaaaacccagaaaataataagtattggggaagaatatgtagaaactggaatccttgtgctctgatgattggaatgtaaaactctgcagtcgtaatggaaaacgagtatggtagttcctcaaaaaattaaatatagaattaccatatgatctggcatttccacttctgggctagtaaccagaagaactgaaagctgagtctcaaatagacacttgtccactcatatttacagcagcattattcaaaacagccagaatgtggagggaacctaagtgtccgttgacagattaatgaatcgacagactgtggtaatatttgctatggaatattattcctccttaaggaggaagacaattttgacacctgctacaacatggataaatcatgcatcgactatgctgtaagtgaaataagcccattatgaaaagacaaatactccatggttccacttacgtgaagttcctagagtagtcaaattcataaagatggaaaaaatggtggttgccagagcttggggtggagaaaatggggtagagttttagttttagaggaaaaaagagtcctggagatgggtggtggtgatggctgcacaacactgtgaatgtacttaatgccacggaactgcacacttgaaaatggttaagatgtaagttttatgtgtactttaccattatttaaaaaatatcccactgggccaggcatggtggcacaagcctgtaattccagcactttgggagctcgaggtgggcggatcatgaggtcaagagattgagactatcctggccaacatggtgaaaccccatctctactaaaaatacaaacattagctgggcgtggtggtgcgcacttgtagtaccagctactcgggagactgaggcaggagaatcacttgaacccgggaggcagaggctgcagtgagccaagatcacaccactgcactccagcctggtgacagagtgagataccgtctcaaaaaaaaaaaaaaaaaaattccactgatacttaacttgaaaaataaaataactcactatactgaatcactaactctcatttttcttttcaaaaaggagattaaaagtatattttcaaaaaagacaaaaagtgtcacactagagctacttccttgggggtatctgagccttaattgttgtatcattagtgcctagcacagtgctggttacatcacgggaactgggtaaacgaaattttaaaaataatgtgcagggatgaatacgtgggttctgattattcttttcttaaatttctaaggctactcactaagctatttcatattgcactgacatgtatatattcttttttcaattgacacattttcctatttatgtaaaatatttacattagtttttttccttacgtttgaaagccttacacacacacacacacacatacacacacacacacacacacacatattttttttttttgagacggagtctcgctctgttgcccagctggagtgcagtggctctctgcagcctccgcctcccaggttcaaacaattctcccgcctcagcctcctgagtagctgggattacaggcgccagccaccacgccttgctaatcttttgtactttcagtagagacagggtttcaccatgttggccaggttggtctcaaacttctgatctcaggtgatctgcccacctcagcctcccaaagtgctgggattacaggtgtgagccaccgcgcctggctgtctttaacatatttttatacaaaaccggagacaagagcatgatgagcctgcggatacattcccagattcaacaactcatgatttctaatttggccacagtgtatatgtgttaatgataatgtcctcagagtcagaatcacattgtgatgtcacgcacaccccacagccaggtcatacatgtggaggctgaggcacatagaggtgagcaactggacccaggtcacacagagagtgcgtggtggagctgatgctggaacccagaacacctgtctccatggccctggctctaggacatctgccaaatgtattagcctgaattttatttatacaagttgatcttaactaataagattaattttccaaaacttagcccatttttcagataaggttaatggaactttctaaaacagaaaataaatgccttatgagtcagtggtctcctggccccggtgtttgagcctttgaaatgtcactactgtctccaagagctccaaaaatggtttttgccctctttctttttcacgctgttcaccagacagatttgccatcacaaattcaggctcaaaggagacaacatctgtgaagagttccataaatggtgaatcagtatacatggtcatgtaggattgatatgattgttggaaaacacaaaaaaacacaaattcacattttctggggccgggagtggtggctcatgcctgtaatcccagcactttgggaggctgaagtgggcagatcacgaggtcaggagttcgagaccagcctgaccaacatggtgaaaccccgtctctactaaaaaaatacaaaaattagctgggtgtggtggtgtgtgcctgtaatcccaagtgctcaggaggctgaggcaggagaatcgcttgaacctgggaggtaaaggttgcagtgagccgagatcgcgccactgcactccagcctgggcgacagagcgagactctgtctcaaaaaaaaaaaaaaattacatcttctggatctgggcttggctcctggctgtacacggtgcctccttctaccgtataactgagatactacctgtacaggactttgttggagaagtgctgagtgtcccttcaagcagcctcttccccaggaggcaatctttaccttcactagccacaaggaaagactgaagtctggcgccaagagcaccatgctggaggtctcagtggcggggggcacatctcacccaaggccactctgccctgtccacttgcagaggggctccttggtgtggggacagcaagagggtttcttttgccacaggatgaccattggctccttgggagccttggtcctcttgactgattcatggatggctgaccacgaatcctcttaaagagatctttgatgccactagactactgacaagcatgaagtccctgacgatgtgtcatgggcctgctggaatctctgtttcaaggacattcttccccagacagagtggagagtgaggactgaagggagaaagagacagcgcaggtgcaaggtggacagcacccatcgacctctgtgctggaagcggtgcttatgcacttaggcaggtgctgaaatgagagaggctgtgcctgaagacagcaggtcaagtctcagtatgacagcaacatggcagattataaaaaccagatgagccagcagatagccgctgtatggtaactcgtgccacaataaaaatgtcagttttctgtattattttacagcattgactagcctaggaatgctttcaagcaggacactgataccctccattgttaaagacagacataggcatttattaactggtgttcacacggctctttcactggctgagtttgtgaggcgagaccagatttcctgtcctaagtattcctgtgggagcagcaaccatgtgggcgcctcaaaacgtttccatcagaaatgacagtcgggggcaggtgccccgcactcaccaatttctatcccacttactttctctctccctggagagttgggcaaaattctctgtcatttcttttattctttactcctaaaagatccttgtaacaaagaactcaagcaaaaaaaaaaaaaaaagaaaaagaaaatcccataattagactaagtggcatcccatccccctcccctttttaaagtgaagtgagctctgcgcatggcagcaaactggctgcctctacaggcctgccttgcgtagcgccggggtctggagtttctggagcattctcttggaactgctcagaggcagggagtgccgggggtgtgtgtttgcaaatagatacctgaatgattatctagaaaacgtgcctctgaattccaagtgaaaagacataattttgagggttatttgccttcaatttgggtggtccatcgtgagctgcctttatacatgccactgtccttcctactgaaggtgtccacagcatgatctcttcaccgggattgggatgaaaacaccagtcatcacccagcagatgttgcttctctactgaggacccttcaacttgttcactgtttcaaagctgaagctgcaatttgcgaagtcgcattttcccgaaggctttcccacctgggccttgctgaggaacataagagtatcatcccaccgactgctggcattcggccctgcgcccacacagcccagcgctctgcctacctgtgtccaggtgagagtgcatcacaggcatcctcctggacaggcagagggaagctctccatcattatggaatgcttcctctactgtatgacacactcagttgaatgaaaagaaacatcagtctttctgaatgggtaatgatattgttttcttaaagaatactttcacagaaaaataaaaaaatacttctagagtaagatttaaaaaatcaacatatacatttggaattatttgtctcaaatcacagactctagaatatttaagttgcttgagactatttagctcggctttctgctcacagacaggaactgaggcacacgcttgggaaggccaacattctgactattgtcaccttgccggcatggcactgttgccccagccaagctcgcagttacaaacatccagggagcaatgagagtttgcttagagaaaagagacgtcctggaatacctgaacggctctcacaaggctgtgaggggctggaactacttggggtagatatatgtagaagtcacgtgaggcaggtttgagtttaataggaaaaaaaacccaaaacaactttctgatggccttctgagagtggaaaaggcagccttgtgggccagtggcaaactcctcatgaaccatgggcctctgtggggcgtatgcagttcctgctattcctcatgaaccatgggcctctgtggggtgtatgcagttcctgctctgtggagggaggctgggcaggggacactggatgctgtgggctcttcggtggcagggccttttttttttttttaaacatcactgttgcatgttttacatatcataaaattcactcgtttcaactgcacgattcagtggcctttagtaactttaccacattgtgcaagcttcatgatacatcagtgtcagaacctttcatcccaatgaggtcccatggggacagagtttcaactaaagcaggtctcttgggactatggctgtctcgggaggggcctgtctcacatgcattccatcccagtcctcccagttacagcctgggtaccttgctttgggtgtgatagggtgttgtaccaataagcaatatccatactgtctacccagataggttcaggcaaggaaggggctgggtggacaggaaaaggttggcagctgggtgatagcacccagtggaccaagggcagatgccactgagggggcaacaggatagggtagctgcttctctcactgcccccctgccccatactcccatatagtgaatctgtttcgggcagaggacacttttcaccctgaccatgtatcataataaacttcaatggttctctcagcaacactgaattacttgagaaagactttgttattcaggaaactgagtaactgaagctcagaaacttctagtaaaaagatgatcataattgttacataatatccattaaaaaaaaaagaaagagtaacagccattttaaacccaattagtttccctgacatgttaatatatgttaaccagaaaaaggaagtcctttttaaacctgggctccctgtggtgcaccccaaaaggaagtctcggtggcctagactccaacgtccagtgagagacaccctgcatgcgtcacgtggctccccagccgcggacctgcttgtgttcttacaggaggtgcctaagtggcaccttgaagaagatgatatgcttgctgtgttatgtacacccgcatccttccttgctaaagcattcctggaaagcccctgctgaccatatctgggggtaatcatcatgggatgggccaggcaaagccaccaaaccatgtgccaattacatttcaagcaaggggtcctattggcaccagcatcatttttttaaggcaaagtctaggatttcagctgtaggaatttaaaaacatccagagttaatttttcacacaaatcttgaagagtgggggcttttagtgtctttaggttgacagcatccaaaatccaaaagaaacaaaaacaacacaatgtgcccagaaaactaagaacgccattttggctttctgaaactttgacaatactgcagacacgggatgagtttctgcggagaggccggggaggagaacggatgtagggggtcacatgtggctcatccagtaggagaaaatgaaaacatgtgtcaatgaggaaaaggcacaggaatcacacctccggttcaagtagtcaggcagtgtgatgaaagctgcgagacgcggggatgcagatcaactgaataagaggcatatctcaaacaagatgtgggagtggattctctctgttctgattattagtatctagtatctgaattcaacctactgatttagtttgtgaagtacaggcaatacgagatgacaggagatgttggcggcaaagaatattctcatgcggacctggagtctttgagagctgcctagaagacaaccatggtagtaattccttctttccagcatagttccacaggtttgtaaatgaatcacagctgatcacaacagatggcctccatttcctcccatcatgaccttgagatatggcccaagcagatcacaagtcccagcaagcagttttcaatccatatctgagcagcgccacataaaagatgtggcttgggtgactggtaccttggcatctaaggatcagagttcccacgtgattacaacgaacaccatttgcagcaaataccatggggcagtcctctcggcttctggaaaactgctacggagcgctgtaactggcctgaagtctgcgtacaggcctcactgatacctttttcaattatccatttgggttaaatcctcatgggtcgtgccatagatccctgagtggattgcacagcaggtgctattagatcctagttgtaatcagtgagtgatggtccaggaacctgggaaggttctaataacacgcaaggactatcatcagaatacctcaacatttaagcagctttgcatcttcaaagctcactacaaacattaattaattaatatagacgacacccctgtgatgtcgttaagtatgattacctccatttgacatataaggaaacaggttaagcggcttgcttgaggccacacaagcccgagtgggtctgggaatgtagtttggaagcacctgatccagcacacacggaggcgtgctagtggcaggtcaagaagctcacccactccccagccctcgccatccccagcaagtgggactgtggctgcaggagatctgctgacaggctgtccgaggaccctgcccggatcttcctcaaccacgttccaacccaaaagagttagtaagagtctgacagagagcgagtgagcaagagcaagctctagcaaatccactgctgggtccagctgcagtgatggggggtgcagcccttgcttcagcattccctgctgctgaggcggactaggcagtggacagtcggatgtcattgttaaggggcgggtgggtgcctgagggggcagaaaatggaggaagcatggaggaggctatcatctgagggtcatcaaaaacccatgacagacagctacactggggagatggaggaaggacctgagaactagatgaaatcctacagcaggagcaccgggagtcacaaatggcgactcgccttggctccgaagctgctggtggagagagaggaactgcgtggctggaaggcattgtgcgggactgggaaaggaaggaagggagccagcacttctcggtgccttctgtgttccagacctttacagcattcacttatttaatcctcagatcagctcccccaggtgaacattacttcatcttattcttatcttagcactgggaaactgaggtggcaatggtgagttttcaggcaggatcagaatcgagtccatgtgtggatgatgacagtgatcccacaccaccacagacaggtaaggactctggacgttggaaacagtgacatggcaggagggcctctgggaagagctgcagaaggtgcagacttgggaacagctggagaaatgatagcagcaccgtgtgtgctgggggctccactttgaattctggaacctgtggcatgggtgaccagtaccttggaatccaaggattagagttcccacacaaagaagtacagttgatctgaggacagtctcagagaggtggggagggcccagaggtgggagtgggaggtccaggcctgtctgtaccactggaacatccaaggagaagcaggcaagtggactctgtatatgacatcagctgctttatgttgatgtatataaactgtcctgagagccaagggaaatgccttaaattctcaacaaagatgagctgaaaaaaatcattccaacattttcccaattatttgacagaaacacaaatttagggcttactgctgcataacattttgtgttctctcctgccaagatgctgagggcagtcagctgggaggaatgctactttggggatgaattaaagtttgttgaataaagaatgagcacagattcagaagcaaaacttccatagtgcatgaatcctcccaacgagactgtcagaataaggatataggtttgcatttatttattttactaaaagcttcctacttccctcctttctggatatcgtaaggggtttgacctttctgtttcaaatatgacatttctttctctgatttcctttagccagatgtcaaacctaaaatagaatttcttagaacttactgctcaaatatgatacttaggagcagactgtagcttttcatagtgtcttatggcttttctagaacatgcactgataaggaaagggagagaaattcaacttggggtgtctctgcacccttcgttagggatgctgggaagtgatggcaacgcacagaagcaccgtgcaggtcgttggctcagaaaaggcagccactgttttcatttaggagcccagctcagtctgaactgtgggacctccttcaccaaagcacccccatattgcttcttgttctcacctacttaactgaaacgtcccaaagttccctagaagagattttagctatcatctctcctagaagagcaggaaaccaagctcccttttccttgcttttatccttgcccctgcggaatttttccaaaggtaccagtgatgtttttgtgaatgcaagtacacggcggccctcctcctcacagcctggaaccccaaaccctaccactggcctgcaccgccttatgtgactgcttgtggctactgccctcaccatttctctgtgccaggaatactggccccactgctgttccttcaactggcaaagcatacacctgccacagggcctttgcacaggagtcccccggtgactggtgaagatccgtgtgccctgctccctcatttccttcatggctctgctgaaatgtctcatcagagaggccttccttgatcacctttaccctgctttatttttcttcatggcacagatctcctcctgacatgttattaacatgtttgtggtctgtgccctcctgtatgaatgggagcatgtaatttatttgttgtaatttgttggaataagtcacctactggcttagcaccctcaggacccagagcagtgcctggcacacggtaggcacccagtaagaatttgttggataagtgcttacatttatttcaacaaataaatcacatgcatgccccgttatagttctttacaataattaggctaaaagttgcttataaaaagaaaaagaagtaacctagtcaaattttactttggtgtttcttaaatgttacccattcttactgcaaaaatcaactcttggaatctttatcatttctctgtaaggccgagaatctgccctttgctacttgaatcttgtgtcagccttcagtcaaaactaatgaaagtctgggccaatgagctggccccagatttctggatcatccaagcatctccttcactctctggaccctctcacctgcccaccccctggaaccacactgtcctctgtcaccaacagtgaggtgggggagtgttcttacaacttcatcgttcactcacatgggagaccgtgagtattctcttcagaggagaggaattgtttctccttagagaggcgtgagatgaatgagtgtcctgttctccctagagtccccgattcatggtgtctggccactcctacaggcacagcacggacaatcacataacgaagctgaaagcaatgtgcttttgagtataagccatactggttagaggtgatttactgtgtcactctgtcacattgacatgtttgagactcatgtaaactattccctgatcagccacagttctggcctaacagggggcaatgctaatgtttaataatgtaagcataatatttaatttggaaagtactagtgattatatagtagtaaagaggcttcacatgtgggtagagattttttaaaaatctcattgataccaaggtatagtgcagtagaaacattttgaaactaaagttagaagcgtcctaactgtagaatgaacatattcacgtcactattgttcaccaggatcgctctcacacaccacacgtgctatgtgaatacagatagacttctgcatactcagctggctttgcacatctctaccacagagtacgtgtatctcttggacagagtatgactggtggaagtggcagttggcagtttatctttgatcactatattcagaggtggcttatactttttaattttttttattattatactttaagttctagggtacatgtgcacaatgtgcaggttagttacatatgtatacatgtgccatgttggtgtgctgcacccattaactcgtcatttaacattaggtatatctcctaatgctatctctcccccctcctggcttatacttttaagggcacaaaatatataaccatgattgcttgaaagggatttgtttcaattccttgtttgaaggaggtaatgggccagcctaagaatcaaaagtgacaatgaaatataaaatgtataaccatgattgctttaaagagatttgtttcagttccttgtttgagggaggtaatgggccagcctaagaatcgaaagtgacaatgaaatatgaatgtaaaagaggaagggagacagacctctggcttgttagtacaacagaatacttacttggggttcactttatacattactttcccccattttcctacccatttgggtaggaatgagatctgccaggaaggtgcacggggcagaaggctttgctgttgttttccatgtcttggtttccttcctttaccaggaccagagcaggaggcctcctttctgctctctgggggccacatactcctgcctcgatgggccacaactggatgaaggaggatacacgtgtgccttgctacacataatagctaaacagccctagaaaaacagggtctgtgtacatatcatcatgtcttcaggctacaaggaagcccgctgtgtgaaaaagctctcctgagctcaaataagaactactttctaaatatcaccttaatatatctggtaggtttggatttggtatgtcaagttgagtcctataatacatagactatttccttctggagaccgtatttttaatttcagcgacttggaggagttaaactcgacctctgggcacactgacagccaagtgggtcatcagcagaggagtgacaacgacacttccattcatgtagggcttccggtctacaggagggctttcatataagtgggctgagtgtatgggaagtgaactgattaggcatttgccccttgttatggatgaagcagcaaaggccgtgagagtccctgagggtcaagtcgctctgagatcctagagacgggagtcctgctctgcccagcatcctctcccctgcaccacagtacctgcatcccctccttttctgtgccgtctttattttacagtgtggatctggtgggctagggttcctctcctgttggtcctgatgatgcaccaagaccaagaatatttcttatttatggaggaaatatggttaagtgctaagtgtacagccctgacccttcctctaccctctcagcctagttacaccagggaggtaaatccctacctgtttgtctacctacttgtttatattaaaagttcttgcaaatttaaaaggttatacactcaatgatccaaaggtgaagttgagaagactataaaagaccttaggcaatatgaaattatacagtcagcttttcacgtgacggtggtgtgatcactaatggaatcaccgagtttccacagaatgaaaaggacccttgggatccggagctacagtttaagctggtccctctctggaggtgttgcgtagtaggcttctcctgtaacgtctacggctgacttatgacatttacatttttggtcctcaaggtcacagtgtccttctaagcggaacgatagtggagactgggaactaacttcttcatctcctctctttgacagcctgaactcagcttggcactggctttctatccaccttctgcccagcagtgaatggagtcaactctcccattaatggagcaccctctgggggaagggcactgtgttttctgctgagcgctaggaccttcacagtctccacagagcaacaaaccagaactcagcgagaagagcaatgccaaagaggaggcctagcgtgcagacacacatgagcctagagcagctgtgcccaccccatgcctctaccattgactcaatgaggacagctgtctttgagagtggtgacggtagggttctatagaagaagcaggtctgttaagcaatctgcgagatggccggcctcagaccaatcaaagtctaccattttgtcttatctatctagaaccataactcaaaaatgaaattgccccagcttttctcctcccaccattaaattccattcaatcatagcaggcaaaatgcagtcacgctcaagcagccagatgttatcattacagactgctctttataaacccatgctgaaacctgagtggttgatgagaccagctaagcagttgtacctttgacccaattgcattaaacttgccctatcaatttaagctcagtataaacaccatttcccagagcccctcgtgaagtcagcagtgagaagaagctgactaagcctaaacattttttaacagcaatcttgtcttacaacaccaaggggatttgctgggtatctggggctttataaaaccatatgaacatgctgaaagaattaaaatcctttaaaaatgaaaaattgatggtgacagtcctgtctgaagactaactggtctaatggcaacatggaatgggcacttttgtatttttttttcttttttttttggtctgagacacttttgtattgttttgtaagtaatatatttgtattatttttcttcttctcaaatgtttgccttaaggtggccattccaattttttttaaatgaaaaaaaatgtgccccacttatcagtaaattggacattttaagaggaattgaacatatttactgtcctggttaagtttctttctaatgaagactgggaccctctccgtattcaaacatttcagataataagatcacagttatctccacatcacatgcggctgacatcccgggagtctggcctatgcacaagtcccagggtgaatgaagggagtgatcgtacctggctattgatttgctaatatttcaataaaacttagatgttctataaaaatgtaagcatatatttgtctttgtaaataaatatacctcagtgtaaaggtatttcaaaagagaaggctgatcttagaggtgtttacttttttctttttttgctttgtataaaaagtttattcagttactttgtggctgagtttccaaataagtaggatactgttactttctgttaaaatgctaaaataggatactggagaacaaataaatgttgaagatttataaactcttttagaaatgacttcgtaatatatcttaataagataaaaaggcctttgaattataaactgtagattataaaaattaggtagaaaatgtaatattttaagacacactgggggccaggcgcaatggctcatgcctgtaatcccagcacttcaggagaccaaggcaggcggatcacctgaggtcagaagtttgagaccagcttggccaacatggtgaaaccccatttctactaaaaatacaaaaattagctgggtgtggtggtgcacgcctgtaatcccagctacttgggaggctgaggcagaactgcttgaccctgggagtcggagtttgcagtaagctgagaccgcactactgcactccagactgggcaacagagtaagactctgtctaaacaaacaaacaaacaaacaaaaaaaaccactgggaataaaaaggagccaaaacattaaaacagaacactctccattaaggggaagaaaacaatgctacgaatttagaaataaactttcttgaaatatgtgtaaagatgtataactagacaaagcaacacatcaggtaattctggccaaatcagagaagtaccaaggtatcagctcaggagaacagagccagtgagttgccaaagagacttttacactgaacttgacacaccctggaattagtgaagactcacagacctgaatggaatatatttctaacatatgtcagtactgttttcactagtgaagaactctctgcaacattaaaatctaataccaaggtctaaggaaactttgtcaaatgtcttgctgccctgattaaaagaattattataatttttctctggaaggaagagacagaagacattgatttcacacaataatggaaaaaagcgcaaagcagggttgggcaggctgggacaagggttggctatcatagtctggggtgctttttgggaatttcagcctttttggggcttagcctcctcagccaagcatgcacttcagaggagatggcctctggggttcattcaggctccactactctgagtctacactctggaggcacacatactctctgggatacacttcagaatcagtcatctctgaggttcttcccatttttaggattcaataaatgtatgaaacgtttgtttagagagaaaaacgcactttgtggatgacaccttcctatgtcatgtaaatagaaacacatattgcatgttttgccataaaaatgggggtgctgaaaatgagatcgtcatgtgctgagcacttcaccgcagctcaggcacctctgtgttcaaacaggggcttggcatcaagagctgtcaccagctgggtacagtggctcatgcctgtaatcccagcactttgggaggctgaggcaggcggatcacttgaggtcaggagttcaagaccagcctggccaacatggtgaaactccatctctactaaaaatacaaaaattagccaggtgtggtggcaggcgcctgtaatcaaagctactagtgaggctgaggcaggagaatcacttgaacctgggaggcggaggttggagtgagccgagatcgcgccactgcactccaacctgggtgaaaaagcgagacgagactccatctcaaaaaaaaaaaaaaaaaaaaaaagctgtcaccgccggtcccatgatggctgggtgaccggagaggtcacagggcttccttgggaatgcaggtggtcgggaggggctgggtgggctccataggaacatcttggtgtcacaaacgaggggagatcttgcacactgttttgaaacccatcacgtctcctggaagcctcaagtcagagcgctgcgcacgtgcaccgcactgccccaccccctcaactcctccctgtggcaccagcagctcggggacttctgcccagcagccttccgggacaagggggtgagagggtgtgaaatgactgtaatgaggaccacagacaagaagggatgcgctggttacaggtgttgcatacgactttcagaagtaatatttttcttgccctgatttgaaagagctacttcaaaatcaagtgtttctgggttttttttggttttttttttttttcacctgcactaaaaatgaggacagcattagacaaatcttttccacttaatgtaacacatgctggaatgtggaattttgtgtttttgaggactcatgaacggtaactaatgctgagtttttcttaattaatgagcagctcagatatgtaaaagaaattggcttatctacaccgggataagacagagaagaaaacactgatatgaaaagctagaatattttctaagtggctctgtaattaaaaagaacatttaaaatgaggaaaagttaatagacttccatgctctaaatatattcttcctaaggtaatagttcagtagtgctagagagaaagataaccatctcctcgtgccttttgtcttcagccatacttttagttttcattctgcattccatagttccaaacgttgaagtcatctgcaggtcaaaccatggcctcgggtaagtacctagtacgtttttaaaaaatgcatcttcattctgaaaacatgaaaactcttgctctgaggctggattcaatgaaccacacctcttacaagttgttcatagttccctgctcgcccggacttttgctcagagttttgctgtcacctcatggctgcagggctttttgaaattctagacaatgaagctcatttccatgttgctccccttgcagcgactgtgggggccttcagaaggcttgagcctacagactcaggcaaagatctgatggcagctcccctgcaaaccacagtaacccacgaaggccacagaacaatgtaactgctccaagtgtcaatcagcggcactgagcttagctttctcggcaacctgtgacctacaaagacgcctgcccttcagagtctggtggcggcttatcactctcaattaggagtttacagacacattcatgttggtgcatgtgttcaggaggctgcttctcactcgacgccctgtttagaggaagcagcgactgaagactgctcccctgctggggtgctctctgggaagccccacaatcttcagcaggttgaatgccttgcttttgggatcaagccaaaaacaacacccacccccacgcaccccaccacaaaaggctactctactaaagggcattattattttctgggtttacagtcacaatgtatataaatgtaaaccaccaagcaaatacgtagaaacacggaatcaacgatatcattctgagaatttgagaggaaagcattttgtccatccctaagtatgtataagatattaaggttggtgcaaaagtaatcttggtttttgccatacttttaattactttttttttttttttttgagacggaatctcactgtgtcgccaggctggagtgcagtggtgtgatcttggctcgctgcaacctctgccccccgggttcaactgattctcctgcctcagcctcccgaatagctgggattacaggtgtgcgccaccacacccggctaatttttgtatttttagtagagacagggtttcaccatgttggccaggatggccttgatctcccagcctcatgatctgcccaccttggcttcccaaattgctaggattacaggcgtgaaccaccgcgcctggcctatttttaattactttctgccattacttttagtggcaaaaattgtgattatttttgcatcaacccaataaatttcaaaatgacaaaactgcagatccagcaccacccacactgtcttattatatttctacaaaagagtgttttttcctggattagacaatgcccagtaatcaccaagacaactacatttgggtctggcttcagagacgacgactgtggagcatttgagacgtctgacaaacttgaggccattgctgcgccatgttttcccaaatgataaaggcagcacaagtgtccaagccgtgatgcgtgaatgagagtcaggatagacatggagtggaagaacagggaaggtcatagagaaaagtgggtagctatgatagaaggctgtccacaagccgctgattagggcctctctgtgtgtctgcaggcatgtgtaaacagagatcaagtgttttttgcagttcctgcaggagagtgatgattcttccaacaaaagtctctgaaatttcccgctctatgtctaacattctctgccactatttatgtctttcagattagtgtagaaaggagcatttcacaatgcctggtttccttaataagcaaaatctgatgctgggagataattctaagattggttaagaggattccaagaaatggcagactgcagagggttcacccgggagtacagagagaaaacctgtttcatcaccaccagactgggtacctttccagaaagtgaaaaccctcctgttcaaataggtttgccagagaatctaagcacctcaccaggcaatggaacagtggtgatgcaaaattctggggttaactgtgctctgtctgacgctgcattcttctgaccctttcttaggaaactgccctgagatgctagtcagatgctggagatgtcacagggctggaataaaggcattccctggtgtcctttctggatgtgacaaaagaaacatctaattgctggctgtgcactcccaccactcccagccgggcatttcagcgaggattgggaattgcgaagtctatactgtattttcaaacagcatgaaacaaacattgatcagccaacagcagctggcagcggatccagcaggcccaccagtggcttgaacttcagtgaaaagagatgaggtttaagatctcagagaggtctctccagtttcagacagtcaccaatgccagctctgttttctagtatctcaggctgtccagcctgctcatcctcagctgaccgatgcctgcacaacactgtggctgcttggttcaacaaattgcagggccaagtgatcaggggaccacatccattcccctccatcccactacttttttggcatgaggagactcagtttttttcaacttcgtgacttctcctcagttaggttaccaaagggctttttttttttttaaatagacttagtatttttagagcagttttagctttatagaaaaactacacagaaagtacagagagttctcacaggacctttcctccaccccactcttgcacaatttcccctattaacaatatatctcagagtgttatatttgttataactgatgaactgatattattattacctaaaatccatagatttttacattagggttcactccatggcatgagtctacagattttgacaaacgtataatgtcatgtatccaccattactatatcatatagaatagttctgctgccacaaaagccccctgtgctcttcctctatccctcccctggaccctgggcaaacactgatcttttaactctctccatagtttcgcctttcccagaatgtcatatagctggaatcatacagtactcagctttttcagactggcttctttcatttagcgacatacatttaaggttcctccatggcctttcatggcttgatagctcatttccttttatcactgaagagcattccattggatgaacgtaccagaagttgatccattagaaggatgtcttgcttgcttccagtttaggttgattattaataatgctgctataaacatctatgcgcaggtttttctgaggacatgttttcaacttaattgggtaaatacatagccgcgaggttgctgattgcgtagtgaaaccatcgtgctatttatgaaattgcaaacattcgtgcaaagtgtctaaaccttttgcattcccactagcaatgaacaagagttcctgctgctcctcctcctagtcagcatttgatgttagtattctaatgttttgccattctaataggattgtagtggtatctcatggttgttttagtttaaattccctagtgacgtatgacgctgagcatattttcatatgcttacttgccatctgtatatcttctttggtgaggtgtctattagctcatttttaaatcaggttgttcattttcttgtggttgagttttaagagttctttgtacattctagataatcagtcctttactgactatgtgtattgcaaagcttcttctcccagtcttgacttgtctacttgtcttttcacactcttaacagtgtctttcatggagcagaagtttttaatttttctgaagttccaactcatcaactctctctctctctcttttttttttttttttttttttttgacatagtcttgctctatcgcccaggctggagcgcagtgatgcattcacacggctcattgcagcctcaacctcccgggctcaagctattctcccacctcagtctcccaggtagctgggacacccagctaatttttttttttttttaatagagatggatttttaccatgttgcccaggctggtcttgaactcctgggctcaagcaatctgcctgccttggcctccaaaagtactggaattgcaggtgtgagccaacatggctggcccttcaaatagatcttacacataatttttagacttacaactatttcttttttgggggtgttaatgtaaattacattgttttaaatttctttctttttttcttttttgagacagagttttgctcttgttgcccaggctggagtgcaatgatgcgatctcggctcactgcaacctccacctcccaggttcaagcgattctcctgcctcagcctcccaagtagctgggattacaggtatgcaacaccacgcctggctaattttgtatttttagtagagacggagtttctccatgttggtcaggctggtctccaactcctgacctcaggtgatctgcctgcctcggcctcccaaagtgctgatacattgttttaaatttaaaattgcactcgttcgttgttagaatatggaaaaccaattgactgttgtatattaaacttgtatcgtgcaaccttgctataaattagttccaggatttttttttttttttggttgtttcttcgggattttctatatagaccattatgtcacttgtgaaagacaaagacagtgttatttcttccttcccaaatctgcaagccttttattccttttcttacattattgtattagaaagggcttccagtgcaacactgaatcatggtggtggaagaagggacatccttaccttgttcctgatcttgggggaaagcatctagtttctcaccatcaagtataatgttagctggctgggtgcggtggctcatgcctgtaatcccagcactttgggaggccgaggcgggtggatcacgaagtcaggagattgagaccatcctggctaacacagtgaaaccccatctctactaaaaatataaaaaaattagccgggtgtgatggcaggtgcctgtagtcccagctactcgggaagctgaggcaggagaatggcgtgaactcgggaggtggaggttgcagtgagccgagatcacgccactgcactccaacctgggccacacagtgagactctgtctcaaaaaaaaaaaaaatgataaaggggatatcaccaccgattccacagaaatacaaactaccatcagagaatactataaacacctctacacaaataaactagaaaatctagaagaaatggatacattcttggacacatacaccctctcaagactaaaccaagaagaagttatttggaaaaccccattgtctcagcccaaaatctcctcaagctgataagcaactgcagcaaagtctcaggatacaaaatcaatgtgcaaaaatcacaagcattcttatacaccaataacagacaaacagagagccaaatcatgagtgaactcccattcacaattgcttcaaagagaataaaatacttaggaatccaacttacaaggaatgtgaaggacctcttcaaggagaactacaaaccactgctcagcaaaataaaagaggacacaaacaaatggaagaacattccatgctcatggataggaagaatcaatatcgtgaaaatggccacactgcccaaggtaatttatagattcaatgccatccccatcaagctaccaatgactttcttcatagaattggaaaaaactactttaaacttcatatggaaccaaaaaagagcccgcattgctaagacaatcctaagcaaaaagaacaaagctggaggcatcacactacctgacttcaaactatactgcaaggctacagtaaccaaaacagcatgctactggtaccaaaacagagatatagaccaatggaacagaatagagtccctgaaataataccacacatctacaaccatctgatctttgacaaacctgacaaaaacaagaaatggggaaaggattccctatttaataaacggtgctgggaaaactggctagccatatgtagaaagctgaaactggatcccttccttacatcttatagaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaatagacaaatgggatctaattaaacgaaagagcttctgcacagcaaaagaaactaacagagtgaacaggcaacccacagaatgggagaaaatgtttgcaatctacccatctgacaaagggctaatatacagaatctacaaagaacttaaacaaatttacaagaaaaaatcaaacaaccctatcaaaaagtgggcaaaggatacgaacagacacttctcaaaagaagatatttatgcagccgacagacacatgaaaaaatgctcatcatcactggccatcagagaaatgcaaatcaaaaccacaatgagataccatctcacaccagttaggatggcgatcattaaaaagtcaggaaacaacaggtctggagaggatgtgctggagaggatgtggagaaataggatgtggagaaatacactgttggtgggactgtaaactagttcaaccattgtggaagacagtgtggcgattcctcagggatctagaactagaaataccatttgacccagccatcccattactgggcatatacccacaggattataaatcatgctgctataaagacacatgcacacgtatgtttattgtggcactattcacaatagcaaagacttggaaccaacccaaatgtccatcaatgatagactggattaagaaaatgtggcacatatacatcatggaatactttgcagccataaaaaaggatgagttcatgtcttttgcagggacatggatgaagctggaaaccatcattctgagcaaacgatcgcaaggacagaaaaccaagcaccgcatgttctcactcataggtgggaattgaacaatgagaacacttggacacagggtgcggaacatcacacaccggtacctgtcgtggggtggggggaggggggagggatagcattaggagatatacctaatgtaaatgacgcgttaatgggtacaacacaccaacatggcacatgtctacatatgtaacaaacctgcacgttgtacacatgcaccctagaacttaaagtataataaaaaaataaataaaaacatttgaataaaaaaattcctttgttagccttctcatatcgatgggattaatagtgatggaacttctttaactttttatatttgtaatttcctgttttcatttttattaattgctgctctggtttttattagcttgagagatcaaaaactcttggtggccagccttaggagggaccccacaacttgcgtgagttttaccccttagtaggttctcaaggcgaagatcaggaaaaaatcccctgtgcttctggcaggaggaggagaaaagtaaccattttgaaatatacccagaggactctgttctccctaacaaaggtctcccctcaagctagtccacaccgcgtctgtagcccttagtcaatcaccctcccaatgttcccacccaatgctggctccagtggcagctgctgctcctggcaagctctgattctttgtatccatcgatctctcagatttgagcagcctggttccctggtgaccttgattcactaaaggaaccaggaagagctgctgattttcagtgtgtttggctttcttcttgttgtgggggctgagtgacaacttccttgctccttacaagttgggctggaatcagaagtgagttcaatggacttttatttttttttttctcctcaactaaatgcaactcagatcaacatggaaaggtaacacgtaaagcagggacagtggcaaaaaccagacaggatgccgggaagaatattttaacttaagattcagtcagagataaaagattaaaataaactttgtaattatctttccacatgacacatttataaattcctgtaatttcctgtgccaaaatatattttcaggcatctcttttgatcatttaaacttatttttaaaagctttacatatttccttttacacaagtaatggaacacagaccagtcagctgtattgctaaacattacaaggatattattacttgttttaaacaagtacctgccatagcacattctgatatctggaatatgattctgacagcaaagcaaactgactaaatgagtcccatttactgaaacgacactagacaaaactgcttctcagatttatgtagctccaaacatgtgcatgcgtacagagtcctctctctccgcacacacacagttgttacgcacacaatggaagacatcactgtgcttgtgaaacctgtgttgagagcagacagatggcggttatcaaatactttggcactcatacacaggagacagttacatctcagaggagtgtaacttgtgtgaaggctaacgctggcactggatccaaacctgtgcaaatagccctgtgacaccctcttctactgaaatatatgaattgttttaggccatcggggtgggctgggaaagagttttaaaatataaatagagaccaggacaatgactatatttatttagaggtgacaacatccttaaataatttaggtcagctgacgcaagcgctgagaagctgaacaactggcatggtgctctatcttcactgccaggccaggcaagggggccccagctaatgctgctccgtgctgatctgctctctgctcctcatacctgttggtatcgaccttgtaagaaggttcagatccatgagtggcccgtgatgactgaacactaaatggatgttgggagaagctcatctctctgtggatgctctctactcacgcaggccacctcgaaggagaagtctgattactgcaagttgttacagttcagtgtatacgatattttgataatacacagagagtgtttcattgcagtcaaataatatcttgagctctcacaacagcaaacttcaggaacttcaaaggaattccagtccaactggaaccgtcattacaaaacaaatcttagctttattgttagccagaccacaaaggggcagagactgtgccaaagtaaatgctcttgagatctctatatattacctttgaacaattaattggtctcctggagacaaggaaaaaaaaggaaagaaaacaaaataaaagattgacaatgaaatatattgttcttggatgtcacagcctggataagccatagccacattgaacaaatacctgccaaattgatcattaatttcaactagtctgtaatttcacacattaggctaagtcttgtacactgaaattacgcgcactttgtagatgatattttcagctggtcacaaagaggaaattctactgcctaagaaaataggcatccagatattcaaagaccgggcctcagaggtgaacttcacttatatgaggcatttctctgtgctaccatgaattcttgatgtgcgcccttcatccacctgcttcctcgtggcaccttccaaaccatccagacatgactctaagtcatcaggttaatgaacaggacaggcagagagctgagtggcagtaaataaacagggcctgacccctatcagaatttaaatgttttgggatcctgaccccaactatcagcatttgccaacattgctagttctcctcttatacctctgccttccaaagtaccacaccaatgagggtgcaggccaggtgttagttctgatccggcaccgtgacctgacttctcacacggaaagcagcgtggaccttctggcctccctcccttgggcgcccggccaggacacgcaaggtcatactgctgaggccctttgagatcctcgagttaaaggggcccataaaggcaaagtgtcatgaacggcgtatgttccaggtgcatcacttgagccgccagagccacataatggtttgcctggtaagtgcctttgcccagcatgtgcccattgaacaaaccacaaaaagatgactgcaaaggggtcttcttataatagggcctggtgcctggtggatgcccagagcccttgccatttctgaaatggacataagtgacctaaaaggcagcttttcatgacaggttaccctggatgatgtttcctaaagaaaagtcacatcagtgggtgagacagaatgtaacaactagtctgttctctctcaccgttcacatttactgttgcctcctcggcagggaggataaaaagaaagaagtaacacaaatatactctcacatacatcgaatatacatacacatgctcacacatacacacacaagtgcacaacacactcatacacatacgtacacctacaaatacacacacttacagatacacacacctatatacacacacacacacctcccccaccgagaggcgatgagcacagggcatgtgccaatgcagaagaggactgtgtctacacacctgcctcctcacagtgtcctgccaccctgccgccaagacacgctggtacttgttgggctgtgataaaagcttctgcttggctgccatgggtgacatcttactacagattctgttacatggtgggatatgtcactgcattttcaatctgctgtgttctagcatctacagtcccaaaatggctcaagaagaaagtggtcctacagaggtcagaatctgaggttgtaagaaattatgaaagctctgccattcaggacaagatggaaatcagtgtggctccaggtgaggaggaccaggcggtagacccaggcgcacagtgggaacagtctacgactgccagggaaggcctccggtggagagtggcatccgccagctccctggcagccccaggcagagaggccaggggatctcaccagcaacccccaccataaagtgctggaaggtgctaaagagaatgccgtgaatctgattttcaaaacaccactcagtgtgtctgtgcagaaatgcactaaggctggagtgcagtggcacgatcacagctcactgcagttttgacctccctgcacgctggtgatcctcccatttcagcctcctgagtagatgggactataggcacgcaccacagtgtgcggctaatttttgtatttcttatagagacaaggtcttgctatgttgcccaggctggtctcaattcttgggctcaagtgattcatctgccttcgcctcccaaagtgttgggattacaggcgtgaaccactgtgcctggctttttttttttcttaatatggaaagatatgagatttagatttagaagacctggctccacggtatggccccttcacttacaagtctcctggccttcagtattgcgtatgtctaggtttatgaaatgccttttcctcccaaaactttgatgtttgttaaatacctatgttttaccttcccaagtaatgcaattatgagtaatttcatgatatgtctttattttattctataatttattttatgacaaatacaaaggaaggagtaaaaggaatctatgtcccaaaagataggtacacttcataacaccttcagacagaaagaggcagcagtgtctgagcccaaacgagctcctctgccaacccccgcctcctcaggcctccactgctaccaagctcagcctcactgctggcatttctggtcagcccacatgaaagagattgaggcttgtgccctctggccatgctggtgccattgccactgggaggaccggggactctgtgtgcccactaggccaggcaggcgggcaggccagtcagtgaggaatctgccccagtgctgatggcctttcatttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcatttttttagaaagggaaatctggatatttgggtgaaatttactgacattttaattcaattaaagaaagcacttctattggcctagttggtcctagaagcccccaatataagacccgtggctgggtcatggagacggggtaaaaccacgcacgtgggtgagcacgtgggagtctcactatgccgacgtcgacatcctgtctctttgggactggctcctacagcacacattttactccagggatggctctaggtttcttttgtttgttttttgagtcagagtcttgctctgttgcccaggctggagtgcagtggtgcaatctcggctcactgcaagctctgcctcccgggttcacaccattctcctgcctcagcctcccgagtagctgggactacaggcgcccgccaccacgcccggctagttttttgtatttttagtagagaccgggtttcaccgtgttagccaggatggtctccatctcctgacctcgtgatttgtccgcctcggcctcccaaagtgctgggattacaggcgtgagccaccgcgcgcggcctggatggctctagttttaaaggtcttaggatatctgcctcaagccctgtcataatggagaaattattttaacccaagaaactctggtgggaaacatgtgagagggccaggaatcccgggtctgatgcaccatcttctcccacctttagcaaataggatgtgaccactgccctcatggctttcaaggatgaggatcggttattacatagaaatgacacgatacacgcatttgggggaaaaacctttagacatgagaggtgcttttgtctcacttgtgtttttcctaaacttgatttttagttagtttagaaagttcccttggacacgttcaacttttcataactcgtgagatgaagtagtaggctcttggcttctgacattcaggtaatcacactgcacctgtcctaatgtcctctaggttatgaacagaagtttttctaagttgaggcataacacattttatactgtaatagaaagagggtgggttttgcgatcggtaggcctggatccgccctctatcagctatgagggtggggtttgccatcggtaggcctggatccgccctctatcagctatgagggtgggttttgccatcgggaggcctggatccgccctctatcagctatgagggtgggttttgccatcagtagacctggatccgccctctatcagctattttttttgtattttacaccactcactctcttcaggcctcagcttcctccttggtgaagtgggagtcacagaagtagtgacttcaccgtgctgtgtgagcatccgctgaagtcgtatggaaacaccaggatgtggggcggctggaagtctcccgtgttgctggtgggaatgcaacagggcagagcggttgtggaaaacagcctgagcctggccacagacatacttcccagatgaaccgtgggctcactcaaacgtatgtaaccagagcaataaaaacacatgtccacacaaaccaggaatgcaaatgttcacagcagcaacattcgtatcatccccaaaggaaacaacccaaatgagcttcaggtgaacggctgtgcggcaatgcatccacacgaacgaagactatgaaatgaatgaaaaggaacgaacagacacaccggggaacatggtaaatctcaatgacattgtgccaggtaaaggaaggccagcacaaaagacacatactgaaggattccatttacacaacattctaaacttacagtgaccagaaaaggggcggtgttgggggcaggactgactacaaagcaggaggagcgagctttttgctggggctggagatggtcctgtcttggctgtggtgatggttacacaactgtatatggccaaaactcatcaaatgtacacccttagtgggtgatttttattttaaataaattatacctcattaaagctgggggttaaaccgagtccagcacctggcaccaagtaaatatacacagtaaattattcatcctcttcctgttagttgccatttagaattatcaacctgtgcctgccactgaagccacaatgatgtcaggcttaagtgttgcttttctccttcaaatactatgacacaaaactgctccctctctcccccccctttttttttaactacttacccaccttaaaaaaaaggtagacttaattaacacttgtaaagcaccttgagacacttgaattaaaaagtaatagaggaggctgagtgcggtggctcatgcctgtaatcctagcactttgggaggccgaggtgggcagatcacttgaggtcaagagttcgagatcagcctggtcaacatggtgagacccccgtctctactataaacagcaaaaaaattagcccagtgtggtggtacatgcctgtaatccaagctacttgggaggctgaggccggagccgagatcacgccactgcactccagcctgggtgacagagcgagactccatctcaaaaacaaaaaacaacaaacaaacaaagtaatagaggagtatctggcactgctattgctcttctgttttcaatgatgcaaacagtatagctctttgtttgctaagcgactttagtaagggtttttttttaattaaaaaaaactgtttaatctgaaaatgaaattcaaaggcctgctgacaatatattcctcgtctccattcatgccaacaatgactatgccagcgtttgcagatttatgcccatggattcccagattgggagacaggaaatgggtgtccatcctcccccacctgcagttccaagctggccgcacagagcacagggaggttggttgctcagaacgtggccataacatttaccaggaaaaacggagtgaagaggaaggatgggaaggaatggaggggcacaggatggagattttcccaatcaagttggggaaaagtatggctgtttcactcagcatttctctgcttcactaattaaaaatgattttaagagctaacaattgcaaaaatcttcttaagcttatcagtgaattcctgaatatcccctggtgaagtcttcctttggcatagacgtgcatgcccgaatcttaatttctctctagcattctgggtgatcatgccataaagcacaggccgtggagtcattttctgagacaagaagtcgctccacattgggctttctggctggttctttttggccgtgggtctggttacagtggtggcagaagaagcgaagtctgtagccctcattacagaccctttgctggctgggggcatgtggctgtgagagaggagcagaactgaagccagtttctcctgctctgcactctgaaacccgagatgacgcggcctctttcccgcacaacagtgtagagcgttcagttggtgttatgacttgtctggttcccacagaggaaggaatcctgccaaatatttgtaatctgcacttaagtatgcaatcagggaaaccacacccagaagcaagtgcatggctacataattaaaatggtcttgctggaagaccaactggaaatggttggagagggtgtggggggaagctgatgagtgagtgtcactgggatctctgacactttggccatcattctctgcaaaacattttctccttagactctagcaagcacgcatctttctctgtgtccactgattagtcacagtatttgtctttgtataaccatttaagaaaatatttgcatctatttaaaggatctaaatagatcccccccgggttggcttgtatttatggcataagccataatggaatgtacttatatgcaaaccatctttccctctgagtaaagcattttggcacattttctatgacagcactgagtcacagtgcacagtacattaacgcagcaacttctgaaattgagctgcccaggttgcagggctggcaatgctttataaaagggttaaaaccattcactctgaggtactggtaagataaaggactaaacaaactaatgtgttatccttggaggcaatacaatttttttaaatgaaattactgaaattagtaaggattaaatttaatttttatagtcagataatagctaccagcagcgccatctgttgaaatattccaaaacttcatttcctgcatcccaaataatatttacttaaaggaagatacaaatgtttaaaatcacaagtaggactggaactccatcctcagttttaggcaaaatcacaactataatattttccaggacaagaggcgccaccccgtttgtcaggccccagagatgtccttacctacatcagtaaccccttcaaggttcacgaaccttctcactgacaaaaaactcccataacagaaacgaaagagctcctgttcaactacagcaacacccccaaggcttgaacatcaggaaggacgtgaacagcacctgctacctagactctcccgcacttcacgggctggttgggtttcagacctggaagtggcgcaggcctccaacctccaggggaggaggatgaggccaatgttctaggtcaaggtcttgcctaagatcagacaggtggtaggtatcaaggtcaggagctgcattcaggccccaggtgttctgaatttcagcccagaacgcttcccattggattccagggccaatactaactcctccactcagcaggccatcagcaagctcctgtgttccaggcaccgtccttctcctgtgttccaggcaccgtccttgacactagggagagagttgccagcacaatggacagggcccttagccatgcagcttccattctagcgggaggagagacacaaagaggcaggtgaagaacgtgaggggggttcagagaagccacggaggcttctctgatgcagagactgaaagagtgtggggagcagtcctgccctctaactttctgggggaggagcaggtgtcagtgccccaaggtgaagctgaagggtcagtgtggttggagagagggcatgggggtaagagggcaggagctaagcggggtgaggttggggcggggcaggtcatggagaacactgtaagctgcgggaaggacctggaattccactgagagagctgtaaagccacaggtgggttctgaatgagaggtaatgtggtctcacttacgtaaaaagtgccactatcttcacaatgggctgtaggagggcaagaatggaggccgtgaggctcttaaatccacagcagagaggatggcggctttgtttagcggggcttgggaggctggtgagacacagctggattctgggttgatttccgaaggagagtgagtgaaccgttcgctgatggataagttgtggggtgtgagagagggaggggagtcaatgttgactctgatgctttggggtttcagcaaaaagaataccagcatttgctgagcacctactaagtgtcaagcatattttctctaccagtctcagaaactctcaagtgtgggcatttgcccccattacacagatgaacgacggctcgtggaaaccccgcaccttgctatggtcacgcacgtggagcgtgctgtgtggaatacaagctggtctacctctttttcttcctcctacttggatctgcttccagcaatcaagcaactccagttccctccaccttctaaagtttgtgtgtgtttctacattacatcctctccgtgattctcctctgaaacctctccacgctcttcaaagcatatatttagctattgagtcacaaatccactgcagctctcatgaggtctttatcttaaataccagccaaaaagaaagaatttgcctggggacttaatactcccatgtagagtttaatttatgttaaacgtatttctgtaatggtcttcattagaggcaccaagatgggatacagtagctattatataaagatagccagctaacacttgtgaggtatatgcagattttgggggtactgccttttccaattgacagcatctgtttgaggaatgtgagtttattttatttttttaaagtcagctctctacatattcctgcaagttttggaagggaaataaatgatagcacttcaacatcagccattttccctaaaaatcacttaaaactgacattagagaatgcagatgtggatgatcattactgtagaggttactttcttataacatgttcttgctatgagggttgcattgaaaaatgaggctctgaaacgataacctttgggccataataagcaccagtgaccttttacatggacagacacaaagttatttttattaaatcaagctgaggttgtggttgtgtcagatatatatttttaaccatggtagagttgcaggaggaatggcctgtgtgggattccatacttcaaacttggtagaatacagttagggaaggattctgcaaccacttctctcttcctcttcatcggactgctccacacccaatactgcaaacatgagtcaagagagcccataaaattacccaagtgtaggcctacctcacaatgaatacttgaaagctttcactagcattataaagtaacttttcattctttgaatgatctgtctcatgagtaatgtcatctagcaatgtagcaaggtaggacactccccctgaataacaagcagtgtggaactgaaatagagatataatgttagaaatgacaccacctctttgaatcagatacatttgtatcttctggtataagacaatggatattaggagtaaatatgttcctggcaaccctaagtaaacttgaaaattcagggttgagcccatccctcactgacacacaaatctccttcttattgcttttctgtcctgcaactatttatcttcccaggatttttgtccaacaacattgtctacaattctaattcaacggtcaccttggcaaaggattaatatactgtaatgtctagcaaatgatcacctcataaacgtcttctgaaaaattgtaataaagtgaagacgcgtgatttccttaggtcaagaggagcatacctggattaatcataaatgagtattcacactggcttacaacagcatagaaaacaagttgaaatatatgtagataacataaagcatgaccactgattaataagattgcttttattaatcaaaataaaactgggtacccatctgtaatcccacctactagggaggctaaggcaggagaatctcttgaacccgggaggcagaggctgtagtgaaccgagatcgcatcactgcactccagcctgggagacagagtaagaccttgtctcaagaataacaataacaaacaaaccaacccacaaaaaactgggcacccatttacatatacaaataatttgagcatcatttgttttaaagaaaacatcttttgctgtgcaaaagctctttagtttaattagatcccatttgtcaatttttgcttttgttgcaactgcttttgacgtttttgtcatgaaatctttgcccgtgcctatgtatggtattgcctagattttcttctagggttttatagttcgagattttacatttaagtctttaatccatcttgagttaatttctgtgtaaggtataaggaaggggtcaagtttcaattttttgcatatagctagccagttctcccaatactttatgaaatagggaatccttcccccattgtttgtttttgtcaggtctgttgaagatcagacggttgtagacgtgcagtcttattcctgagtccccatcagagtgaacagacaacctacggaatgggagaaaagttttgcaatctatccatctgacaaaggtctaatatgcagagtctacacggaacctaaacaaatttacaagaaaaaaaccaaacaactccattaaaaagtgggcaaaggacacaaacacacacttctcaaaagaagacatttatgcagccaacaaacatataaaaagaagctcaacatcgctgatcattagtgaaatgcaaatcaaaaccacagtgagataccatctcaaaccagtcagaatggtgattattaaagtcaagaaaccacagatgttggcaaggctgtggagagatagggacgcttttacactgttggtgggaatgtaaattagttcaaccattgtggatgacagtgtggcaatttctcaaagacctagaggaagaaatagcatttgacccagcaatccaattactgggtatatacccaaaggaacataaaccattctattataaaaatatatgcacacatatgttcattgcagtgctagtcacaatagcaaagacatggactcaacccaaatgctaatcaatgatagactggataaagaaaatgtagtacatatataccatggaatactacgaaaacataaaaaggaatgagttcatgtcctttgcagggacatcgatgaagctggaagccattaccctcagcaaactaatgcaggaacagaaaaccaaacaccacatgttctcactcgtaagtgggagctgaacaatgagaacacatggacacggggaggggcacacacactggggcctgttgcggggggtgtgggggagggagagcatcaggaaaaatagctaatgcatgctggccttaatacttaggtgatgggttgacaggtgcagcaaaccaccatggcatacgttcacctaagtaacaaacctgcacatcctgcacatggtccccggaatttaaaataaaataaaaataaaaataaagtgatcttagaagtctactattacctataccagtcttggttcaaaatacgtcttaagtgtccctttgggaactgccttaacagtgggtctacaaggcacattagaaaagcagttttatatggtatagttacagtgttctaaaatttattttgccctaacagctttattaaggtatataattaacatacaataaagagatggcatcctatctgtgctcctatgtaaacatatcatgtcctttttctctggctacctttaacatttttgtttatcactggttttgtgctgtatgattatgaaggacctcagtgcagtttttttcatgtttcttttgttgggatttgtggtggttaatactgaatgtcaacttgactggattgaaggatgcaaagtattgttcctgggtgtgtctgtgagggagttgccaaaggagatcaacatttgagtccgtggactgggagaagcagacccaccctcagtctgggtggtcagcatctaatcagctgccagtgtaaaagcagacatgggaagggcagacttgctgagccttctggcctccatcttcctcccatgctagatgcttcctgccctggaacatcagactccaagttcttcagcttttgaactcttggacttatactagtgatttgccaggggctcttgggccttcggccacagactgaaggctgcactataggcttccctgcttttaaggttttgggactcggactggcttcctggttcctcggcttgcagacagcctatggtgggacttcaccctgtgaccatgtgagtcagttctcctaataaactacccttcatatattcatctatcctattagttctgtccctctagagaatgctgactaatacagggtttgttgagcttcttggatatttgtgttcgtagttttcatgaaatttggaaaaaaatgtttagcattatttcttcaaatatcttttctgtcctcccctcctttttggggactccaattacacacatacattagggcattggaagttgtcctccagaactgattctctgttaatttttttaaaattctgtttttctgtttcatattacatagtccctattgctacgtcttcaagttcactaatcttttcttttacaatgtctaatacgccattaattatgtcaatgtaattttcatgacagacattatagatttcatctttaagttcaatctgagtgtcttctttatatcttccttctacttaactttcttaacatacagaataaggttctaaaaattagtttaacatctctactgctaattctaacatctgcatcagttctgggttgattttgattggttctttttctcttgtttaggggatatattttcctgcttctttgcaagcttggtaattttttattggatgccattaattgtgaaatttatcttctggggcagtagatatttttgtattcctgtacatactcttgaacttcgtttctgggacccagttatgttacttggaagcagcggtacttttggctcctcctttcgtgatttgttaggcaggtctggagcagccagtgccccttctaagaggcaagacccttccgaacaccctaccaatgccctgtggattttaatcttttccagtctggctggtggaaacaggccaccttcccagccctgtgtgaacattcagtactgttccctctaatccttttggatggttgttccccagccttaggtagtttcctcctgtgctgatcagcactgccctgactgctccaggggcacctctgcagatctctggagcaatcactgcaattctcctcacctctgccctgcgttctcttaccagtccggctgccctgaactctgtcctctaagcttagggaacttgctgggctctgcccgaatcctgtccccatgcctcatcctgttcagtctcccagcagtgagctagggtactcgaagggctcacctcatttgtttcctgtatctcagaggttactgtcctccgttgcctgacatccagtgtgtactaaaaaacatatttccatatatttttgttgttgttgttgttgttttgtcttttgggcaggagggcaaatctgtccctgtcactccatcttggctggaagtggctgtcttaatgctagtgtttagtatcactcaatgcggccatcaacttggcaagggttgactttggattactttttcttatttcaggaaaataaaatggcaaagataaagttctgttactagcaagcacagttactagtttgttttctctgttatcatttactgagcacgtgctatgtaccctccaagtaggctgtgctttatgtacatttttcttattttaatctaacaaacttataaaacaaatactatgagttttattttatataagaggaaactggaacttagagagtcaaataacttgcccaaggttatacaactagcaggtgacagggctgagttgaaaacaagtttctccaattccaaagactgtttttattcactgcagttctgaaggcactaaagagaagatcctgggcccccaaagtgtgtttgaacaatggtagcattgttaaaatacataattctctgatgacttgacaaagcataatgatgccaattactctcttttactgattctactatgctacggattgtaagaggtactattattttatctgtccgtaagaaggaaaaaaatctacccattaaaccacagcatagtgttttagatgccgttaattttagggtggatctcaattttagcattgttaaaaaagaaacaatatgcatattaaaatcaataaaatgatacagtatcatgtactgggtactactgttgcttttgattctttcaacaaccctaaaaggtagtcattgtggtatgcatttacagaagtagaaactgaggctcaggctcaagggtaggtgacatgtctaaggtcacactgcagtaaatggcagtgccagacttttgctacttcttatatgcttgtcaaaaaaatcagtcctattaaaatcaaacatatgcttttaatggcatgtcaagcccatgtgtgtatacacacacgtctgcacacatgtatatgcctaggtgctccctaggagttatatttgctttagtagcatagcaagaggtggaaataggataaatgagtgtgttggcagaatgacatttctcatctgcccacaatctagtgaataaacaattacgtcgtgaaggttacataaacttagaaaaagcttatagtatttattgcagcaataaccaaattttaaactaggacatacacctgtccaaatgaaaagtacctattacttttatagattcctacctagttttgtgcagtaagacccagagccaaccctgctttggaaggtgtttgtctaacgttctttgagtaaggaatgcttcctcacaataccacagaggagggtgccatttcaagtagaatttctttgttttcttgttaattctgtatctcttcagtgtaaaacacagagaacagagtcatatttctttctatgagcaaattaaaaaaaaataacaaacttccctgaggataaaagtgtgaggacggtcatttacttggattgacaaatgcagcccatgacggggtccaggaaagctcgtctgcacaatataccaccagttcactaggtgacgtggagaatcctgaagagtctggctactgtttaagatcctcatttctgatatgagttagaaatctccacagtgagtgaatcttaaatttggagtcttctgtaaaaactgaaccaatgaatagcattgaaacggtagaatgaaattcaactacctttgaggcctcacatcagtaatcccctctacaaaatcatagttatcttaatgcaaagactgctgtaatcctggccttgcaatgcactatttttcatctgaatggttcaactgtgtgtcctatttcagaagaggaaggggtgacagtgacatacagggcacagattttctgtatgttatattggtaatcatagagggctctctcatgcagcagtagataacgtctaacagccagttctttctcaacatcagcatcagcatgtggccatgacaaatgaagtctggaagtagctcttggcagaatccttaaggctgcaacagaagatgtgtgcttttccctgcaaggcccctgtgtgcagggaccctgccctgtcactctgaggtcctggcaccgcctcttcagagtcccacgtgttcttttccaggctcaaacttaagagcctggtttccagtgacttggccctgagaacaaacagtgctgagatgaagcctgtggctccatgagcaagctgaacgtggccagaaggcaatcacaacattcttttctgtcttggtttttttttttttttctttttttttttttttaattttagctttgatgacaaaaacaatgctggaggagagtgagagcaccaagttgaacccacgtggaccagctttgacgatgaagctacaggcagccaagtcaactcacacatagagaaagtggaaaaagaacagaaaagcaggagacagaaacaaaaacatgcaggagagggtgattctgttccatgatcttggctcagtgctccagggttcctaatgtttcagcaaaaagaaaatcactgtaatgaaatgtaatgagaccctttgacactgaggaagtgacaactcaggcttggccttctaccacacacctataatctgtgacttgcaacagaacttttcccgaagagcgcagtcctccctgagcaaaatggctagggcctacgccgtgatttgctgctctggaatgggacacacatgttgctaatccttgcaaaaccagctgaagaaccattttcctcctgagaattttcttctgttcactgctaattttggctactttagttgctttgtttctcctccacttaagtaaatattcctcgagttgatgtgccaaacctctcttttggaataacagaaggtttaacacatatatgctcacagggacagcgctttcacacgttactgacagcttcatagacatcatttctatttctcctcaagacaagctaaggcagaaggtaaggcagacattatgatgtccatttcacagatgcggaaagtgaggctcagaggggttaaaagatgacctgatacaagtcatagagccggtatctggaagaagcaggagcaaagtccaggcatcctgatccaagctaggtccactgccttccactctggagaggcttcatctccaacagaggaagggacgtgagtggctggaaaatctcatggatgaagagcctcagatttcatgctccttggagtcacatggtaaaacaacaagtgtttggcctgtggttctgtcacttttaccatctgtgaccctggggtaaataatggcatctttaagcatttgtttttgaaagatggaaatgatgataattagctgattgggctgcagtgagaagaaaacaggctggtacatggatgatgcagagaagtatgtctgtcacaccgtaggagcccaacagcccatgcgttacttcagacaatggcagctgtttggctgtgtgagcccaaatgccataagtgggcatgtttaaggtggatgtgattcctacgtatgcctcctgaggaacaattaacatccctaaagattgttgcagtgcgttgacggcaggtgtcccccaaactctaagtgtcctgtggaacctggggcaacacactcacagcctttcccacagggcttcctccgagccagataccagcaatgtagacaaagcatttgggaagttggatcaatagtgaaggtggccaattcatcccaggttgcccaggactttctcattttcagcaagaataatcctgtgccccagggcaaactgggacagctggtcaccctgtcaatcatagagtctaggctggtaacaaaattaaaaagctagaaacctatttcttataggctattccttaatagaaaacaatgcaaaaaccttggcgcgctgcagcctcatgttctgaaccaatggttctcaaagtatggtccccaaaccaggccagcagcatcagcgtcacatgagaacttgttagaaaaacaaatttggggcaccatgcacacctcacgagtcagaaactgtgggaatcaggcctaggaatctgggtttgaatgagccttctgggtgtttctgatgcttgtgcaagtctgagaaccactggtccagaccataagtagaagtcagactagatgccaaggagaactaaaacaatgcaagctcacgagaggaagctttcttcctttgtcatgatccctccattttggattgctcaaactgaacggggaaaatatgatggaagcacttcctgctctcttgttccatgggaatccagtatggctgcggacgatcaaggttaaagtatctccgtaaagtaacacactgacaagaaaggcacctttaggggagtcaagcatatcatttcatctgtggccacatgtgaatgctagctatgtatatgttctaaaaagcaaagagtagacaaagaggagcgccgcccagcctcccaacaccagagtctcacttcctctcctcagctggcgctctggggccggactccagtaataacagcctcctggggagattaaagccctggcaagcacagtttatcttggtgaatgtatactttagctttgtgtgtatctacacatatacatacactgcagtatttatagctggtatacatgtgaggtagcgctggagacaaggcctggaatgggtgtacaacacctatgaggttggaaccaagatcttttaaacgcaaacctggtttccctgaactgtcctccacccgtgtggtccaaacacacactcaggtgtttcgggaagaacatcctccctccctgcaaataggggcagcagtctttcttctgtttccagaaagagttgagtattttgtggtggcttctttcatctctggggactttgcttattagaaaaatacacagaatcaccgctctcccgagtaaggaaatgagatggccgggaggtgagctgagtcaggaccgctgctttaagccaagtctacagggttggtattgaggtggagacgcttctcagagtgcagcacagcccactctgagaagggcaggcatgggggccatccggccccagtgcccacgtgtgcgcgaccctggacagagggcggcctccagtggcagtgctgctctgtggcacactgaggcctggtttcccttttttttttttttttttggtgggggcacatatttcctcaggaaggagcagataagttcctccttaggcttgtgaatactttcttgtcacctggccaaatggaattccaacgatattgtgaagaggcagtgccacttcacagcagacactcacaacaagccacagtcatggggtggtcaaaactcccaatctccattttcatgcaaagctgaatgggcagctcagacctttaaaaagtgtcatgaacacataggtcctcttagtctctgtctacttgacaagatctcttagtgtccatgtgtgatagaacagcacatgcctacactgtgtggagtgaggggctgccagagccacacggtgtagccttctgtcccccatggaggcatgggtgagaggagagacacaagacagagaggaagactgcacatcaggctgcggaaatgagcttgagggtttatgttttgaggttgcaaagaaaagaagaaaaataaggaagatgggggtggggagaaagaacaagctgggtgaggggaggaggagggatgtacaggagatggcctgaggcagccaggaggggtctccaggagggcctaactgtggaggttgctgagaggctagaggggagaggctggagccagtccagcctaacacattaacgcaggtgtaggggtttaaaacaatacgtgtcgatcctcttacgttcttggtgtgggcagggctggctgcctctagaggctcccggaaagaacccgttcccttgccttgtccagcttctagaggcgcctacaccccttggctcgcagccccttccttgaatcaccctgaccccgcttcgtcttcactgctccttttctgactctgaccctcctgccttcctcctataaggaccttgtggttaccattagggctccctggaaaatccaggaccatctccagacccttcactcaatcccatttgcaaagtctctggattatcatgtaaggtgacatagccacgtattctagaattagcatggggacttccttgggggtggggacattctcctgtgtgccacagagattaggatggcagcacgccgtctgctgtgactcctccctggcacagctgaggggcacacacagcctccatacgcagaggcagctggcctaagccctggggctcagcatctcacccatgttctccaggcccaggtgaggagaacagcagctcacacgtgcagaatgtgaacattctgcaaaagggagatatttttgcattctttttctatagaagaaccaccccctccgcaccgacaccaaagtgtatgagctcccacaaaagttggatctgtccctgcatactaattttgtccatctattcaaagtgcagggaaaggaacatttctttaaggaaaagtcttcatgcttcttctaatttatctgtatatgagaattttttaaagtattattagaaaacttctcacctttattctcaattactctgcgaaagtttttatttttactctggattttaaaatatgcttgtggggaagaaatctacaatcccttaattccattttcatatagtcacaaaatcatcagaagaaaatggaattttctgttcagattaaatacagctcctcagtaccactgaaagcaggagggaagggagagcctggggcaagttccatagactctaaattactagcttctgcaaatcattagtttctcccctgggagaaaagcagctctacagtcttctggttccgaggcaccctcagcagagtcaggagctgcacggccacattttaaattctagtgggcacagctaaaacaggatgaaccgaagtcggcctgaatattgggacactgatttgaggagagagatggcaacgtgggacaacagcatctgattttgatgtcttttgtctagtgatgtcctatgcggtggcaagaaagaagactgcaggtgccagcacacctcgcgctgtccctcctcgggcccagcactgggacctgaggctgagcagtccacctccaccaagaacaggaatgcctgacactcaaaggccatcccagccccagttctggaaatccgagaccctaactgtactttaaaagataactgacagacaggtggcaggagtcaagaagggtcagtcataacttatcctattcgtaaatcataacagtgaagtgcaaaatcccaggaagccagctcaggctgatgatgccgccggggtgacaaaccagggactaaaaagtctgggttcaggaatctttaggtaattaactgtagaatgactagatacccgcctcccatatttacagcgcatgcctttgctaaacccatttgccctccttcatttcttcctgtctctctgcctctccctcccttcccttagcgtggagtacatcaatctgtccgaagggataaactatatttgtgttaagctttcatttataattaaccagctgaccccaattccacacataaatggcacttattatttaaaaaatacaggctacatttctttcattgttcactgtgtcattatgtatacataatgtttccttcccatagagaataaaataatgaccaaagttctgtccttcaacccaatgtctccacagtgtgtctttccacccttgttaaacactgcctgcttacatgttttcaaaacacatgacccgcatctactctgacactttcccattcatcgacagagcaacttcagtccttaattagggcagtgtttgagcttaaaggcaagtctgtacaattgaaaaggtgcatattcaaaaaaaaagaaaaagaaaagatgcgtattcaaatttctgagggagtaatagcgtggtctgtgatgacaaaactaaaaataatttattacattttattttccaacgttaatccattaaatcaaaggtcactggggcagaggtcttattttcaaataatatatatttattataataaataaatgtatttataaattcttcctttccatacctctataaatgtgcctatttctgtaagtttaaagtaagttccttacaactaattatttctgtttactgatgacaggtatgacaattttatatggaatgaaacatgttctgattcaaagagaagtagttcttccaaagtagctgaaagctgattcacaacacaggagtttgccttttacaggcagacatgatgttataaaatgtcagatggccaacatttttgcgatgggggtgtgagagattcttctcaaatgacgcacgcctctcttgggtattatcgaactagaaactggaatgccccctttaagacaaggaaagtttggaagaaaggcgccacaacgccagtcagagctggcggttttctcagcaatgcctgatgcaagctcgagctttgacagcagtagctggactccgactcttcgtaaaggtgcagcttaactcaggcactgctagagagccttggagagaattacagacgtttagagtggcaggaatgcctggtatggctccttggtttgagtcagggcagagggaaagcagcacacacttcagtcagagcatagcctggcctaaaacatgagactgtattctgttctctcacccagagtcttgattaaaaatattctttgcccatttaagagcttgatgtgcagaaccctttcctgatagcattgattctggctcggttttataatttcactgtatgtgggaggagtagttaggagggcagagaaagcagcaccaaaaagatccacacttgctatgactgaagctcattccatagggaagataacagagagccttggagagaagccaccacgttgtccctctgtgggtcccccagctgtggtggcattaatactactgttgataagggtggtggccacctgttgggaaccctggggagatcttaagagcttcagcaggaaagtttctgcaaggtttcaggcggatgcatttaagccatcagcactcagggtcttggagctctggacattggatagcagataatgtccgcctcactgcccatctggtgaccctaacctcaatctggggaaatcgcttctctgtgaaagataacttcggctctgtgacagctccaccccaaccctcgctaagaggagggccaatacatcatgttgacttatgactgctggggtttgtatcccagatcactctccgtgaggatttcctaagccactggaccagagtccacatgtgcagagatgagttgaagtgctgaacaaaacacacgccctgagctacagctgcagtagcaccttttgggggaaggaagccgagatctttcttaagcataatgaggacaagcacatgcagtgggttccttggtgtcggcaactcctgtgtgaaacagaggagttcctgcatgctggctacgtgggcacagggcatggtagggaaaagtgagctggggtaaatggggtgtgctcactttgttctctctctctgcctcctctgtccctgcctccacccctctggctcttgctcttcctcagggagagcagatgttttaactgatagtttgtaaatattcttaaggcagacagttgctacctgacttcacctttcttatctccagttccacccgaaagtggtaacacagcatatccaaacatgccttgtcataccaaagagaagtctgtagctcagctagttagagacttgcattcaaaagaaaaaaaaaaaacttaaagttgcttttttatacggctttttctgtgctgggtggaagtccattcaaagctactttgtataaataaagaaatacaatcctcttccctactccccaataaagctgtggggcagcacgctggccactgtgcctggatgcgcctgctggcatctgccgaggtgtcctgccccacagctgccaggtgtactgtggggacatcattcacctcctgggcatcacactggtgtgaaagcagcccagggctgagctgcacttgaggaccccatggcacaggcttggttcgcactcagctcaccagtggccgcagggccaaggctgttttatttttggcacactgtgaagttgtatttctcccacaacttgatgttcagatctatgtttaagacttagagtaatcatatttctcttttccttttctttcaccttcggcattagcttcttgtaaaaatgaatttaagaacattgtccttgcaaaccagattatgtgtttctgaaagtctgtgcaccctgactttctaaggctcattcatcaccctattcatcatcacctatcatttgtctgccacagtgacaggcacgaggaagatatgacagcaagacaagacctcgttcttgactccaacaagttaacgtttttgctaaggggacaagatcaacgctgatgatacagtgagtcaacaacacaaggttgtctccaggctgacttggggctgctggctgtaaatgtaacagagcaatcagaaggagaaagaggaccgcaggggtgggggcagcctgaataaaggcactgagattcaaggcggggtgggtgtgggggtaaggcagccctgcctgaggaatgcacaggaaaccaggttctgggcactctgaggctggcagagtggtgtgggctccatgggggtgggcaacagagagccactgagggtaactgagcaagagcgtgtctgtgaggaaggaaggtcagtacgggagtaccattcaagatggtctgttggagcaaaaggaggaaatcagcaagaccaactagaaagaaacttcaaaaaattaaaggaacaccccagaaaggaagagggccaggacaggtggatgcggagcgtgaaaatatctgtgttgtgatgtcactgaaaagagtaaattaccaaatgcaccgggagttttgagcacagtgtccagtgtgtaatacgtacgcggtaagtgctcactcctgaacttccgttgttgtgggtattttcatgtgtgagaagagaaatacgtaaattggaagtaataaacacagtccctgcctgcgtggagcttgctttgtggattaatattaaggccacctggctatgacagcatttgttctattgttttggcggcggtggagaggggggcgggggtgaggggtgtgagggttcaagtacatacttgttcttcctaaaaagtacctttgaaactgagtcattgaatggttgtgttattaaagcatttaatagtactactcatgttgaaaatgctgaagaaagccaaggtggaaatttcccacctcagtaacttttgatggtaggatactagttctatagataattattaaataccactaaacgacaaagcgatgactactgaacattttgaccagtaagtgttgatagctgaccacatgtcaggccaggcactggggatacaaatggaacaaaacaccttccctatgcttaaagagccaaaaagacagtggtagaaatagacacaaataatcagagtacaggtgcacagagcctttccaaagcctccggagagcttggagttgagatgttttggctcgtagagacacaaggtgatgggcacaaaacacacaggtggacatttgccctgtgctgccaggacaggctgagttaggcttgtcctggtgctgcctctgtcccctgccccttgtactctcgataggcaggtggtaagtttgtagttaccctaatcccatctttctgagcagccccagcaccatctggccagcacaccataatcaaacgtgaatattccttcagcaaaatgtatgaacagttacagtaagtgataagaagacagactacataattagtcttgtgtcaggttgggccagattttgtaggagaatgggttttaagggaagttttgattttccctgagctctttggattttggaatcacggataatggactgcgcatggtgtggggctgtaagtgtgggtgtccatggcaacagaagagagaacgtctagctcactcctgggaagctggaggactttccagaggaagttccagtaaacctgagacctgagggaggaggagaggtagcttcaggagagtttgggaactggggagggcaggaatgaccatcaagttgcagtcctggcaggcggctgggcacccagcaatctggggctagacccacacagcaatgagaagggtggcggcgcagcaggaaggcccttgcaagaacaggtgcatctggggggcattaagccctgaagaagttttagggtgagttgaattcgtcattgtggaatagcaattaaccggttgttgataaggtgcctggaagttggaactaatatgggaggaaatagaatgattggtactatagcgggcaggcctcaaattgttggggcaatgaatgaagtgaacagattttcattcatttcgattctcaagggttgttatggttttgtatattaatcagatgtatatattgtgtatgatcagatgtgtgcggtgtgctggcaccatcgcggcacagctgatgattctgaggggaggtggtgggcaggtgctgaggcaggaatacaagaagtaagccacaaaggcaggcactccagaggcagcagcacaggcttagtgactgatcagaggtgggggcagcaaggcaaacaggggagtcaagggaagtgtccatgctgttctgcccatgtgttctaacctgaggcctgtgaaaaatacttgtctctttcctcatgcgtttctttattctaactgatgagaacgatgctgaagtctgactaacatacttcaccactgttttctttttgttgtaaagtcacacatgttcgctaatgaacatttggaaaacacaaaccagcggaggagaacccctcgcaggcccatcatgaacacaacactgctgttaacagttttgctggaacgaggctgggagcacgaggcgtccgcagcacgtggctgattcccagcgtttgctcacctgtgtgtaggtttccttatatggttgtgatcatactgtttgcgcatttttatgcttcttttttcacccatcattttatcccagacacttccctgagctactactccatagtctgaatggacacggactttaatggatttgctgcatggtggcatttggaaggactgtgctcagttatcccctatggttggacactatgctgtcgaacagatctctaaacctgaaggaaattgctttaaaggcctactctcatggcagtattttcgggaaggcaaggaagcatttggcatctcatactggttcctaacttatagccttccgaagtctcttgctgtcaactgaatcaggcacggaaacatttataactggtagtttgtggataacagagtagtattttagcagttaagtgaatctcaagtttcagtgcctctcaaatgttgcttacccaaaatttcaatattagtgttggttgtgaatagaaggaattaaaattacatctccattgtgctcaccagaaccacgtctctgctaaccatactttttaatgtgactttaaggaagcaaaaccaagtcataaggttttgaggtcaaaatgtgagctgaaaatattctgatttttaaaaatatctatctgttgatccatctatctatgtattgctcagaaatacttcttggtctcacagaagaggggaggaaaggcttcagtgacagactgaacagccacacagttgagagaagtaatcataggacactctctcaaaggccctgctccagagccctctcctccatggcgttgtccagggtgagcaaccagatggaggtgggctccccaccttcctcctcccaggcagcctggcatggcccaccacacacaggcctgggaggagctccccaccttcctcctcccaggcagcctggcatggcccaccacacacaggcctgggaggagctccccaccttcctcctcccaggcagcctggcatggcccaccacacacaggcctgggaggagctctgccactcacccactcttctgaaagacacatgtgagtagcacccagatttggacgttggaaagtgcgcttgcactgaaagcaattttacatatggtaactagacgcagttaaaatattttcattagtatttcaggcatgttattgggaaaataggcttgtgttggcagggctggggccctcgtatcatttaaaacacgctttctgggagaaaaaggttttcaagtaccaaatctgttgttgcaccaaagacttcacaaactaggctacatccttactattcacatgcgttattaaacattttctggagtaaggtaaggtataaataaatgaaatacaaataaacaaaaaacaaatacagcactcatccgattttaatggcatagaaaggaaatatccagaagtatcaagtgggaaaggtgcttgtccacaccctcctggggctctgagggccataaagaatcagccatttgctcaccatccacagaaaagcgtgaaacaaaatgcggcatctgggtatatctcaaaggtagggaaggaaacaactcgaaggctgtaactttcccgacacttgagacgtcactcctttgcaaggcagcattcccagcaggcagcgaagcgtgtttggagaagctggagggcagatgaggagtggagggaaggcgggtagggggcttgcactcgaaaccacctctgaaggcgttgtcaatacagcaacagcaacgaggacaaacatgccacacggtgggtccaagtctgaactgcccggggctaagtcagtcaccgcacaatcgagtatggtgtagctccaaagaatggatcgggcgagagccccactgcatcagataactggtgcatcaaatggtttagatcttgggaaaagcaggtttgggttttcctcaaaccatgcctattataaactgctggtagaatattccttttgaattaaaatctcatagtctattctaagaactccaagggcacatgaaagaaaggccagtgagcgccgggggcctctgggcctggctggcgttcctctgagtactgccatctgaaacagcaaaaggccaaccggggtcacgtctctgtacgctgcatctcacagctttgggttttaaatgtaaaaaagaagcacctttacatggtaagtaagtgtgtccagtcatacactaaaaggacaaaaagccattgtcaggtgctgtggtgacatgttcagttgggccctgacccttcctacttccagaaaatccctcaaagccttcatacctggtgcctgtgtcactggaaaagagggtgcagctgtctgatgtcccctgattgccgagaaccgtgtacactgactcagctccacaggtaggcatgacaggttatgtcccctgaatgcacagcaggtgtctgactgctggtttatagattcagaccattaagtaggtgcagatacacccactgcagcactgagaaaaggcaggagacagtgtctacagaaccagagtgccagccacccttgtagtgctgctgctgaggggcctggctagaaagtgcttagagcagctgtccttagaggctaatgtgcagaagggcaaagtttttgggtgacccagtgcacgtgatctgggaggaaagttgcagaggcttcgtgggggagcacggcctggaaactggctgtgccactagcacacagcgtgaccttgggcaagtcactcggcttcctggtggcccaatttcctcatctgacatgacaacagtgaagatcatgttccctgagcagctggaggaagtgacaatgaggctctgtgctggagaagccacggtggcaaaggccaacatctcagaggtgacgtgttgcctggcccccaggaccaggagaagcccttaatgcttggagctgattgtcacagatggaaggagaagtggacaagtaacgtgggtgggccttggctcctctgttccccaaggcacaaacccactcctctggctgcccttacatggctatttagactgctgcttacatgagagtacgtgcaaaaagaagaacttattgagaattaatgctgtaactaggatttagagatgggactgagagttatgtttcaaaaccagagcttgaagtttggggagaaaacaaatgtctcttctctcaacaaatacagtcctttggttgggctaaacctgcctaactcgactgaggcagggtatctatggaggaagagtttttgcttcatgcagcagcttttggcttaactgcagaattatttctggaaatagttaataaaaatcacacatatatataaaccgataacataaaaccccaaaccatacaagtacacttaaaataaatgactttgggtatttaaaaattgtttttatactgctgaagtccctgaagtcagagcccgtgctacagctgtacgcttcccaagaatcactgcttgtcaacactgctcctgcagaggaagactgtttacctccactctgcctgtcaagttgactttgtctctaaatgctctgctttttattactaccctccaccagaccggggaaaacatttgtgtatgtgtatattcctgagaagcttaaccacattactgctgagaacacagcagatctactcatcaacttggtaaagaaaccaatcacactgattgatcagatgcctaaaacagctagttgattttcttttccacgtctgcggcattcattcagtccctaaaccctgagcagccacctgctctggacctgccgtggtataaccaggctgtggtcagacctgatggagcttccgcctatcagagaactgtgtagggacaatgccctctggggcttcaccaaaaacaaccaaaacacacgtctgccctgacatggcagatacacttttgaggttccccttgggaatggtccccctagacctggagctctccgaggatggggtcagggaagctgagactacctaggcacaaaaatcttgacgtctacatttctatcatcaatttaacttcaatcggtaaatgatctggtgatactgccaagctcaatgtccaggtcctaagcacaccctcccttgcagggcgggggtgtgaatggctcttatgttccattggggagggcggatgtcaagctcttccaaagcacccctgtgagtttgtggagggcttaacgacagacttgtgaaggggttgactacatatcgtcagaaattataccaatgacagttttaatcactggacatgaacatttacaaaatacgtacacctatgaaaggatgtgccaagccaagcaaaaacttggggctggagaagaaaggagccggacctggcagttcagctttgttttctccgcatggacagctggacaggcacaattccctacaactacatacatgatgtattctgagcattttcccctggggggaatcagcttttatctaattcttcaagaggtgaatgaaaccaacaaggttagggacaacccaactgtgtgcatcattccctgactgcagcccagggcacagctgcccccacttaccgaggcttggccagcctcagagccggctgcctcaggatccctgcagagtcctacgtttccagggtccaccgctcaagtggtttgaggatgaatcctggaagactgtattttcaacagctttctggatgagtctgacgtactaggcttaagaaccatggactagggtagccacccttgacaaaggatgcctgcggttttgcttaaagtagtagtattgcctgagaagaaatgggttgcctctttaagaacacttgggtaacccacccatccacaacagctctgatgattacaggcaaaatgaaacacatgggtgggaaataaatgtacaaactcattttgccagtttgcaccaaatctgtgtatttgtggcctgtgattttggagatactactctgcaatttttgcacacgttatgtctaggtatggttttccatccaccttgcttatctctgtgctatcagcctgtctttgcctctgacaccccggctgcctgcataccccttccgtgccccttaagtgacttgggaaacttgtggaaagccatcttttccgtccgattttgtgcagcatggatgaaagtccctgttgattctaaggaatgagctgggtggagggacagtttttctggcatagtgaaggccccacccgagcaccagccaaacggtggctgctgagagcagcactgcacagtcaccagccgaacatgccccccaaagccccatccggcccctcgcctgagccttcattaacacccaacacttctcctctgtttacaagtttatgactgcagcctactctctaaccctcttcaatgcttagaaacggactctaagatcacgagaaaactgcaagagattggaggtttggggcttcagatatagaaggtatagaagatgctggaaaattcagtcagatacagaagatgctggaaaattaagtcagattaatccagactcttggtttgaggaattcttttctttgatagtaatcacactattctgcaatactccggtatctttgatcataagatctcaacatgcttcacaaacactaatttaacctcccactacttttgtgaagtttatcataatcatccttcacttaggagatagggaagctgagatgacgtgtaaagtagaagatgtaagtagctaaatgaactttgaagtgctgtgttcttatcttagctcctaattattttgactgaagtgttttttcttatttccttcagatgaataaactgatatcgatggtttacataaacaacagaaactgcaaaacacacattcctaacttgctccctataactaagcctggggtgcaaaatgtcactcacatggagagaagacgcagcagacataatggcttatcatcaactcagggtttgaaacaaatacccactttactttgatgtctctgatgctgaccacaaagtatgagggtatcggaaagctcagaagttcagacagaagttcaattgtctgaaaaagttataaagatggagaaagggaaaaagcaaaagggttgaattctttaaaaaaaaaaccaagatcatgaaacaggcagaaaggaagaggagaatatttctagcaagcaataggttattaagtttggatttcaatagaggttgttagcagaacaatataaatattacttagttggagggctgaggagaaagtggtgtgaatcagaaagcctgaccaatgtccgtggatgaccagggacacggggcagacacaaggccgtttctgctgcagatagtgagaaggccatgccatcatatctgcgtttctcccaaagcaacaaatccatcaacacaagactatgtagaatccagccacggatgtcagactgacaagtcagaaatgtggtagatccatagtggccactctcaaggacaagcaactgactctgttttatgttttgccaaataaacccacaggccagcgggtgggcgctagccttttcataagtatgccaagtcaaaccaccattaaaaccattcccttggccactgcggtccctgtgggatgaagtgtcctcgcctccactggactccagtgtgtgttatcttttcacctccttcctgggaagagttggtggttgctcagcaccacatgtgacgactaggcacaggccctggctgctcctggcacccaccaccggcccacgccgggatccagtgctggcactgtttgctctgcgtctccgccccgtggctccctcccactgcccacccccgccagctgaaagaagagacaatgtattggcactgacggccatccccatcctacctttaggaggaggtggtgatgcatgaagataatatttcgtcttgccaatagacaaacaggctttttggatcaatgggacacacacacacacacacatacacgtacgtgtgtttgtgctgcattttacagttgtgccaaactgcatgaaattggcttttctctcatctcaatttggcggcatgaagcacaaacatctcaaaggaaaatcagcaactgtttttatccatagtctcttctctttttcttattcatctgatccacgggcctatctgagttcttattttttcacatcctcactgtaagttaacagttttggtaagacaggcatactcaatcaggccatttctcttcatgtgggaattagatacttgttttagaaaacatatccaaagactattctagtgcatttgactgaattttccaccaaaatggatgtgcaaagaagaagacactgtacaccttattaggaaaatctctataagcccaacactttttcagactttttttgagagggagtctcactctgtcgcccaggctggagtgcagtggcatgatcttggctcactgcaagctccgcctcctggattcacgccattctcccgcctcagcctcccaagtagctgggactacaggcgcccaccaccacgcccagctaatttttttgtatttttagtacagacgggatttcactttgttagtcaggatggtctcgatctcctgacctcgtgatccacctgccttggcctcctaaagtgctgggattacaggcgtgagccactgtgcccggcctcactttttcagaaatttaaaaaatgttgttctaaatgactatcatcttacacaatcatatatttaagttctttgcacttacattaaaaaaaaaaaagaaaaacattgaagattctaggtgaagagaaaaaggaatatcatgccaccaggtttccggaagaccttggttccacgataccaataccagccatgatggccattcactgagtagaacttatttctcactttgtaattcagaaagtttcagagtagcagagaaacgcgtgtcatggggaaagccagagaactgagtgtcttttatgctaggtgacactttgttccacaaatatagcctcagagtgggtaaaggaaagatggtggctgacaatggggcatttcttatggaggctcagagccggcaatgcctccagttggcagtcgtactctcttcagacagaagcaaccttggatgccttttgcatatgcattattgttgatgctgtctgccaagacttcaagatactatgagattttcccacaatgtgcatatgctgtggatgccggaggcatcatgccctagtggtctaagggtggagccgggctgcagtggctgtaatatggcatcaccaggtcttcctgtggagaggagccagggagcacatctggagtgctgagcttgtgtgagacagttgggatagatcaacaagaaaggtgcagagggaagtggagaaacgaacagaacctatgaaaataagagtttcagaacagatgaagaaaaaaggagagaacatcagcagaaacataaggagacaggaaagtggcagaaatgaaagaattagtgaaaagacatgtatagaggtaaagcaatagaaacgaaatatgaccttttcaaaggttggatatacaagtgtaagttgtgagtgaacttaacactcatcttgccatggaatctcaaatagaaagaggaacattattatttttattccctttgctatttagtatagtttagactattgctctctaatagtttaatacactggtttgaataattttggttctatcagagctggctgtaaagcataagaatgattctttggcaatgtgcacattcattcattctttatcccctgacaatgtgccaggtcgtcttcaaggccctccgatgtcattcttcccccaggaccccaggtggaaatgacccatcacaatgcaatgggataagcggtaagtgctgactgcctgggggaacaggtgcaggctgcaccaaggagctgacacttgtgcagggtcttgtaactaatattgcatcagttttttcaacatgcctattgagatcagtgggaaaatactcatcgttatgttgtagcaggaaaaacagaagtaaggagaggttaggagcttctagaagacttcaaaagtttgagagctgggaataaaaggtgttgagatacatactttaaaacttataatgcaagctagtaggacatattcaaactaccactatactttttaaattttagaatttcaataagggactatagtactttctaatcctccacaacaaaaactgattcagaaacaaatacgtcttattaacttcaataccttagtaacttgccttagaaaaaatgacaaattccccaaaattcaaacagcaggttttagatgacgatgttaggcacatttttctccactgacctcttttcaaaaaataatagaaacagcctgaatttaaaatatacagtgtctttctaataccactgtgaaaaacattcacacagaattaatttcattctcaacaaaatccctggaaaatagggaaacatttcattatgaagtcgaagaatatgtaaaaaaagattaaaaacatctttagattggttttctctgagttactgttaaggatccacgtttatgctataaacaaatctctctcatgaaagtaaggccttccctattcctggctctgccttttaatcactgaaacagctgggaactgtttaagaatttgtctcaaacacaaaacttgtttaactaacttaatggaacaggtgaggagacactcttccagaatttgaacccatcaggggtcagatggcaggtatcaaaagacagattaatggtatcagaatagtggccatgtggagtttaatgatgacatatgactggttttaagactcgtgacagcaagaaagaaaaaggcaagaaaataggaggtacaaataagaggagtggctaagctgctgcacagacaggcttggaggtgaggcggtgaagaggggtggcctgctggctgcgtgagagaaggcctggccagggcagggtgtggtgatattggctctaccagccttgcttctcagggttcccagactgggccacccacccactccacctgacagagtccctgcctatgtctctgttcatgcggctggttcattcccacagcacctcctgccccaattgtgaattctttcccagttcttacaccccgtcccccaactctctcttttaattacaaatctttccaaagccctgctctaaaactcccctttattaggaagcctgtccttgtccctcaggctcaagtacgacctgtcctcatttccagttgcccaaatgtatcagcggtgttttctgagtgtgtacattatgcaattttaaatagatgatgcaccagcgtcttccattttggtttagtccgcaaagtgattaacaacatgctatccattccatggaaaacactagcccagcaccggttccaagtgattaactcagtattccctgccaagagaaaatctcactgtccaagaactctggagcctcaacaaggaaggtggctttgccagcaccttgatttagctcagtgggactccatttggtcttctgacctccagaactgtaagacaatgaatctgggtagttttaagccactaagtttgtgattacttgttacatcagcaatagtaaaccaacatagattttagactatcaaagtgacactcagctggctctagggagcaagtacaaagatgggtttttgcagacaggtttccaagggaggagcatggggggtggttggcagataaaagcagatgatagcctgatgtcttccttggtggctgctctctagcctactggggatactgcagttctaggaggagctgtagagcttgctggatctcagcgcctgtcacactcccttgaaacataccgtttaggcagaatcagaagtcgatcaccaattcagcatatccctaccttccaccacgatcatcctttctacccctgggtcaagaagcacacagctggcagtactaaggaacaagtaactttttctgcatgaagatctataggtataaaacaaaataaatatttaaataaaaaatgtcaggagttgaagagcccaaagcatcctttcagaagatgtcttttgataactaataatttcacaagagtatatgataatgataattaataatgatgactaataaaatgacaatatgcagcacaaagtaccttacacttataaaagccctttcatctttaagaatttgaaaatgctttgcaacctgacttccaggacatagtgatttgaaattgggtctctgcttgccccctgaaactcagtttttcttggattgagatgaagtaatcatctgccaattaatgtaactctttgatattagctctttacacattaatctggccctatggctctcagatacaagtgcttagtttgtgtatgctgtgaattattaacctactttttcaaaatatgtttctgagacttacctcctggaattcgaatttgcctggctctgcgaccagctccctgtgcacactctttttcccccctagaaatgctccttcagggagtttatgtatgtcaggatttcagctcttgcacatcttgcacatctaggccctagccctgacctcttttctctacactaggcctccagctccaactgcctccctcattttgcagcacagatatcccgaaggcaccgggagtgtgacggaacacctcaacacctccccctgcaaagtaagtcttctcgctggatctctgatctgggttccagcatcgtcacctccccactaccctacatggttcagcctctgtcctgggagtcaacctcagctctgtcttctcttccacatgtccttagtccactctgattccatggtctccatctctgccatgttctggcacctgtcactgtttctctcgcctgggctgccctggttccgtgagtccctcattacacccaccccaccccgggctgtcccggcagcttcgcagctgcttccctttcatctgagagtttctattggacaaggaccttatctcatctatctttaaatttcttggtgttagactgggacttacctctacggtaatggaatgttcaataaacattcttttcaaaattgaatgttaaaaactcaaccatgtattttcatatatatacatatatatatatttcatatatatatattttctcatatatactgatatatatctgagaagctgaaggtaaatcagaattatattttaaatgtgcatggtcaatgtactatctaaaatattcctgtaataaatcctaaaacctgcagaatcttttagtacctacacacagtcacttattttttagtttggatattgttacaccaggttttcatgggggcaaggcatacctgatttactcaggaaactagcaaattgatgacagcattacaaaatgtacaaggtagattttgctattaaggacagttcctattgctgagtaacagcggaatgaaaccaggtatttactgatgggccaaacctggtaagcatttgtctaggaggcagatcagagctactaagttgggacggaagcccgtcagtggtggacctatcaccttggcagttaatgacaaaaggagccagacgagtttttgcctttgctactagatgtaacagtggatagagaagccggcctggcatgagccacaggtgtgggcagtgaggtggtgggagaaggcatgcagggtgagaaaggtggcgcagagcccacggtagatgggcatgactacatttcagccccagaatattctagtgtctgcagagcaactgttttcaagtaaagaaggtgctgggaaaacaatcaaatttgataaaaaataattaactttatcgagagcatgaggcagaacggggtgagagaaaccacaggcagtattatctgtgaaatctccatgaacacagatttttggattgctgttattttggaagataaataaggcttggtggaacaggaagagcactgctgatttgtttaaaaaaaaaaaagagagagggattttttagatttccgaatacagaggtcatcggccaaagatgaaaataaagatggaacaggtaatcacaccagggacgaatggatctctcataagtaattctattctttaggtgatgtacttcagagctactttaggtagaagttgagctcaacaactaattgttcctcctatggaaagttgatgcagatgctaaaacagacttttaagacgataaaaagattttgaaacttattttgtagacgtcaataagtctgcattatgattataaatgaggatagtcagccatcacctggatagctttatggaaaaaaggtacagatgttgcaggaattcctcacgggtgcaagtaatggacatatctgcactaggaataccagaaggacttaaggataaatcaaaaaatattcttaaataagggaagatacatagctatgtatagccataaagatttttgagtctttaatgacatcattttaatctagatctgataataagaaaagaaacttcaaggaaaaaaggaggaagttggggttattacaatcagtacacaattactatttcattagatatgaaatgctcttgaggggggagagcaaccgaggaaagaacccaggcttcaggaggaatgttatatggcccttggggatttgtatgcgatcctatgaagtatggaaaacaaacagtggaatatttaagaatcaactgaagagactgaaacttaaagctcccttggttaagtccaaggaaggaaaagggcaggaaaggccaatgtgattaaggaaggatataaagattagtatgaggagcctaagagggaggcttaaaatatataaacagtgatttagagatataaactatttataaaatacaagcagtaagaagttcagagaataattacaaaagaggaagcattctgatcagcattccacactactgtggtccaaaagttatgggagcacaggatgccaggatattaaaatgggaagggaccttacagaacgagtagtctcgcctctctttctataggcccaagagtgcaggaagaaaggcactcatccttaatctgctctctccacatcctctgaccctggctcccgctggtcagagaaaggaacaaagaagagcaggggtggaggggaggattagagccttagaggtcagaaggagcaggagcgggagggatggactggcttctaacagagctggtacagatgaagggatagagtggggggatctaatttcctgctttgggaggggaagtgtgagaaggtggtgagaacagctatgggagaaaagggggacagtttcaggacaaaaggccaggctggtgagtgtgttgagggcttttcacccccaaacgcagagacagagctgagggaagctctgactggcatttatataagtcctctgatgacagatcaggttcctgaggtctggaaagtgttacatatcattattctaaacagggctatgagatagagcaagcaattataggccatttaacttaacatcatttacagaaaaatattaggaaaagtttgcggggggtggggaggacaactcgacaagcatatggtaatttgatcagaaacaggccacatgtttttacgggaggaaggtgttgttttaactagcttgttggacttctttgaagttattgctttcttagttctaggttttaacctatgatttttccctgatatctataaagattaggaataaatatcagatatctaagtaaataaaacaaaaaccaatcacaactgaggagattaaaaatacaatgggaagaaaaagaaaaatgaatgttaaagacaaacagtgtagcaaggaaaaaaaggagtaaacatcagctagtagagtttaagccaagatacttttcatgaaaaatacttgatttgggtctgtgaatgtgtccctttatcccatttcccaagatgctctgcagaaaaaaaagggactttttgtttgtttgactgaaaaaaatctctttgctttttttttcttttgttttgcttttttagtggattgaccatttgatgtggttacaaatttggcacgttaggatgactacttcattaatccttcctttgtgaatttttaagttaaaaattctcacataagaagacgacatatttgtggttattttatatatattaataggtcaatagtagttttctcatatttacacaatatttctgtactacttactgagtagcccctgaactttcagaaacaggatcagaaaggctgaaaaccaataaaaaaatgagcatcttaaaacgtgcttagtaatactcactagaagcttcaagtatgtttcattatccatttttggctggttagtctgcacaagtcactaacaatgtcgttctgcttctccaaagatcctggactccaggaactgctatcacgtcttttttttttttttttttttttgagatggaatcttgctttgacgcccaggctggagtgcagtggtgtgatcttggctcactgcaagctccacctcccgggttcccaccattctcctgcctcagcctccccagtagctgtgactacaggtgcccgccaccctccctggctaattattattattagtagtagtagtagtagtatttttagtagagatggggtttctccatcttagccaggaaggtctcaatctcctgaccttgtgatctgcccgcctcggcctcccaaaatgctgggattacaggtgtgagccaccgcgcccggccaaactgctatcatttctacatttgcaatctccacaagggtggggactgtatctgttttgttcatcattgtactcctagggtctagcacagtgtttgataaatacttagtgcatgaatgaatggttaagaacaacatcaatattagatatttactctgtgccagacactgtactaataagtactttgcataactgactctgttaattctccagtaattctttgaaagaagtcctattattaatcttatttttaaaaatgagggaacagaggcactgagaagttaaggaacttgcctatggtcgcacagctagtaatcaataggtttcaaactcaggcagtttggccaacaggcccacatttgagcataattaccactttctctctaagaatgaacacacaatgcaataaatctgtgcatcagtgtatgcatgtacagaaaattatacacaagacaggggtcttaagtggcacagaactcaagtactaatgttatcatcaacaaataccagaattcaggagtgatggaaaatttaaagtctaatttccaggatcaggctctctgtggtaacaaacccctgtaggcagagtaccaaaaaatgttgctcaattgagctttaattggatgctggagtccttagtccagaacaaacactttgaaaacttcacactggtacagaagcgatattgaaggttttgaggcactaaatcaatgaggaaaaagaaattaccagcacaggtggaactacgccctctatggaaccactggtggcctctttcaagctagtacctgcctttgctgagcaaagggccatttttgagaccattctgagtcttattcaaaacataatataaagctctatttccctttagtcttgctgtaggatatcagtgttctgagacctgatgtgtcctattttttttttttcaaattttctttatggcattttttttttttttttagacggagtctcgctctgtggcccaggctggagtgcagtggcacgaccttggctcactgaaagctccgcctcccgggttcacgccattctcctgcctcagcctcctgagtagctgggactacaggcacctgccaccatacccggctaattttttgtatcttttttagtagagacggggtttcactgtgttagccaggatggtctcgatctcctgatcttgtgatccacccgcctcggcctctttatggcaatttttttttcctatcagtcattccgaaatgattctaagaagacatagttattggtttgagtgtccctctgtgcagaagatcttgggggacagatgacctaagctgatcggtgaaagcacttttacagactataagaagaataagaagcctttggcatgtgcaggatggactgagtccctgagaaggaaagattcagtttagatgtgagagaattccacatgtatcctaagttgaatgtagacaaacctcaaagaagcttggtgcttttcaggactcataccaaatggctctagaccattggctcttgggacctcacacctaactaaaagcttatttacaatatagtctccagttctggttacctttcaactggaagaatattctcacccctgaggcaattcaacaggaggctgtcaagttgatccaagttttaggaaaacttgttgttctgaggaatgaggttaaaagtttagtctcaccatacaggaaaagcttacccagtggaatattaggttgaagtggagtgaatgaaattaatgcagcctagaggcttagaaagataaaacgtagttcaagattcaaaattggacagtaaagggaagctcaggagagagccaaatcggtggaaaaataaagcaagcatatgaaatcagacaccactcttatactcaaagaatgctagtgtcaacagagctgcagaacaggtatgatgatagcacttgaatgaacaaaagaaacgggagggatgcggcgtcggtcacggcaggaaagggggtcgatgcggattcaagaacagtcttgttagtctgagggtccttttcctgttcagtgaattcttttgttctgtgtccttatcaatcccacaccttgtctaagtaggaatgacagacaagccattcttaatgacttcctagcttttgaaactattttggtgtcagagagggaaagagccacatttaagttgtaaaaattgaggtttctgttggcttagtaaatttccttctctgagatgaccatttttgattgtagatacagaaaagcatttgcataaatatgtgatctgtgcaatgttccagaaaattgacatctctgtcgcacctcatcaggccagagagtcaaatggcagcacagctcagggctccagtcggcagtccctgctatgtcagcacagcgtggctggcatcttcctccctgagggccagtacacatcctctcctaggcacacccactctccattagcaccgggaacaatggttcactgtgtcagagccccggccacgccctgtgcccggacaatgcacgactccacagccctacctctcccaagcactggttacttcctttcctttttatttcctcctgtgtggtagagtgcatgaaatacagttttttccttctgtctgaaacaagacattttaaagagtggtaaatgatgaccgattcactttcagtctctcttcactggggttttcctaacctctccaaggttgaacaacagataggaatttggttcagaacacagggaaaatggtttcaaaaaattcaattttcacagttaatgttcactaggtaacacatatgaacgtttctctctagagatgatgctttctattatctttaggtatatttcatatgttgagctttgcttccatagtgaggatggacctcattaaagcaataacagcaagctaggcagctttataagtttaggaaaggaggatgttatgttctaacaaccattttgtaacacaggaagttctgtatttagaaattcgcccatccatctagcaatcagtcagtatttattaagtacctaccttgttatagtctagtgtaagatttttttttttttgagacggagtttcactcttgttgcctaggctggagtgcaatggcgcgcgatctcggctcactgcaacctccgcctcctgggttcaagcgattctcctgcctcagcctcccgagtagtggggattacaggcatgcgctaccacacccggctaattttgtatttttagtagagatggggtttcacatgttggtcaggctggtcttgaactcctgagctcaggtgatctgcatgcctctgcctcccaaagggctgggattataggcatgagccactgtgcctggccttaagatattttttaaaagtccctattctcaaagagttcacaatttggtaaagagagaaagacatgtaaacaaatgattatggtgggttatagtaggtactataatagaattatgtatagcatataatgtggatacaaagaaaggagtgggaaggaatttcagcagtactgatgtatcggccagaaaaggctacatggacagggtggtccctgacctgagtcttataaaaagcaggggagaccatttatggtatagtgtgcaagtatgcacttgtgtatgagtacacagacacagacatagacatagctggagaggacctagatgtcctgcaggtctgggacagcgttgttaagtcaggcatcctgtaggttatcagggaccagccattagaataggagaccaacatgaggagatctgcgtgtgatgtgagattccatttctgaaatcaatgatttcttttggtgggtttaactcttgttttcctttatagagcaatgaagtttgtggtaagaatgataatctcaaattgaattcactgtgttctgattttggaaatgcacgctgaaggatgccagggagctgaactgacagctccaaaggctggcaccaggcattccatgagcgcatttgcccagccagccagccaaatgtggccacgcactgggtggccagagagtccttaccacttcagttggccggtagtacttgagatccacagtcacgtgaactttgccggtctctttacatctgcccacttcattttcattctttccttcccacctgtaaggaagataaacactgaatcagctcctaattgcttgggaacatttggccatgctgtagcaccttgggatgccccagccctctccccgcaggagcgcttaagctcattaaccacagcagcacaggctgatgctccagctgattattaaagcaacggcgactttcaaagcctttctagatctgttttgcaagggcagcgtttttttccttttcaagaaaatcatgacgaattcagaagtgagactttagaaatgaacagattagccagaaaataaaattgggcaactttcagggatttcaaagattttgtatttctctagaccattcttggtcaattcattattattaattaataaattattataaattaattaatataaattaatgtcttctgtcttccctttttttttctttcttttgtagttttagggatattcagagttaattcaacacattccatttgggaataagttttgtaacctaattaaccattcaatgcatccctggatcacatacaagttctcctgctctcccgtcaatggtgggcccccttagtaagtctcagatgattaaacctccaaaaagtacagaactaattgtttgtttcctgctgagtgagggtatatcaatattactttcctataacctcctctgacctagctaggatactgtttgcacacaagtttccttccctgaacatccaaggttgacagcagtaaggatcccaggagcgagtcctcaagtccacactatgcaggatgagctcatatgcttcgagattaccttctcgctaaaattctacttatccattttatgttctcattttttataaatcaagccactcacttaatggtaacgtctggatgtctataatattacagaatttgggttatttatttttacatatgaacttttttgcaaagaaagagaagaaattaacaagtatgacatgtttgactttactgtttatccttagaactggtttgcattatgagctggagatgaatcctatggacacaggacaattctgtgtgctctcggggtcagagtcatcatggggaagacaaaattagttacctgcctatgtaagccacaggcaccactgaaaatgaacattaaatgttgatcccagttatattttggaataggttgagaattaaagacataaactgacctcataagccttatttctgatgaatcacctgaatgttctgtcaaatcacttcttggtagcaaaggggaaatatttcaccgttggaggaataatcagtttgttagtgtgctgaatttaccaatggactcaaggcaagtatgaaaactgtcctgtgacacagagaattatatagcgcagtatgttgaataatatacagctgtacaactggtcatttccccatgacttttatattaattaattaacacaaaaagggatgtttggtaatttgttttcatttcttccttaatgttgattagatcaatttggcaggtcatataggtctaagaatttcaaagcaagggaattggtaggtaggatcagagctaagtttttggaaaattcaccgggaaacggtaagtggatgttttggagcatggagattgaaagcgttttaaaacataacctgaaggaatgatgaccctcatacatctcctgtggataaagaccaaatcttagctaatatccacaggaagggaggacaattggttaagtcattattattattttttttaaataactatctaattctaaagttaattgtttaagtagaaccttttaaaaaaattttggttaggctttcagtagatgaaagtatatttgtatttcacaggcatgtttgatctatttttgctcacatttcgttcttcgcaaagagaaacaagttcagcagatacttgcgtgatagtacctccaaccaagtcaaagggttaacagaaataccatttacaattctgctgactgatttttcgcctgtagctggccacgctgacttatgtgcgcaccaatattccactgttcttccactggtaaatctcaaatgccacaaccatgagaactggtgattcaaatctatttataattcaatttttaaaaaatcacacacaaacacacacacatatttaaatcgacaaagccttggtaaagacttggagagcttttcttgttttaggagggagcgtgtgagtcaggagaggactgaggccgtgcctgaggggtctttagactttggtggggtctgtaaactgtttctgtgaagagccagacagtaaatacttaaagcttcacagatcacatatagtctctgttacatatttttcctttctcctctttctttttctgtttcttcttcctcctcttattttttcttccttattattttcttctttttttaaaccacgctttaagactgtaaaacctgtccttacctccaggacagtaaaaaaaaaaaacaaaaaacaaaaaaccaaaaacaaaaccaaaagggcctcagctgggatttggcccacaggctccagttgcccactcctgcttcggccgatcaggttaatggtatcgcctcaccctcagctgaaggaaagcatttaattcctgtttatagcagtggcctgcacggctagactgcttgaattttagtgtctactactgattctctttgattgctttgctggtcatagactcacatttgggatttgtaacactagctgaaatgggaaaaggctgaaggagaaacactccctctctgaggggtttattaaatacagcctgaaagtcagacttgggtctggtgctactttggcactcaacaggcaccagctcccctgcacgactttcttgccactgtctgaacgctgtctgctgaacttgcatcttgcaaatgctgtctacagtcaaaacagtctctaagggcatggcattgccctctacaattaatatagctacattgaatgagcaaatgtaatcaggaaatggctcaaagctgaattgagttggcaaaaaccactttctaatttgcaccaggtctgaatgagggcagtaagcaaaagtttcggccaagtgccaaaaaacattcagttacaacaatacatgaaacacttgtattaacaagtaaaaggtaacagctaacatgtcctaacaagtgatgttacgacttgaagcagggctgctctgttaatgaagtgacggtggcttgacagagaggagaggattcggttaattaacaagagttactacccacgaattgagatcaacagctcaccgagcagggatcctgtataattcaatttttaaaataaattgttggctcctaataagcattaaatagcaatagaaagcactgaagaataacagaatcaaggacaataaggcaagacaaagcgctatgaaaatctactcaactcggcattcctttgaaggagcaacaaaagcaaagtcagccacatgagtcaagtttggggctattagacctaagttggtgggggcgggggaacaacacactccttgtagtgaccatgagtcaagtttggggactattagagctaagtggggcgggggcaacacactcctcgtagtgacccaaatatcataaaagcgctcagggattattctgaagaaaggcgatttaattagggtatggaagtaggaagctgcaggagctaaaatttagtcagtgccataaggcaggcctggaggaagcattagcttctggataaagatggtggttttcacacacttttgctccttccgcagacccctttcaaaaaaggaataaactcacatgagctaagagggcaggaaagagatgtgagaaaccaaattctggaagctggaaagcagatggatgagtgttaaaggacttagcagaagtcctagaaaagtctcctaaaccaacagtgggagagctgagaatggccccaatttacacttgcagaagttcccaaatgctcaggaagtgagacctgattgcaaatctccataggcagcagtctggggcctgattccctccccgacactcactgcctcaccctccctgaggtagaaggtggctggactgaaggctacaggctcagtgaagagtgggtcaccatgctgaagacagaggaaattaggtgcttgtatgcacgatgaatactgaggcccaccacacagctctctgtgggctgacagtcaggcctatttccttccaatgaggacactggggaggctcctctgggcatcagagattctccaactaaaaggccccgtcaagtcctcttataataaaatagccacaagatctaactatgctctcaaaactcacaagtagctttttaggccccccacttttaaagaagcagaaaaccaagtattacgagacaggaaatatataaggaaaatcacatatatgaaaaatagaaatccaaagaaacaaactgaaaaaaagcaacgtggaggaagtagaacaagcagggggaggagaatcagaaacaaaataaaacaaacaagaaaatccccacatctaccacctttgacgtcctcagacagagagatcaggaaagatatcaaacaaacaagaacaggatactacataaaaagaaataatgtgaaacacaggattttagaagttgaaaacaaaacatagaaattcacaatccaagagatgatttcgaagatacagttgaggaaatctaatctcccagaaagtagagcaaaaaggtgtagacatgaaaaaccagaagaaggaagataagaacattagagtgcctcagggcagtcagtataacaggatttccagaaagagagtacagaaaaaatggagcagagcaaacaactctcttaaaataagtcaagaatactgatcaaagcagagaggcacatgcatttccacaccaaaagggtgtcctccaataacgaatgggtctagacccacctcacatcaagttccacaccactgggaccaagagaaggtctgaaacactttctagaggggacagacgggactgggagtcagaatggctcttggtttcccatggtgatactgcaaattaataggcaatggagtaacaccttcaaagttctgaaggaaaattatttccaatctagaaatatataccagcaacattattaattttgagattggactagagatattttcaggtatattttgtcacaaagtatttgtttcccaggtatctttctcaggaaactaattatgattttgctttaccaaaccaagtagtcttgaataagatgtcaggaaataggggctcagtgcaggatagcagctaagagagccccccagaggagcatgaagtgacacagcagggtttgaccttctgggcagtccacacggggtcaggtcagaggctctaggactgcctcaggaagatgtgactgacagcccaaccggggtttgagagcctagagaggtgatttgcacagctggagcagagtatggggtaaagttagtgataagtacacagaaaatcaatagaacagagaaagaaggcatctgttagctctacagtaaacaaatgacaattgtacatagaagataaaataggccgggcatggtggctcacgcctgtaatcccagcactttgggaggccgaggcatgtggatcacaaggtctggagttcaagaccatcctggccaacatggtgaaaccctgtctctactaaaaatacaaaaaatgagccaggcgtggtggcgggcacctgtagtcccagctactcgggaggctgaggcaggagaatcgcttgaacccaggaggcggaggttgcagtgagcccagatcgcaccactgcactccagcctggtgacagagcgaggctccgtctcaacaaataaacaaataaaaataaaaaaagataaaatacatgtggtttactggaatgcatagcattcgtcagtcatggtaatgtagcactaaatattgacttgactccaaaattaaaacataacaattgagtattaagagaacggagggatgggtcaaggggagaagaagagggcaaaactcttgttttgaataagaggaggccgacagataagtcccagaagggcaaaatcagtaacgacatgttatttggaaacatggagataaatgccaaaataattgtaatacagtacaatagaatttccagaaacaaataattatctttaaataagacagtgtaccacagcagaacaacaaacatttctgtatgtcggaaagggcccacagagcaccccaaacagcagagcacagaacattccctagcagatgggcttagccagggaaatgggcagggaggaagcaggggtaggagacagcagggatttgtgagaactcctgtagaatgattagaggactagggtgctggggtaactggacaaaaacatctaataaagaagggaaaaaagaattacaaatgtgagctttgtaagtagcagatgtgagtgacaaaccccctccccgcaggcccctctacgttgcagagaaagcgagactgcaacgaagaagatgggcctcagcacaccccagcctgagctctgccccagagatgggtattctgtcacactagctccgctacagacccagcacttccttacaggattcccctgtcaccctgcctctggatggggaggggatgacatctttggctccatcaacattccagatcctgcaccaccacagaagccactaacagggtgggcagatgaaatctgcagagaagacagagcaggcaaccctgggaagaggcaggccaaggtgaagtatgcgacctcagcagcccagggaggagggcggtcagcactgccaaactgtgatgatgggcagatgtcaggaggatgcagggactcaagcagggccctgggcacatcagagaaagctacttggatagggtgtcgggagctgaatggatggggtgaggctgtgtgtggaggtggctccttgatgccttttggcagaacagggggagagagaggccaggcagtgactggagggaccccgattctgaaggggcctctataaaagacgagagggagcctcaaaggagggccagaggccagatgcagtggctcatgcctgtaatcccagtactttgggaagccgaggcaggcggatcacttgaggccacgagcttgagactagtcggggcaacatggtgaaaccatgttaggtctccaaatacaaaaattagctgggcctggtggtgtgcacctattgtcccagctgggcctggtggtggtgtgcacccattgtcccaagtacttgtgaggcagaggtgggaggattgcttgaacctggggggcagaggttgcggtgagccgagatcgtgctactgcactccagccagggcgacagagtgagactcttgtcttaaaaaaaaaaaaagagggccagggctgagtggggaggctgagcggcagcctgagcctcttgagcaggcagaagggctgaggccataggccaggaggaggcactcttccaaggggcatcggggcgacctgctagtgggacaggggaaaggagggcgggtgccgtttttatgcttgggaagcactgctttaatcacagagcactctaacatttaaaatacagcgctagtgtaaacggtgaaccctggatctatgagaaccttagctgtgtatggcctcttgcattgctactgaaatggaggctggttagcctccatccatgcctagaattcttccatcttatttatgataattattctaagtaaggggcttctggcagtactcagcccaggtgttatgttgtagttaaggaataaccatctaccacaaaaaatgtgaaatttaaatccattatacagctgttcatgtagaaggcacttcttaagattaacgcctacatctattctgtgatttctctatcgtggggcccttatgaatgtcacttgctgaattcatatgccaagaggcaggcaagtaccatcatctgcagtgcataaatggaagaacacaaattcacagggctgaacaatttacagatggcacgtggggaaggggtgctggagccaagactgccaagccaggcttctgggctgccccaccctgggcccagacaacacctgtttcacgtggtctgagccagaaaggtgtggtgccctctcaaaagggcatggccatttttgtggggaggcctcctcaaacattaatttcagtaagagtggtcagctggtcaatacttcccttgctttcttctttttagcagtaggactgagaaattacttaatagggaggctcccctctaaacagccttttcttatgcttcatccctaggaagtcagactaggaagatgaattcaacagaaaaagccttgcgaggtggtgctactgagggtagctgaagagatcaaataataataatgataatggtaacaagaagacaagaccagagatggctctcctcggctgtgaaaatgacagtgaacagatcttctgacgcagagctagcatttcaaagagcctcagcgtgtccacgctacctcgcacagctcattaaatgcgctccagctgcctgcttcatttatatttacccaactggggcatattagccacccccagtggataaggatggagcttctgctgtgtgggggaagcaaaacttacagaggcttcctgaggggccacagtgagtaggtgtgccaaaacgaccagtgcccaagtacccccagagtcgctgccactgttctgggccatctgcatctgcacctctttcacctacacgactgtgtctatccatctcccttcctcccatccccacaaatcttcaccaagcacccgctaggtgccagccagtaagctaagccagttgctaaggacacgggtatgtggaagctagacatgtctctgtccttaaggagcctgcagtctatggccaccacagtcttgtgagggaatgatggcagagagccagggtgctgtcagagccaggaggtaggcacctagcacagactaggtggaggcagggtgttggtcagagggaggatgcctaagctaagacctgaagaatgagtgggaagtggccaggagaagcagacggaactgtaggagcaggcatttgacgagcccagtgtggccaggctgttccaccctcgctcatcagcttacccagtgcccacacacaatgcactagctcctgcctccatgccttttctcatgccctcccacccacctggaatgtcttcctccttcctatcatccgtatctcccaatctggacaaggtccagcttacatctaactttctgcaaacataactccaatcatgattgtgaggctattacttcagtatcaatataataaatttgcacaatgtcttcatatttgcacagatatttgtaaataatgtgttcttattaattgacacccaattagagtctatatttctccagggctaggaaatctctttcaattctctttgattagtttggcattgagaggaaattagatgagcaaataacacatttatagagcacctaagaggtgtgaggtgctgtgccagctgtttaggtacttatgaaggcagcagttattttgaggatctaacagacccttagttaagaaggaaaatgggcccgcgacctggtgaattgcatcaactgcctatgaaatgaaatgagggttgcctcagacccacagcccagcatgacatcagggctctatttagatcttgcaggtgccaataattcaaaagtctgttgctccaacaaaggcactacaacatcaccttatgttgtagtattttgttttttaagggttaaaaatctaagcatcttagaagttcagaaacataaatgatagtaggattcagatttccaggagggaggtagagagacagagaggaagaaagcgagaagaaaaagagaagaagacctcatttaaatggtaacttgaagcttatatgaaaagtccaacctctttatgatgaccaaatataatgtgaatactcttgaaggtgtgagtccctttagagtctctccagaaagttctcatgggactctacgcaggttttctcagcatgactgctttttctagctctaatggggattttgagtgacgatgaatgaaggtgagttatatttccatcactcagtgtcacagattttactccacctggtcacagcatggacatcaaaagaagctttggcaagctgctgaggtgggagttaaatctatctcagggatcaacggtggctggtctaaacacaccacattgaaaggttagggaataatacagagctgcagtgagtttccttctcctgactttgcccctacatagaacccttagaagtatggctcattacatgagagttctgttcatcaccaacaactgactgagtggagggatgtgctctcccacagtgagtttgacagtcccaagctctgcaaattcccgaggaatgcattacagtagctacactggctgcaggatccaccccctggaacctgctgccaggccttccttctcaggagctgtcttcaagatcggcctccagaggcttcatgaagcttaggacccagggtccagaaatcccatccatcaggaaacagtgtcaaatgaagggagcaaggtgcatgagcacaaaacagcttgttacctctgccaggaggattttagaaatgggtttcttttctgatgtataacaatgttgcccttgttacttttactgaaaatgtaaattcagtaccacagactacaataacactttccatgtctgaaacattacccacctcccacaacgacaacaagcagcagatgttggttctcacctggttgtagggtactcttacaactctcttctcaaaatttaacaagattaatgacagaaaattagtcaagacaagtatttgcctgtttgggttatcctactatcatcttaattgtaggagaaaagtgtttccttttcacactacatacttagtggtaagttgatgtgaaaggaaaaacaaaacacagcactaaaaagagccccaacaatgcaatgtgctccacacacacacaaacacacacacacacacacacagagatacacacacatacacaccacacacacagatacacacacacaccacacacacaaaaatacacacacatacacacaccacacacaccacaaacacacacacagatacacacgcacacatacatacacatacacacaccacacacacagatatacatacacacatacatacacacacacgcacacaccacaaagacacaccacaaacacacacacacatacacatacacatacacacacaccacacacacagatacacatacatacacacatacatacacacacatacacacacaccacaaagacacaccacacacacagatacgcgcacagatatgcacacatacacacatacatacacacgcaaccccacacacatacacaccacacaccacacacagatacatacacaccacacacacatacacagatacacacatacatacacacacatacacacacaccacaaacacaccacacacacagacacacatacacacatacacacaccacacacacacaccacatacaccacacacatacacacataccacacacacaccacacacatacacaccacacatatacacacacaccacacacccatacacacatacacacacagatacacatacacacacacagacacatacacacacacatatacacacatacacacacacatacacacacacagatgctatcaaaagaaagcagttgtcataaggctgcctttctcaatacaaatgactgtgtaagaatttaaaacgttaccttacattttatcaggactgcatgtggtactgatctgcttccccgaatatcttctactaacccaaactcaaattaatgtgctattttctaataaatgcaaaacaaaaattattcaaattactcaagtgatgtcaaagacttcaagaggaaatatctgtgtcgattctaaatatacagatggcgacacgtgtcaagccttttcggagaacattacaacggataaattttaaaaacgataacaaaaatgggaagagacagcagagcttagaatagcaaaagtgagaatgttccagatgctgattggtgtgtctgatacggtacagcctcatgtaatatgaggcaaggacacaaagcacaacaagtagaactctgagctagcagaaagctttctagcttaattaatggcaatgctaatgagactagagagcttggctgtccttcaccctctacatctggctgttcaccaaatcccgctgattctaagactcaaatcaatcgctcctctccctctccatgttctcggctgaatgcagatcctcctcatccttagctggacagctccaacaagcctctagggaggaagcatggtggtttccctcaagctgtccccaccatatgagagggaataaggctaaccatgaaatctgcggaaatcaggatgacagtgggtgtttctgggaggactttctggataagctggcttttgggatatccacttgtgcttaattaagtatttacagagcaccgtcagctgttgagagcactgaggataacctgggaaggagacgatgcccacaggcatgaagacctgggtctgtgttcactgcaaatatcctatcacaaagttttttttgacagcatatgaacaagaaggataaaaagtgcacataaaggaaagaggagcgtcttgggtcacaacatactcatttcagaccctggctctgctactcccttgctgtgtgacctggggagagcactgaactgcactgtgcctcagtttccttctcagtgcaatagtgccccagccctggaaattaaacacagtaggggtgcggctcctggcatgcctccaggctcgccctaaccactccctgcgtgccgcggtgagcatgggctgtctctgtctgtcttggagcacatcctgccgttcttctgcaatagcatcctgctataggggaagaccctgctcccccgcattcaaacagtggactttcagtggggctgctcatcccagaatcctcacaccctgaaaacaggccaaggcctgggatccagtcccacgctggccacagcgacaggtctagggataactgcaggacccacaagggccagccacagtccttcctcaggatttttctaggtggattgttcttaaaggttctattcctcttttgactgtgtgaggctgtgtccccagaaaggcagtctagactgccctctgccatggggagcagctgagggatggaggcaacatcccagggcactggagccaagaagcagaggggccctgaaggagcaccaggtacctaaggctactctgagttcagtttcagttcctgaaaaacagaagaactctgactgctgggaaagtccattcacttttctccctttcctaatatagtactaaacagtttcactatgcttaagcctttattagcatagatacttcacacatttaaaaaataattcatgcgtatcatccttcgcaacttttggagcataacaggacactcctaataataaaatgtcatgtttgattcctacagagaacataaacaaaagtgcacatattttttaaagaataagatgttatgcttacatcttatttttctcattaaacttgtttaagtataatctgtgttattcacatatacaatataaatttgttaaaatatgttagagagttattaaaaaaagtaattaatgagagtggcagatattaatttctgctaaactatacgttttaattaaaatttttgggccaggtgcggtggctcatgcctgtaatcccagcactttgggaagccgaggtgggcggatcacttgaggtcaggagtttgagaccagcctggccaatatggtaaaaccccgtctctactaaaaatacaaaaattagatgggcgtggtggtccatgcctgtaatcccagctacttgggaggctgaggcaggagaatcactggaacccagaaggcggaggttgtagtgagccaagatcgtgccactgcactccagcctgggggacagagtgagactccgtctcaaaaaaaaaaaaaaaggagggttacttagaagcaacataaattttatatttgaaaagtataaaaaaaccctcaattccaaacataatcaatccaacaatgcatttttcagtccacaagagaagaaggccaatttttttttttgaaaaatgaggtatcttctttaaaaaataaaatagaaggccaaaagaatcaacataaccaaattacacttcaaagattattttatatcttcttgcttcctatctatatgctattttccaactccccatattatacgtaaaatttgaaaaagatcttatttttgccttaattttctataattaatgtcattagtttcctgcacaaagttttcatgcaaaacaaatttatgtaactcttggccacgaattgtcaatatttttcataaaattggaagtatattgagacaaaatgttcacaaaataattgggcagtatctctttttctgagtgttcttatttttgtttttaaaattttaattgacacattataattgtacacatttatggggtacattttgatattttgacacatgtatatgttgtataatgatccattcagggtagttagtgtatctctatcagctcatgcacatatttctttctggtgacaacattaaaaattctctcttccagctattttgacatatacaataggtattgttaaccttagacaccctattgtacaacagaataccagaacttatttctcctatcttattgttactttgtacccatttaccattctctccccagcctctttccacccatcccttcctcagcttctggtaagcaccattctactctctgcttctctatcatctttctttagatttcacaggagtgatatcattcagtacttgtcattctgtgtctggcttctttcacataacatgatgaaagaaatttggaaaattttccaaatttctttcatctttcttttaagatgtttttggccaggcgtggtggttcatgcctgtaatcccagcactttgggaggccaaggcgggtggatcacctgaggtcaggagttcgaagactagcctggtcaacacaatgaaaccccatctctactaaaaatacaaaaattagctgggcatggtggggcatgcctgtaatcccagctacttgggaggctgaggcaggagaattgcttgaacctgggaggtggaggttgcagtgagccaagatcgcaccactgcactccagcctgagcaacagagcaagactctgtctcaaaaaaaaaaaaaaaaaaaaaaaaaagaaggtgcttatattgagacaaaacatttaaaactaaaaaaagtaaaataaaatagtatttaaaaataaatgaaagtaaaaacatctttcttttttttttttgagatggagtcttgctctttcacccaggctggagtgcaatggcatgatctcagctcactgcaatctctgcctcccgggttcaagcggttctctttcctcagcctcctgagtagctgggataacaggcgcgcaccaccacgcccagctaatttttgtagttgtagtagagatggggtttcaccatgttggtcaggctggtcttgaactcctgacctcatgatcctcctgtctcggcttcccaaagtgctgggattacaggcgtgaaccaccgcgcctggccaaaaacatcttaaaagaaagatgaaagaaatgtggaaaaacttggtttagatgctgaccaacatctgacaaataacacaagtagggctggatgcagagcagagcaaaggccccactctacactgaaactttctgtattgctcttcaggagagtgaagggggaagatgacagccagaaccgaggcttcagcaagctcaggtgcatacctgccagagagctacaagtagtcatttctcaggtatacttacacaatggtttttccaatgtgcaagaatgatttctcgacaaattcccggacactatggacctccccagtagctataacgaagtcctccggctcatcattctgcaacatcaaccacatagcctagagggaaagagaggcaagttcactttgaagtcacactcagtggccacacattgttttccagtgcacataatcagatatggacatcgacagctggaacatgagcatgaatttcatagcatattctaagcacaacagcaatggctcccaacttttactgagtatccgaataacatgaggaacttcttggtgtggatgccagggctgcagccgtagaggggtgggctcagaggcctggagattctctctcagaatatttatccttaacatcccaggtgattctcatagtgcaggtcctcagaccacaacgtagaggaatgtgatgtgaagcagtgtctatggcaaataacctttttatggtattatttacaaaaagagcagttctaaaagcactgtttaatttttcttcatatcatagatagtagtcaaggaaaaaaaccatttaaagacaggtatttgtcctcaaaagtagaacttaatttttgaacaataaagttgagaaggtactagtcaaaaaacaaagtaagtgcgaatcattaatggaaaaacaaccacgtaatggagagtactactattataaaaaagctgtctgagaggcaatgaaaacatttatcccagagttaatgggttcataaggcagcatttcaaggccaggggctcaacttccacatcaaaatggatgtctagcagggcgcggtggctcacgcctgtcgtcccagcactttgggaggccgaggcgggtggatcacgaggtcaggagatcgagaccacggggaaaccccgtctctactaaaaatacaaaaaaaattagccgggcgtggtggggggcgcctgtagtcccagctactcgggaggctgaggcaggagaatggcgtgaacccgggaggcggagcttgcagggagccgagatcgcgccactgcactccagcctggacgacagaaccagactccatctcaaaaaaaaaaaaaaaaaatggatgtctatacaggttcactttctcagtaggagccaggagtctggtgggcaaaaatgccactgcatgtccaagatactgactggtggcaccagcgcagccccgctccccgtggttagcttttaccaacagcagataggcctggagttcctgtatctcgcaattgcaccttaaagatttttttttttaatacagataggagatgaagatttaaaaaaaaaaataagtgtagcaggaatccaacaggaatatgtctcttcaaaaaaggttgaagcaaaacaaaaaaaaatcaatctctattttttcatcacttccacccacttctcaaaataaaataggtaaaaacagtaaggacttaattataacacagcctccaatgatatgtgcattgaactctcgttccagcaaaatttaaacaaaactgtttggtttgcgtctccctaagttgttccttgataagccaaaaacaagaagttgctaaaatcaatgagccagcctattttctcttagaaaatgccaccaaaaaagtttaatttcctttttattcattggaatttgtagaaaacttctaaaaaataaaatttaaaataatttctcttttacctgaagttatttcctgtgtatgtttttgtatttttggtctattacaagattgttttaaatcatatggaagacaagattttggtctattttatatgctttggagatgtggcatgctggttgggacaatggtaatagtttcaagtcagtgatattctataaagtaactgacggaagaaattatcttggcgagaagacatatttgttcacattaatggaatacctgcaatttcattttgccttaagaaatcatggttggtgaactgagccacaagactttttaaatgttatactaccactactactactaatgataaagcatgagcttttaaaaggcatgaaatacaagttgttcactgttttgggatagtccacacaagcagatggagtctacaatggcttggtagctccctgaacactgttaaacactgggggctgaggagagcaatgagatctgaagtacagcccaggctcggcaccgtttgtcaagaagttccccaaggtgtctttctgaaaggggcaccaaggcctgtgtgcacgagcagaggcctagtgagcagctgctccttgtaggtctgtgcctgcaagtgaaattcccgcggcctggaacaccctgtctcctcatctgtctgggaatgctgacctctctctaggtcccggaccagggtcccaagtctagccactggaatgaattccaatgcacacagtatggtggcttcaccgggatcgggcctgccctttggcccgcttcccaactaagctgagcctcccacttcacccaagtgggcgcacgagtgtacccgtggacacacacagaggcacacgtgcacacacacacacacagaaacttattttggcttttgccaaaataccttcagaatttttaggaaaaattaaatgatgcctatggctagaattcctatctgaacgttcttctgcgggattagatgtaagggggtaaatacactttaatgtgtttgactcaaatttccattctaaaaataacatctcaaataggtctttcagggccactcagcttattttacttctttagaaacagtccgctgtgttagagtggtctcaaaaaagtcctatttttagtcatgtgaaagaagacaaggacgtgctaaaaatgtaaaaggagaaacttgactgttggctactggtgggtcacttggagaaacatgactgttggctactggtgggtcacttggagaaacttgactgttggctactggtgggtcacttggagaaacatgactgttggctactggtgggtcacttggagaaacttgactgttggctactggtggatcacttggagaaacttgactgttggctactggtgggtcactttaaacaccggcccgggtcccctggtgcttgttttgttcccggcaggaatctagggatcagtcagggcctctccttttactagagcaagagccaagaatctgctcttttcttctccatcagactatctgtggcctttgacctatcaatttctaggcatttcctctaaagttcatattgtaccagactccagtctgggaatgagaagagaaaggatatacaactccagatttatttgttattactgaatagtttactggtttcaacagagggatagggctttgtttaaatttccactgagcataattaatggttattgactggtaaatgaagaacaggtgacactctggattagaagataaatgatcctgtgttctggtgtgataatgggttagtaattcaccacaaagccgaggctgagtgcatcccgtcgtaatgctagatcatgtccaggagacaaaggcccctgtgtgagaaggacgcagccatccgcctccttatacagctgcacacgttgatgtgctccattgattccctgatggatggcacaactgaggcaaaagttcacccgttctcaccttcctgttcacatgctggaccacatgacccatgacatggccaggccacactctgtgatcaaatcgccacccagctttggcttctgactagagaaacagtgttgaggttacatgttttagaggtcagtcttctctctttgtctctcaaggaatgaaggaggaaaaagacagtcttcctgcattcttttggtgtcctttgaggatgtgactgacttgtccacttcctcaaatacttatttactttcagtcctgacctgattaccagtgcacatgaaaaaaatctcctgttttttaatccatctcacagagaggaaagcaaatcagttaaggaatgtgccagggcttcagattctttaacataaaaatgtcccttaattgccaaaaaaacagggcagttttcaaatcatgtcttgcattcattttgcttttaagcaaatgaagttcaagggaaatctgactccagaccattgacttttgatggccaagtcaagatgggtataaatattacttaaatttggacacgtactcttctgtaagtatataattaatctatctgttctacaaatccaatttggagaagtaaaaataaaactttagttttatttatttatttatttatttattttttgagacagaatcttgctctgtcgcccaggctggagtacagtggcacaatctcggctcactgcaacctccgcctcccgggttcaagcgattctcctgcctcagactcccgagtagctgggattatagttgtgcgccaccatacccggctaatttttgtatttttagtagagatggggtttcaccatgttggtcaggctggtcttgaactcctgaccttgtgatctgccggcctcagcctcccaaagtgctgagattacaggtgtgagccaccgctcccagcctacaaaacttaaattttaaaatgtcaaataaaaatactcctctctcacagtctcccatttggtaatttgaggggtggatgcagaagtggtttgggaggctcaggaagggccactcccctgcttgggaagctgccagctctggtggctgttcagagctggaccaatgaaggagaacactcaaagtgcatcaccacagccgactgactacacctgattccgtgcatgccttctgtggtgggatgtgtgtttgtcttaaaaatctggattctacaattgcttccacctcgacgttaacctccagttcagtatccaagccacaaacacttattaactgagctggcatccatgaataacaagatttgttaatgaaggttatgtttaactatgtctatttgactgttactttttcaccctggtgcttttgtgctttacgtgctactgtcacaaaaaccttaaaactacacacacacacacgctcatgcgtgtgcgcgcacacacacacacacacacttatgtatgtatacgcatttcaggggagaacatgtatgaaataactctaataaaaatcatggaaatttgaacaaatggaaattaaagttccagagaaaggatgcccagtgtgtacccattcacatgcgtttcatctctaaacattatttagtagctgttttcatgatggcagcctggtatttagtttgagtcaggacctccagtagttttgtggtcagccaagccttattctttgtggaattcacataggtaggtcttaggtctttgggttagttttaattaataaaactatactaataaaaacaaacagtgtgaaaccaaagtctggccttatggctatgtctattttcttcctgggcaaaaacgctgtgtcacacggattccttagattaagggacttttagacgttttaaagatacgacgttactgaacagaaaaaaaaagataataaattaatcaaaggaccaaaaataaaagaacacaacccagaaagccatatagctcttgcttctttctttgctaacatatcattctatatcaacaccatatgtactgaaagaaagaggcaatgtcaaaatttgttttgccctttatcttttaactctagccaggaatacacagctaaaaactccaggttggggttaatgtttctcttccctagaaacaatataaaatcgaacagctcctagtcttgtgttaatcattctgaatcagttttctaggatattatctattctttcaatttgcagattctagttatatatttatttcttctatttatctttgaatatatcttatctcttctattcaatttctttttcatgcacatcaattatgcatatatctcttttgttttatcttttacatctatcacctccgagctaatcatttttgggttttgtttcatattaatttatatgatttcctccagcctgttcacctgattgttttagtaaaatttattttatattttgttggtaacatggtttcaatttctgtaagggtttttttctcttccatacttttcctgtttactaccaggttgctttttatctttttgtgactttatttaagccaggggacagacaacttttttcttctaaagccagatagtaagtattttaggtttgtgaaccacatggtctctgtttctctgctgttgcagcacaaaacagccatggacaaaatggaatcaaatgggtatgactgtgttccaataaaacagttacagggcccatggactacgatttgcccacctttgctttcagcaaacttaacaaaaatatgttgcctgtaatttctttgactctacagagaacaattacccaagctctagctgctaatttttttgaatgataccccttatgatatgcacaatgcatctgtttgcttatgttccttttcttcttcttgcaatcctttccccactcacactcaagcatagattctggggtagtgcctttctacttattattatacttgaacaaggctggctgttccctgaagaatcttaggagggggaacaggaaagtacactgaggacagcctgcagctttaattcaggcttctctgaaagccctctaccaacttcattgcacgctttgccccaggacgtggctgccacaatttctcaagattttgctggtgagtgtgattagtggaaaggagcccatgaattgtagggctgccctggtgctctctggcgatgtttgctttcactttgcctttaccccagatcacaatctgcggtgttccttggctaggaggttatgccagtgacaataaaattggcttctggctggttgtagtggctcacacctgcaatcttagcactttgggaggctgaggcaggcggatatcttgaggtgaggagtttaagaccagcctggccaacatggcaaaaccccgtctctacaaaaaatacaaaacttagctgggcgtggtgggggcgggggcacctgtaatcccagccacttgggaggctgaggcacaagaatcacttgaaccctggaggcggaggtggcagtgagctgagatcatgccactgcactccagcatgggtgacagagactttatctcaaaaaaaaaaaaaattaaacataaaaaaaagaaattgtcttctccttcagcaacaccttcttgccactgtgtagtgtacaagtgggtatctatgaggatagtttctgcttctctctaataggtaatactattttatgggttttttaggactgaaattattttgtgcaaaattcatagcctgtgtgtatagttcctaacatctgctctaaattttcttcaaatgtcatggtatctgtctcaaatactttttcattttttttgtagacagggtcttaccctgtcacccagactgtagtgccgtggcatgatcgtagctcactgcagccttgaactcctggactcaagtgatcctccagcttcagccttccaagtagatgggactacaggcatgcatcaccacacttggctaatgcttttaatttttagtatacaaaaatactaaaaatgtatgtatgggctacattgttcctggcctcaagaaatcttcctgccttggcctcccaaagggctgggactaaaggactgagccaccagcctcaaattattaatacctcatatttcaagttgtgtccaatttcattgttataatgaagcagaagtttcctcttaactttattatttttcttgatttcagagggtttcaaaaaaaggagtgttgaatgaaaatgtccttatatttagtcatttaaaaatatatttcttgaagatggctgaataggaacagctccactctggagctgccagtgagatcaacgcagaaggcaggtgatttctgcatttccaactgaggtacctggctcatctcattgggactggttagacagtgggtgcagcccatggagggtgagccgaagcagggtggggcattccctcacatgggaagcgcaaggggttggggaactccatcccctagccaagggaaaccttgagggactgtgccatggggaactgtggattccggcccagatactacgcttttcccatggtctttgcaacccacagaccaggagattccttcgggtgcctataccaccagggccctgggtttcaagcacaaaactgggcagacaccgagctagctgcaggaggttttttttcatatcctagtggtgcctagaacaccagtgagaaagaaccgttcactcccctggaaagagggctgaagccagggagccaagttgtcttgctcagcagatcccacccccatggtgcccagcaagctaagatccgctggcttgaaattcccgctgccagcacagcagtatgaagttgacctgggatgccagcgcttggtgggggaaggggggtcgccattactgaggcttgagtaggtggttttcccctcacagtgtaaacaaagccatcaggaagttcaaatgcggcggagcccaccacagcttggcaaagctgctgtggccagactgcctctctagattcctcctctctgggcagagcatttctgaaagaaaggcagcaaccccagtcaggggcttatagataaaactcccatctccctggaacagagcacctggggaaaggggtggctgtgggtgcagcttcagcagacttaaacgttcctgcctgccggctctgaagagagcagcggatctcccagcacaacacttgagctctgctaagggacagactgcctcctcaagtgggtccctgacccccgtgcctcctgaccgggagatacctcctagcaggggttgacagacacctcacacaggagagctccggctagcatctgatgggtgcccctctggaacgaagctcccggaggaaggaacaggcagcaatctttgctgttctgcagcctctgctggtgataccaaaaaaaactgggtctggagtggacctccagcaaactccagcagacctgcagcagagggacctgttttttcatttgtttgtttgtttgtttgagatggaatgtcgctctgttgccaggctagagtgcaatggcgtgatctcagctcactgcaacctccgcctcccaagttcaagcgattctcttgcctcagcctcccgagtagttgggattacaggcacatgccaccacacacagctaatttttgtatttttagtagagatgaggtttcaccatgttggccaggatggtcttgatctcctgactttgtgatccacctgcctcaggctcccaaagtgctgggattacaggcatgagccaccgtgcccagctgggcctgactgttagaaggaaaactaacagaaagaaatagcatcaacatcaacaaaaagaacgtccacacaaaaactccatccaaaggtcaccaacatcaaagatcaaaggtagataactccacaaagatgaggaaaaactagtgcaaaaaggctgaaaattccaaaaaccagaatgcctcttctcctccaaaggatcacaactcctcggcagcaagggaacaaaactggacagagaatgagtttgatgaattgacagaagtaggcttcagaaggtgggtaacaacaaactcttctgagcaacaggagcatgttctaacccaatgcaagaaagctaagaaccttgagaaaatgttagatgaattgctaactagaataaccagcttagagaagaacataaatgacctgatggagctgaaaaacacagcatgagaacttcgtgaagcatacacaagtatcaatagccaaatcaatcaagtggaagaaaggatatcagagattgaaggtcaacttaatgaaataaagcatgaagacaagattagagaaaaaagaatgaaaaggaatgaacaaagccttcaagaaatatgggactatgtgaaaagaccaaacctacctttgattggtgtacctgaaagtgatgggaagaatggaaccaagttggaaaacactcttcaggatattacccaggagaacttccccaatctagcaagacaggcgaacattcaaattcaggaaataaagagaacaccacaaagatactcctcaagaagagcaatcccaagatacataatcgtcagattcaccaaggttgaaatgaaggaaagaatgttaagggcagtcagagagaaaggtcgggttactcacaaagggaagcccatcagactaacagcagatctctcggcagaaaccctacaagccagaagagagtggggccaatattcaacattcttaaataaaagaattttcaactcagaattccatatccagccaaagtaagcttcaaaagcgaaggagaaatgaaatcctttacagacaagcaaatgctgagagattttgtcaccacctggcctgccttacaagagctcctgaaagaacactaaatatggaaaggaaaaaccggtaccatccactgcaaaaacatgccaaattgtaaagaccatcaacactatgaagaaacttcatcaactaatggccaaaataaccagctagcatcataatgacaggatcaaatgtacacataacaatagtaaccttaaatgtaaatgggcttaatgccccaattaaaacttacagactggcaaactggataaagagtcaagacccatcggtgtgctgtattcaggagacccatctcatgtgcaaagacacacataggctcaaaataaagggatggaggaatatttacgaagcaaatggaaagcaaaaaagaaaaaaaagcagggggtgcaatcctagtctctgataaaacagattttaaatgaacaaagatcaaaaaagacaaagaagggcattacataatggtaaagggatcaatgcaacaagaagagctaactatcctaaatatatatgcacccaatacaggagcacccagattcataaagcaagttcttagagacttacaaagagacttagactcccacacaataatagtgggagactttaacaccccactgtcaatattagatcattgagacagaaaatttacaaggatattgaggacttgaattcagctctggaccaagcggatctaatagacagctacagaactctccaccccaaatcaacagaatataatttcttctcagcaccacattccacttattctaaaactgaccacataattggaagtaaacactcctcagcaaatgcaaaagcatggaaatcataacagtctctcagaccacagtgcaatcaaattaaaactcaggattaagaaacgcactcaaaaccacacaaatatatggaaactgaacaacctgctcctgaatgactactgggtaaataacaaaattagggcagaactaaataagttatttgaaaccaacaagaacaaagacacaacacaccagaatctctgggacacagctaaagcagtgtttagagggtaatttatagtactaaatgcccacaggagaatgcagaaaagatctaaaatcaacaccataacatcacaattaaaaggactagagaagcaagagcaaataaattcaaaagctagcagaagacaagaaataactaacattagagcataactgaaggagattagagacatgaaaaacccttcaaaaaatcaatgaatacaggagctggttttttgaaaagatcaacaaaataggtagactgttatccagaataataaagaagaaaagagagaagaatcaaatagacacaatataaaatgataaaggggacatcaccactgatcccacagaaatacaaactaccatcagagaatactataaacacctctatgcaaataaactagaaattctagaagaaatggataaattcctggacacatacaccctcccaagactaaaccaggaagaagtcaaatccctgaatagaccaataacaagttctgaaattgaggcagtaatacctatcaaccaaaaaagtccaggaccagatggattcacagccgaattctaccagaggtacaaagaggagctggtaccattccttctgaaactattccaagcaagagaaaaagaaggaatcctccttaactcattttatgaggccagcatcatcctgataccaaaacttggtgagacacaacaaaaaaagacaattttaggccaatatccctgatgaacatcgatgtgaaaatcctcaataacatcctggcaaaccaaatccagtagcacatcaaaaagcttatccaccacgatcaagtcggcttcatccctgggatgcaaggctggttcaacatacacaaatcaataaatataatccatcacataaacagaaccaatgacaaaacccacatgattatctcaacagatgcagaaagggccttcgataaaaatcaacaccccttcatgctaaaaactctcaataaactaggtactgattgaacgtatctcaaaataataacaaaataataacagccatttatgacaaacccacagccaatatcatactgaatgggcaaaagcattccctttgaaaactggcacaagacaaggatgccctctctcaccacttcttttcaacatagtgttggaagttctggccagggcaatcaggcaagagaaagaaatcaagagtattcaaacaggaagagagtaagtcaaattatctgtttgcagatgacatgattgtatatttagaaaaccccactgtctcagcccaaaatctccttaagctcataagcaacttcagcaaagtctcagggtacaaaatcaatgtgcaaaaatcacaagcattcctatataccaataatagacaaacagccaaatcatgagtgaactcccattcacaattgctacaaagagaataaaatacctaggaatacaacttacaagagatgtgagggacctcaaggagagctataaaccactgctcaaggaaacaagagaggacacaaagaaatggaaaaactttccatgatcatggataggaagaatgaatatcatgaaaatggacatactgcccaaagtaatttgtagattcaatgctatccccatcaagctgccactgactttcttcatagaattagaaaaaactactttaaatttcatatggaaccaaaaaaatgcccgtatagccaagacaatcgtcagcaaaaagaacaaagctggaggcatcacactacctgacttcgaactatactgcaagaccactgtacccaaaacagcaatggggaaaggattccctatttaataaatagtgctgggaaaactggctagccatatgcagaaaactgaaaatggaccccttccttatgccttatacaaaaattaactaaagatggattaaagacttaagtaagtcctaaaacaataaaaaccctagaagaaaacctaggcaataccattcaggacataggcatgcgcaaagacttcatgactaaaacaccaaaagcaatggaaacaaaagccataattgacaaatgggatctcattaaactaaagagctgttgcacagcaaaagaaactatcatcagagtaaacaggcaacctacagaatggttgaaaaattttgcaatctatccatctgacaaagggctaatatgcagaatctataaggaacttaaacaaatgtaaaagaaaacaacaaccccctccaaaagtgggcaaaggatatgaacagaattaccataaacaatatattccccaattatgtgaccatgtaaataatgtatgaaagaagcttaatgaaaaatacacatataaacaaaggctgtttcactgtctgctgatgcttaataagccatcccaaagcttcatggctgcagccttttgttctggtttttttttttttttgagatggagtttcgcttttgtctccctggctggagtacaatggcgcaatctcagctcactgcaacctccgcctcccgtgttcaagcaattctcctgcctcagcctcctgagtagctggaattacaggcacctaccaccacgtccagctaatttttgtgtgtgttttattttagtggagagagggtttcaccatgttggtcaggctggtcttgaactcctgacctcaggtgatctgcccgcctcggcctcccaaggtgctgggattacaggcatgagccaccatgcccggctggctgcagccttttgattgtttgtgattcagtgtgcaggaactcaagagggctcagaggacagttcctctctgctcccggtggtgatggccaaggcggactgactggggcagtggggccaagatggcctccctcacaggtctggtgctgggtgctggatgcacctcagttctcctccacgtggccattctccagctaagcgttctgacattgttcattagtctagacgatgcttctttacgtggtggctgcttccaaggtggcaaaacaaaagccacaaagcatcctaaggccttggcctggaagctgtccagttcacttcctccgcacgcattggcgacaggatcagcccaaattcaaacaaaggggaaacagactctcccccttatgggaggggtggtagagtcacactgcaaaaggacacgcaggatgggaggggttaccgtagccatctctagaaaaaaatctaccacaaagagctatcttgtgataactctaatgtcagctgattgtttcaatatagcaatgaagttattattcttgtctctaatataaacattgcttcagcttgcagtttttaattaagctccatctatctttaacatcgtgcagtgacaggtttaaatgagggcaaaaataactcacgacgcatacacctgggatatgggagctcactttcaggtcactctaatctaacgaatgctctaactggcccaataccactgctgtcacaacgtacttcccagaagtggttgtttcctggagcgtgccaagccacctacttcagccaggtgtttccaattatcttctgtcgctcggatacctgggtaagccattctagaattagttcctggcccagtaggaacaacataaaagctctgggcatgcaggaggaagtttctttacactcatgaccacctgatccttcatctccatgctcttggctcctgactgtgctacctaaatctgttcctgggaagccattatgacctttctatgaccttattcttcaagctagtcatcctgagcacctgattctgcctcttggtctaactctgaccttgggaatttaacctctgaactgattctaggcccactaggtttcttggttgaagtgttgacaatcactgttaccagaaaatatcaacttatggacatcacagtgcgtgcattaaggtggatgtagacaggactttcaggattattctaaaacagcactgcccaatagaaatataatgtgagccacacgtaatataaaattttctatcagttgcattgaaaaagtaaaaagaaaaggtgaagctaaatttgatgtttcatttaatcgaatatatccagtatgttaccatttcaatacaaaatatgattgagatatttcacgttccttttctatgtaccaagactttgaagtgtagcctgtcttttgtcctcacaggacatctccactcagaagaggcacaatttgagtgctcagcagacacacaaggctgtggctaccacgctgggctgcgtggggctacagagccagccttatgttcaagagggagaaggaaccttgctatgtgacaccctactctaatcctgtttgcttatcctgctaaaactctctgccggggcttcttggagaaggcctcctcattttctccacagcacggctggaggaataatggcccctcctcccttcttggtcattatctccacctcctgacttcttcagtagtgatttcatcagcgatgacaactgggagagagtgagtgtttgaaaagtagcacaactagctcctaatttacaggcacttgacgtttgaatgcctgcctgcctcatccatccacaaatgggcactcataccacactctctccccaattggaatacctgggagtaaacacctgagaaaccctctggagtttggtgaaatgtagtgctgcagagggggtaggtgttctcaaacgttagcgtgcattagaatcatctgtcaggctagaagtgtgcactgcaatcctctggaagattagaacgcaggctgctggcccccttgaggcctggagctacagattcaataggcctgggtggagctggagaatgtgcaagttccagggtgaagcaggaggctgctgatctgggaagcgcgctgagaaactctgtgtctagagcttgggctgggaatcagaaacccgcgtctaagctccagccccactattcactgggtgacttctggattacaggcgcggtggctcacgcctgtaatcccagcactttgggaagccaaggcaggtggatcacccgaggtcaggagttagagaccagccttttctcaaaaaataataataatccctacctcagggggctgttttatgtatttattatttttgacacggagtctcactgtgtcgcccaggctggagtgtagtggcacgatctcagctcactgcaacctctgcctcccgggttcaagtgattctcacgcctcagcctctagagtagctgggactacaggtgtgcgccaccacgcccggctaattttttcatcaggatgatgacaatgatgattacgtatcttgagggagttactggtgcccaggagaatgtgtagttcatctccacaaccaaactcttgcacccataaatagcatggggaaggaagactgatagggtggagtgaattaaatcctgattatgttagtcacagccacagaatttaatagctggaaggggccttagaggtgttgtcattcaattccacaaatgttaaagatgaagcagctgaaactggagagattaaatggttcacctgaagtcatacacctgctaagtgttagagctggggctggaacctcaactccctttcctgtattcttgcgactgcatgatgctcttgtgcattctcctaatggctgtgtgtagaatacattttcttgttgaaactcaattctacgtgctggttacaaatagctgtgtggacttttgtgagctaacctggggacctgaccagacaagaaatgaatgtttacagtgtgcctgctagttgctgggcactgtgctagagtctggcgatagaccacgtaggaacagacagggaagacactgtgcctggcctacgtgctttaaacatttatataggaaaaagcgttttaaaagtccaaatctgatttaagaaataacttttgggacagaggcttcaggtagttatcagggaactatcaggtatggctcctttctaaaaccttcctcctaataagactgtccccacacactgctcttgatgaaggagtgagtcaagccaggtgtatttaaaccaggtgatgtgtccctgtgcctactgcgccccagccccccaccccccaacacccttcggtttccatggatggagacctaacatattctgggccaatgggaatgtcaaagacatttgcagtaagagacccagaggcagaaacagcaggaaagggctgagcacccaggcgtgagactgtcaccggggcggagccagctggagagactgggaggcatgaagacctgtgtgggcagcagagtgggaaagggagcccacgaggagggagggagtgagggagatgtgcagacacagaggaaagcagatcctcctttcccattcctgcgaggtgccctgaggctccttacaaaaaatcccgttttccatgaatttctttgagttggtttctgctcctttagcaaacaagtttggataaagagcaaataggacttctggaccacgagtatatgggaccagttgtgtatcagctctgtattcagtggtaagaagggagctccaggggggataagtcaccacctgttgacctcagtatccagtggggaagatggccacttgcccagccagccactaaaatgatgggagaggggccagtgtgaaaggagctgtgggaacacagaggagacaacccagtacaccagaggaggaggagtactcagggtcctcatgagggtgtcatcaacccatggcccccgcagtccccaccgccgaggaccgcccacccttgagcgcctctaaagatggcaggctgggacatgcaccgtctttgtaactgggaacctagtgtcctatgcaacttgttggttaaaactcatttcaaatgtgtttccccagtgtcttcattcacaaaaatctagatgtcaagttaaaagtcactcttccactcagtactctgaaaaacatgctgaatataattagatttaatcattcttcttttaatttttgtttgctaatctgagaatgtcccactatgaggagtatctgagctttgttctttcgggtggtccaattgctcttactaacttgacctcacccgggactgggatggtctgttggcataatgatttcccagatgctgactctgcaatgtcctggatcaacacagatgaaaagggaagccagttgtatttaagaaaacaatgattgtaactgtaacatttgagtgtagtgataaaggaggaaagaaattctactacatacatgcaaagagtcatctagagaaacctccccttccatggaagggcctgtccacatgactgaaaattaaacaaaaggccccctgtgttctccaagattcagaataaaaatcaagagcgtaccttgaagttcaattattttaaaaacacattatagatgatcaagggagtttttaaaaaattaagtctacttaattctagatgaaatctggaaaaacaagtagaaaaagcctacaatgaattaacacttttaaagtatttaacttatcgagtatttgaaaactctaaaatatccaaaagataatttaaaaaatctgtgagaaacttaaattatcaggtactgagaatgaacatttattttttggtgactaaaattctcagtagtctgacaagttatcaacggctgctcaagactgttaacaagaaagcctgtctaatactatacagcaccataagtaatgtcatttacgccagtgctaaaggtcgagttctgaggagcaagcttttctgttaatataacacagcatttttcacatgcatttcatgtgaatgaacaatgtcttcattgtttgcctgaacactaatttaatgttgtattttttttgcttgtgtcaatgagtgtcaaaatattgttcttttaatacatgaaagtatttgcatagagctttattactgatcttcagatgttagccagaggcaaaataaaacagagacgctccagttgggaaatctcgctcacaatgaaaagcaagagtccttaacatattctgctctcctgccaatttttcttccaagtacacaatgatttatttactccataattggtgaaattaaaagcaacactggagacgaaaaaaaaactataggaaaccctttccctaaaaatgaaacagagactttgcaaggaggaatacaaaaactctaagaggaagtactaagatgtaagatcttaacgtgaattaaaggacaatctgatataaacctgattacagaaaaagccgagaagcacagtctgtttcaaccatgaagtgagaaacacagaggcaatttttattaagttatgcctttcagcatcatctcatcattaaatgctcaattgcttataaccgtctgcatttattaagaaaaataaagccaccacattttctgcctccacaaagttgaagagtccataaccaggtatcggatgtggttttcaattctgttttttccctccctaacactaattatcctgccatttggtactgccaaaaaagacaaaatgccctttcagagaggcatgggctcctgctgacgggttactcacgacgaaacttcagggctgtacccgggttgtggtcaggagtgagcagtcccagagctggctgccagggcaggctggtaaaggccatgctcgcacggcgagcaacccgaccagcctttcaagtcaagtgttggcttgtagacatataagttaatcagctatgaaataaccaccacaatgtacttattgatcacacagggcttatgatgaaactcttggcccagggaagatttgtgcttctttctttcagcctccaacctaagagaaagagcactttgaggtggtgtttacgaaaaggcagatgttaacttcatgatttcaaccttcccttcctggggaggatgagaaacacgctgggtcttcaaaatgaagcccgacacattcgcgtccctgttcattttttacagaacttgacattttcagtgtattgtggttattattaaggaagagtatttagaaagtttcaaactgataaattttaaatgtgttaccctaatttctttgcttcgagacattagggaatgctgatcattttgtttataaatcaataatatcaaagaatagcaattgaatgtttgctccaaaaatcaaaaccatgttttagaaagctggtagttttaaagtgctagtgtatgtacaagcagaatgtttagtgtacttttactgctcttgaaaatgagctggtaaatacatgtggtaattatactttctgctcaatcttcggttcccatttctaccaaattctttctaagatcgcaaagggaaagacaaggtgggtgaggctgactggtgctgtggacacgtgcgaagatgctggcagatgtgggccacgggccatccagaaacgtgaaaagaaaccagtgtcttttcccactaggtcagccccattgctctgagctgtcttctaatgtgcatcttcttaaccaaaaatgaaaaagaacaaattcagttctgatttcagtgagaggactatgcaaaggggctgaagaaccagtgacttaggtcttcaagggaagcattcagtaagtcaattctccaggggcatggagataaaaccccagcgtctccccaagagtaaacctactggcaagtgataaatcccccacttccagggcgctgcccttactgtctggcgaggccacagactgcaggtggacagacattaaaaaccatggtcagtgtgagaatgaacatgatggatggtatgacaattatgcaactgctccttcctcttttctttcacatagattgccctgtgtgtgactgactccagaataaacagattttttaaagatctagtatttctaacagtaaaatggatttccggtttgcccagggggaacaatgggacatcccagtcatcatggtggcatgaaatctagaaagcggaagaaccagtttctccattggtacgaatctgtctcccactcagtagctcagtttgaaactttgctaggaccactagtgaaagtagtgaacatccgctcctgagagtgaagagtgctccctgtctccacactgggggcacaggtggagggctcccttggagggagcagtgccatttgctgaagctgcgatccactggagctgaggcaccccctcttggcaggcacccctgctagtttggagggtctgcaggggaaagacagagcgggcattgtaggcctgcctgctgcttgtccggtacatctcctcgtagtgctactgaggctgggggttaagagtgaaggagcgaagaaaaaaaaaagctgtttgtttgaaatgattttgttcccagcagtaaaaacagtgctggtaactgagaaggcctttctgtgatcacaaatgtacattcatacaagatgggagacaactatttaaagctgggaatgtgctgtgagggtgaatacgaaaacatgcactcaaaacggaggcccgtgtgtgggatgtgagagccgagaggttcacagaggcaagagatggaggctttatgtgtttcttcatctttccaaatgaattatttttacaggaaaatactcgatgataaaggatagtcttaatatcatgtagtgaaaagaacttggactgaagtcctaaaacgctgggccctgtctggaataggcttgtcactttagacaacttactcatttcacccttgattttcttacacaggttatagggttttaggtatcccatcagataatatgttaaaagcactctgtgatctacaaaatgttattgctgttataaatgataatattattggagaaaatcctgggttaatgcctaagagatcatcaccgctccgtaacgatcgtcaagatatgatgtgataattccatggggctgttatcataccaaacataaaaacgctgcatttttcagagcatgaattctttttgaaagatgagttttagaactgaatctggggtttcaacatttccgttctaaagaatttctgattccttgcccaaaatcgtttggttatatttaagttctgaaagaacacaaaaatcctggcaatttatatgtttgtctcaacatgcgggtttttgcaatttcaagaaaataaatttgtattatataggtagatagttcagaggagctgtctttttttctgagtagggagcttcatgaattattgttaaatagtgttcctttaatagtgttgctaaatagtaaacagctgtgggcacatttttttccccccagtgtgacttctcaatgaggaagaaaccttaactgacaggagtgatcagaagatttaaacaatttaaatcttttaaaaaacaaaactaaaccaaaaagaaaaaaaaaatttacaacagatcagttaactggagattgtgctttttggaaccggattctaacttaagcatggtagcaattctaatgctatcttttattcaacaccattttcctaattatcttggtctaaatgtttccaaactttgttgtttattttggcataaagagttcccaaggccaccgcctcttttcctagagctggggatggtgttaacaagaaggtgagatgggaacacaacccattaacaagcactgagaaggctgtggtctgaaaaacccctcgagcagataagaaggcgctaggcaagagtgagcccaggaagagagcaaggcagagcccccacaaaaatattcattcgcattgtttcagtgaagataatcagaaggatttccctcaggtttcttataaataacattcatttcattgtctaattttacagatggagaaactgagacatgcttggaggactgacctgcaacagggtcacgcggcggctgagcaggaacagaaggcaaatttcctggtccctgggccagttttccacccaatctaccccgtctaaatgaaacggcagaagcttagttttgataagcagttccatgaaaacatgtcctgtgccagattctcgctggtgcccgagacactccccgatggagggttagggctcggagccctttaactccttcggcacagtggagaaaggtttaggaaatagcagaacaaacgcaaaggccttgagaaggcccttgcgagactcagcccaggactcttctctctgtcctatcttcagccctaaagcaaagggctgaggatgtaagaaggctttcacctgggtccttcgaaacatgcctggtgcctttattaactcctctacttcagaaatcagctgcaaacgtcctctctcccagtgggcagagcggctgcactatatgaaaacgacacatgtgaaatggagggtgggtatgtgaagctcaggatgattcatggattcgctgcccgtctgtttaaatgtaatactctttcagtgcatcaagatacctgatgccatgattaatttttgtgtgtggcacagaagcaaggagaagttagctaatttaagctgatgtgcattgagtcactggaaattggacaggagcaaagaccacagaactttcgaggcagcagattcatttgggcttcaggaaacgcggtgcatgagctgtttcaggtgctggggaaaggctctgcgttagaacccacaccttccgtctcccgggccaggtctctttgtaggccaccacggagagagaaaagcatcttgagaatcctaatgggaaccaatgaagaaatgagtatcatatttatatatctgctataactcactttctaatgaacaaagtcgcttactttgaaaagtgatttctctcttgtgtatggctcgggaggagggtctaaggtgggcctcgctactccagtgcctccggagcccagggaagctcacctcaggcagcctgcagaggctctccccttctagaaggcccagcaagcgccccgtttcccacagacggttcccacctggggatgttgaaccagtctcaccagatctgcttacacggaggagctgcacatcgaacatgctaaaaactgcgttatgttttttaaaaacccaacaaactctaaaatgttagctgtgggctgaaacactgactggactaaacaaagcctggcaatgggccagatctggtcagctaggtctcccagctcagcaatctggcttaaaggagcaccgggtaagggttctttatttcctgctgaatctgacttaagtgtaaaatcgagcagggatccccaaaccttcctctcacaccacagctgtagggcacactgaactttattctgttcagtagaaaatgaaatgaacaaactataaaatgtagctccttagatttgtttataatacagattcaatatttaataatacttttgttttcctagttttctgaaattcttcatatacgaaatgtaaaccacaaagggaatatgattttaaaaccggaaacatattttccacccaccacccccccaaatttcattaaacgcataaaagaaaatatcctttgtaaaatggctaattacaaaataattagtcacagaggtcctgtataacagaaacgacaacaactcttaagtttcagtcatcaagaatcaaggaacttattatttgggaaataaaaataccagttcaccttaaagtaaattttgggttaaaaggaaaaaaagatggccaagcaaagtcaagttattacttcaaccttatgccctgtccatcttttcaaatgtacttcagataaaaacaagcaacaagagcagaatgtgctattggtggccctcccttgaattcttctctgagctgccaccactcccgagtctcccagactgacctctgagtcaagccagatgggactgagagagatgttaagcaagtgctgaaaaggtgacttgagtctctggcagccgagtctggagcgagtttctctgcaaattctctgggggttgttgctttccaatttctcaggaatgtttaattctcctcatcccttcactgaatctctctctggagaggtcagggaagcctgtgacatccccggagggcactgcctaactaaattagcatgagataactttggactctctcccaaacatgaaaatacaagggagagagtttcattaaaaacagaatactaggtgatcccagttaatcccggctctaagctgctgtagaattgctcagtgtttacattttgactctcttctcggtgacagttcaccgactatactgccagctatgttatgcatacagcttgccctcagctgaccaaaccctagtttcataataaaggtaaaaagtgggtctggtggtgttaaaataggtatttagcctgtatatgttactatatgaagcagaagatccagaggtaaaaataaacatttcagtactgaggcctttaaatatcttttaaatcaggaaacaggaaaccttaataggtaacatgagtcattaaccatatgaatgtgtgtaaacaggggaatatctaatgtcacttcagtaaagcatacaatgtcatagagacatgctttctattatatccacaaatatttgaaagaatacattgtaaatatttagaacgacagtataatcaataggatatgttcaaaaagtgcaaggatgatgatttcagcatttgcttctaaaaatttaattggaagaacagctccaaaaaagggatcaatattgccagctactaccaatatatgacagataagatactgaagaattcaaacttgggtacataccttagaactcctgcttcaaccaaggaggtactacgtttactcattccttcatgaataaatgtttcttgttagtcactgtcacataatatacaggttgagtaccccaatccaaaaatctgaaatctgaaatgttccaaaatctgaactttttgagtgctgacttaacgtccaaaggacatgctcattggagcatttctgtttttggatttgggatgttcgaccagtaagtataatgcagatactccaaaacccaaaacatttctgttcccaagcatttcagataaggaatactcaatctatatattttgctttgatttaaacatgtttttgtatcttttgaatattcataatttgtaaaaactggcacttcacaactcctatttaactactgacattttacagactaaaagagttatgcttatatttctcattttttgtgtgcttattcattttgagttccttttaatattccttcaatattgtaagagataaaagatacagaataatatgcccaggagaggaaataacagcttactctgtctgattatactatattctacagagagaaaagtactcagtgataaaaaattattcactagtatattataatttaagttaggttatctactgatgtaattcgttcctagaaaagtcctttattttgacttggtgattctgtgtgatcgactttcactcaagcttcacgacaataactgacactaatagaactgggtttacggagataaagaggaagcggatccttctcccagaagcaaccagtgtaacagaaggtatgcagtctaacttgtgagtaaacagaattctggaatgtccaatactggggtaacaaattctctcaaagctggaggaaataaagaaaatgacactttaacctgtgtcaagctacttctcagctaaaatccaagttatattcacactgaagctatgaaaacacaaacaacccaggaagcacagggatggaattgattggcattctgtaattccctgccttcccttttgctaacccctcatgggcattttcaaggggactggcaggactcagtgaaatcctcagccacttaacgaggctattaattggccaggaggaagactgaagcccaagcttcgacctcaatagtttaaagctctaacaaaccaacatcaattagcacagacacaaaattttgatatcctttaggtaacacagagtttaaatgttttttattttttatttttttttttgagacggagtcttgcactgtcacccaggctggagtgcagtggcgtgatctccacaaccaaaaaatgcgtgatctctgctcactgcaacctccacctcccaggttcaagtgattctcgtgcctcagccttccaagtagctgggattatgggcgtggaccaccaggcctggctaatttttgtatttttagaggagatggggttttgccatattggccaggctggtcccaaactcctgactctaagtgaccacccgcctcggcctccccgagtgctgggattacaggtgtgagccaccgcacccagcctaaatgtaactttctaatgattgatatcttttgttatgaatgctaactaaaatcttacaacattttggggttctctgtttaatttttaaaagcacttattattaactttacttgagtcatggactcctttgagaatctgatgaaaaatgaggatatcttcttccctgagaactgcacacatgtgtgagccaacacacgaacacatttttacctacgacttgaggaaattcacagacagttttagaccctaggttaggaaatttggattttcagagagaaagccacaatttccagtgatctttcactcactgatgcttcaattttgcatgtgtttactgaagaccacgcgtaaggcactgtacgtaaagctgtgtgggacacaaggaactatcgaatcttgttgtggcagcggagaatctgaccgtggagcacacatagggtgaagccacagacaccatcaacgcggctgctgcagagcgcctctgggatggccgtttcctccttggtgatttggagtccctgccatgaccccacggtgtggggagtgagacaatgagagtgaacagtacttgctttgtaagtggtaaaccactgtgcaagtgttagctgttggttttatgaagtcaaacttgctttcctgttttgagagccaaccactgagtagtaaaccaaaaatttataccaggaaagtgaaagtgagatggcagaagattagtcagaaacatccaaaagggtcttcttaatgaggatagaagatcacttaatcaggagtctgcataccaaaagcatccagtcaactgttctgaaaaggtattttaaaatgatgatccaataagaaagaaaactgccaaggtaataattgaagaggcatttgccattgcagcatggagctctgactgtgagtttatgaaaagtgttatttaatttccattttcaggcagtcccagatatttttgatatatgtaaaataatgagctattcatgtcttcataggatatataaacaaactaaaattaaataaattaaataagtgaaatgtttataaggcatagtcacttatttcttacacagaatatgctaaaatagcccctccctggtgttaaaatatcaatattcttttggagtgaagccatctaagcctgaaagtgtgattaatctggagcgtgtcagcttccagacagtcaaacaaatcatattcagttccagatgcatcccactgaggatggctgtgctgggggtttctttgtcttctcttcctcctcactctcttcaacctaacttaggatgctgaaagaaaccatgaggaaggcctgggcctcagacacactctggtttgaatcccagctctgctacttaatgactgtgacgctggcaagtcacctccgctgtaaaattatgataacaatgcctcctttgcaggcccaaacaaaatgcacaagaaaaggagtgtgaagtgcctggaacggtgccaagcaaatagtagtgagtcaatacaatggtggctacaatagtgtgcactgatgatgccatttcctctgagtaaattggatgcatgcatcctacagctacacagcactgtctgttttgcaaaacaccttcatgcagatgtcatttgttcctcatgacacatttctgagttttgtgcaaatcttactgtaacctgtgagatgttcgctgatctgtcaaagtcacacagtgcagaaataagaagtggtccaactgaaagctggagtttgacaatatctgatatgtccagccagaaaagcatcctacgttatcagcatctattggtacagtatgatgcttaagctcagctctatgaatactgtaaaaatccaagaaggggaagaagagaagagctatctgagaaacacgaacatatatctaggaggcaatcagtctcaggagaaactttagagtctaagaaagaaaaggaagagcaggcaaagaaggtttttgtgtaatttccaacagcaatagaaagaacagccctgtgagcggaaacctgtagccttactgaggtctgggcttacagggactagaagaatgatatttatgaaaacagtacaataatgtgtccaagtatacactgcccttttgtaatctccaaaatctcatgctattttcagttactgttacaaggaaaatgaagaaggagacaatgaattgaagaccataatcaaaatccaatgcatgagctctctcttttttaacccctgagggtaggacaaggaaggaatatgctaaagaaaagaaaaaacatgtttcttataattggaaagtgcttgtagtatgtgtggagaaattctgatgcacataatttcctgagtcctttcttttaatccccagagaaaaacatggcataccccctccatttgaatctgcacataaagagaaaaggcaagtttcaaatccaaaaggggccattaaaggatttcactgggtactggaactgcatccaacaatggttagacattttacaaattctacttatttcttcaattaaagtaaaaaacgcttgaacagagatgcagaggtcatccactgaagtttggggtgcaacatcatctgccatcatgtgctggattatctagactagcaaagcacgggggagtatacgttcgtggggactggcatataagaactttgaaaaccagctgatgactgcagacgaagcctggctgaaaaactggtcagggttcgtgatgacaccaaacgtaaaaaacaaaaacaagcatggactcagggtcgcttcgcttcctctccactgttctgtaggtggtggcttgtcagcaacaactagtttctagaaagagagttttattgaaaatactacctctgtgttcctgtttaatattcctcatgcttaagctgaaatggatgtttcagagcaaaatagcagttaactgtcattagctggaaccaatattgtaaaatcatattcttactttgtgaatgacagagcctgctaatccctatttgcaaacatgaggctcaaatggcagggttaaagcaaactgcaaggacagaggaggctcttggcaaggagggtttagactaactcactggatgatgaaaaaaggcagcagaaattcaaggggaaaaacagagcatggcctttacattttatatgcattcaaggcagttagaaaatgcacagagggtcctcttttttttttttttttaactttaagagaagtctactatttgagagcaatatctatattatttgggttctccaaggtctttctcaatagttatgatattccttgaaagtaacagcatttactgaataattctctaaatacaactctcttctcttaacaaggttattaacgaaagctctgaccactgcttagaatgtttagcgctcagcaatgttgaagtgttaggcatgaaatacatgttggtgctaaatcgtttcacaaagtggttggggatgcctggggactacaacctgcagagtgacactcatggaggaagagggctgcccttgggcaggtgcgtgcacatcggagggaaatctgagcacgtgtggtgtgacagcttcacagtgggccagagaagggctcgactggctcggaaacaggcctgtgctgagcagcatcgatggctgtcagatggactggcccagttctccttggggagtgtctgacacaggaattctaaccgtttcactcctcttgagaggatttgcaaggaagaaactaccgtggaggtaattatatcttattccaagaaggaaagagttaatcaagatttcagtctccttgggaagcacccaggagagtttcacatgaaagggtgtagacttgtttttaagaaatatcaaatccattaacagtttatgagtatctcagacttcaaacatttactattgggtcaaaagttcaaaccactatacactgtacatttttgaaaaacaggaactaaactgaattttgagtagtagctttaatttaaagcacagaaatgacaaactatttgaagccaaacatgacgtacaaaaattaattgaagaaaatcttgaaagaagaaagtgatgaccattgttgctccttaaaaaattcccaaagagtgctgactatatcagaggcaaggccttataaataaatgaatcaaaaccataagaattctacttccctcatctcttttcttagctgtaatgttcatataaacatagctgcagaataaaggacagtatattatctggtgtggagagatgtactgtcttcgtaactcacttgtgcctcatcactcacatgtcacaggctaaccacccccgctgcggaaatcacagcatctatcataggatctttctgcatctgtggaggacactcagagcaatgagttgatatgagatatggagtatatcccacaaggaagaggggcaggctctcagatgaattatgagggtcattccttcacagctgcagatagttttcatattttataaagcaaagcatgaggcaatctctcactgtgttattaaagtggattagggcccatcagcatccccaaatgatgattgtgtgtaaatgtgcagacacacagacaaacatgtacaagaatgcacacactcgtccttctgtctgtctcaccaaatatccaggaaagatgtttcaggctacagtcacattgaaaacatatgtgcagaaaggcatgctaactcatgttggggtggaaacgacttcacctaaaggaacagcttccaaaactctcctctgtggttataaagaagcaaactttcatcagtcatcactgcagtcatctgattgaatcagtgtggcatgtaacttcagggatcagaagactggagattgaggaaagggaactgagtttcagagagctgaaggtgggcagttcatcagaggcaaggccaggctgactagcgaggaatgtccattccagggggagttgaaggggatgagaaatttccaagcggagcctgctcgatggcctcctgtctttggctgattccgaaagacaagtctgttagagacaacaacttaataaaatctgtaacagctaatatgattgacaggaaaagtaataataaatcaaggacccaggaatgaagttcttcagaaataccaagccttctagagaagagatggagaattatgctagcaagcgcatgcatggctgaaggtggggagttttatggacaaccttggtaagaccccactactcatcttctttactcatacaacatcttcctttctatctgcatggtatttggagatactggaagagccaaaacgatgcaaatattaaaagacaaacactgcataaccaccaccaattctacagggtggctgctagctcaaaggcatcttttgagtgtcttagaggaaggtgccttttccttttactctgttgaaaaactctattaatatgttgattcttacgataaaacactttactgtcacttgccagaaaattaccacaagtatacaaatcaaagatgtctgtaagagtggcactctcactggacatgatgtgcttggacccactatactttgaaccttccttgacctcatgtttagcaggggtcaaaacacattactttgaagcctgtgtatatagagcgatttgcagctggcctgatgccctgctccagggatccagggatataaaaaaggcagtgttttgccagatagtttccatgttgctgtgaaatgcaatgaaagttttttgtttttcttctagaaacttctgtggcttggagttcaaaacacggttctttgaaatacagagaaattatcctacactttttcaaaaatatgagtaatagatggctgtctttacataatagttattttttcttcaagttctctaaattctctaaaatgaacatttattcttttctgtctttattgtgaaaaaagaaaagtttatttttgagaaataaaaaaagggagatgggaggtatgtggggttttatgataatattctactgagcaatacaatgggtgtcctgtcccctcctgtgctgtactagcacaacctctgcactgctaccgtcgtggaatgacacgggcagccagctggactcagagactcagtgcctgcatcaacctccaacgaaagccgtgaccgttcagaatccggagttgactatacaccaggctcaagaagacacagagttttctcaaccattcatgggagggcagtgaataaagaccatttctctttccatcgagtttggaaagtcagaggacagttgctgcctctctttgaacaaacgatgcaaaaatacatagaattttcatttaagatttcgttaaatctaaggcatcgccattattacgaagaattatgtcccacacagaatttttggaatattaaatccttggttttcaaaaaatggtctgtggggccaggtgtggtggctcacatctgtaatctcagtgctttggggggccgaggcatggagatcacttgaggccaggagtttgataccagccttggcaacatggcaagactctgtctctacagaaaaaaaaaaaaaaatttagctgagcatggtggcatgtacctgtggtcccagctactcaggaggatcactctgagcccaggagttggaggctgcagtgagctatgattgcactattgcactccagcctgggcaacataacaagaccttgtccctaaaaaaattaaggtctgtgggcatcacttgagagtgaaatatgtggactgttaggctctgtttcagatttacaccatcgaaacctgcctctaagtaaattttcaaagcactgattttgctcctttctatctgggcacttagcttgcctgccctgaaagaccattaaacaggaaatgcgcagatatacgggtgaagactgacactcttctcccccaagatctgccaagtcctggggggatgtggcccaaacctcatcaactaaggaagcaacaacaagagcatctgtaggtggggatctggccagaggtcccagatgatagatgaggtgttagataatcatgagtgtgaaaacaaacggctttagacactaattctaggcacattttaccctgtaaaatttggcataatgataataaagcccctcactgatgaatgcctaccgtgtgccaggcaccatatgggcatgggccatacccctaatcctcacgccggcagtgaaacaggttacgtggctcctgctgggtggcagaagacatggaggggagacgcgctgctgcgcctacatagcacagctcctaggcagcctggagatcctgtccacttcaaaggtaatgttcattccactattccacactgcttccttaatgttcatgttgcttcggaggatgtgtgatatttttttaaatgtggcaattctagaaagaaaactaatctgcttatatttttattttatgttatttctatatttcttcttgatatacttccagatttactgctgaaggctgaagtcactttattttgaaaaattaagaaaatacacacacacaccagctccatctggagactccatttcaacagtgtgtgttacaccatcactctgaaaagagtttcccgagattgtaatgacatcaatatttctaggaaaaaggagaatgttgaacacgtctctgctcctgaaatgcaattatgtgcattcagcaggcatgtgtagggaatagaactagagtttaaattagatgatctttggatgaaattcacatttgtggaacactttcttcttcgggggatggagggatagcaagagggtataaagtaccttctccattataaaatgcaaactgttctcagcagacggctcaccatgaataacgaaccagggaattaaaagctttaaacctgttaaagaagcaatattaagtttggtataaatatagctgaaataatccagacagttttatgaccttacaccccaaataaaggtgaaatgctgaattctttccctagaaatagaggtaaacacagctaacagatggaagagctgaatggaaatttcaataaagagggccacaaagaagcatttgtaagctcaggggtgcacgcattaaaaaaagaagctgaaaaatggaactttgttttattttgatagagtgccaaaacagtactgcattccttaaagagctgaataaaggatcgagttagactggccttctcaacacctcacgaaaagcgcccttgggtctcattttgctgggatgactatttatatgacaggtaagggaataactttgctggattctgttacactagggcctctgtgacccctaggtcaaaagagcaaatgcaaaagtgacaatgtggataattgcctgtttaggataatggaatactgattgaagtcaattattataacacctgaaagataaatgagctgatgttaaaggttcagtggagacagcagacgagtggaacggcgggcactgtgctgaggagtggccaaggaactgtggaattcaagaggagggggcagccttcctgacctggaacttactccagcctggagtgttccaagatctaaaataggttagtttgtaaaacatgccataaaacagaaatttagcccaatgtctcgaactgcaggattagagtaacattagttaacgtggccctccattaattttcactataacctctgaaggcctagacttgccccaaatccattatttttgtctgtcactggagggaactttcccttcctgccagccaggaaaaagcctgctgacgtttgcagctcagacctcaaagctcgtcgacagcagcagcctgaccagtgtgggccaggactgtaccagctctgcagtcagaacttggccccttgcattttcttgttttttttttctcttatagcagaaatacgcctgaaaatgtttttccaaccccaacacccctgctgccctcctggttcaggtttcttattgccgtgtctggcccttcaaaggcctaccccatcatctcgcagtgctggcgtggcctcccatgctgatccctggaccagtcctggctggggtgggagtgaggagggagcgctcaagtgggggtctcaagagaaatgagctgtactctgtttagaaatcagaccagatgtgatcaccaccgtccacatgcctctgggtacgaggacagccttcctccagcagccctctcagggtcatgctggaggactttctgtccaaggctccacttactggaaacttcagaggagggtctttcatcccctgatgctcccctctgagcccaggcccagttctgaccattctagcccagtcccactaacacagcctcctggccgggggaagtatcctgcttctggagctggaagtgctcctgtggcatcctgatgcatttgccaatgcccagggtcacagatcaggtgaattaacagcctgggactctacctgggccctctgcctccaactgccaccacagataaaggtaactgtgtgtgaattgagaagcttctagagacaatgactctggaaggaaagtttttgatagagtctgcgattttccagcgagaaacaatgcgtgtgacccctgcagagacaatcctcatgtcctccatgagtgtgcgtctgtgtgaaaacgaatgtcctctgataggaaatgaccccaaaagcgctcttgtgtttcccatcccctcccaagaacagcgtataagcagctgcacaagcatgactcaatcatggatgcgaacctgtccctctaactgatagtggtaaaatgaaaaaaacactgaccaaattcaatttcttctttaactcattgaaggccacagacgtaactgagcgaagtgtctgtgtttcgagtgcacagagcggagtggaagtcggccctgtgactgtcatatcaggcatattttagtgaacaccagacacagccaggctggtaccaaaactgctggagagaatcacctttcccaaatcctgcctcggttggctgaaggccaccaaaggcacagtgtggtccagttctgagtttagtcttttgaggacacatcccacccaacagctctctcaggccaggagccaccgtgagcacgcctcactcaaagtggggaatggacgccaaatcgaaaaagagcgaagtgaatccgacactcttgctccgcttgcagcctgtccctggcttatacgtaaagatacatgctggcaattgtgttttgtataagtaagtttgatgagtaaaagttttgttttctaaataatgatttctaatcctttggcaatgtgtgacttcaggcaaatcacttctccaggccctagtcttctcatctgtaaaatgatgatactaccatgtagtgccacagagattcttttaggggttaaattacagtaccaaggatgctagaagacacacagaatgtattcaataaatggcaactactactgttattatgggttactcatgcagtggcaacggtgtccccacagcttcctgagagcgcttcctctgctggcctgggagaggacggcatggcagggcctccacctctctgcctgtctgcagcaccaggagccttttggtcagttataaaccctctccttcccctcctgcttcccagcctctctgcctgcctgaggagagcggggctgctgggtgccaggcccaggagctggctcccgcgctgctctgcccatcctctgcccgtctcctgcccaggtgccggcagcatcaacacgcaacggctcactgccacctccccaggctgcagggctcgctcacgccatcacaggagtcctagtgcctggtgagatgtcagactcagaagaacttcgccatcttgttttgctttgttatacaccaaggtgatgattccatttaatcagagagactgaactgtaacccaggatttacaaattacatcaaggaaccaaacttatattttaaaaactagaaccagatttcccttctccttttcctttcacatctcattctgaacacagtttgagtttgaagactggtctgtggggagcgagtttttctctgaaactgttgcagttcgacaaaaaccaatctgtgttgtaaaagcatcgaatcccaagcgctcgccttaagtgggaaaacacgattgcaagacgaaggacaccgagaaggcacatgacagcttgctgtttagaaaaagctctttgctgaccaacagtaagaaaatggccttgtgtttcagggaaccaaggcaggcctcacgaaggggtctccagctctgcctggctccctgccttcgtggtccttcctccaggtgtccttgctgctggttcaggtcccgggtgaaggacagagctcagaatgggctgtgttcctgctgctgctggtggtccttgcccagtgtgcagattgctgcccggctcctgggctctcgctgcttactctcgctggcgtgggtttctgctgttgtgctactctgggccctggcctgggcttctagccctctgctcctcaagctgactctgccgagccttctgcctacttcctcaggccactgctcccactgggcctgatgagcttgagtgcctgcgtgtgaagcctgaactctagggcctactcccctctgctgtctccctggcaccctcacacccaggtgaggccacctcaaatcaaatgtggtgatggctcttccacacatggccttaagccctctgaattgtcagccgggagaataacatcccgctgtgaatatcctctgaaatgaaccctgctggtcataacttcctttcctttcaacttagtactgaaagatgagtcaccatattccaatattcttaatggtcatgggggcctttgtacaattttacagtattgtaggaataataatatagaactggtgcaatcctctcaaaccaacttttttttttttttggcaaaaactgatttttagagaatcccagctgtcctgaaatattgacgagcaggagtaaagtgggctaacttcaaacacaaatcccggtccctacacctcgccgccaagttcaacagactgcacagcaacaggctgttgtgcttggatcaaaaggatctgagagtcttgaagcaggcttgaaatacaactgattttatgatgagtaaaattaattcaatggaattctattgaaactgcatggaagaaagagaatttgacccagtttagtccagactcacagaatttggtccaattctttcatttactaccttataccaacttagcccaaaatatatttctagcaaaagacccagttacatgtatttaaaaagcatgaaggaaaaataaaacaccaaaccaataagcctaaacataggtgtactgtaggagtcactgtttccagatgcccataaccaaacacactcatctacaatttaagctctgtgaacattcatttacttatttatcttgagtaaggacaaatagataacatttttattatctcatcagaggccacaagaagcttcaaatctgtaatcttttaataatatctttccagtccaagccttaagaccaactttgttaggactaataaaaacctgaatttagagaaaatgggaccatcttcaaacacaaatttcgtattacccatagaaggatgaatgctctttataaagagactttggatagacatgcctcatggctaactggctgatttttagagcttactgattttaactcactcttggcaaaggcaaatattaggaagttgttaggaaggaataagtacgggtgaaatgagaacatagatcaaaatgaaataaaacacttataaaataatttgactaaatgtccactgtgggccaggcactaccccatacttgggtgtgaacttgtctaattctcagaataacgttgtaaaggaggcattattatttctctgtcaagaaaggatcacagaggctgggtgtggtggctcatgcctgtaatcccaaaactttcggaggctgaggtgggaggattgcttgagcccaggagtttgagaccagcctgggcaacatagtgggactccatctttacaaaaaaaaatttaaaatagtcgggcatgttagcatgcaactgtggtcccagctactctggaagctgaggtgggaggatcactcgagcctgggaggtcaaggctgtagtgagcagagatcacgccactgcactccagcctgggcaacagagtgagaccttgccaaagagaggagaggagaggagagaggagaaggttaagaaactggtataactaggggagtaactggggagctgaattctgaacaagttatttaacaccaaacctcaaacaggacttaatcactcaacttaaagactctgatatcccttcctttgggagatcttgctcctgaggttccacggggtgcaggtgcaagtcttaatgggctctgatattttaataatctatttacttgggcatgtcccgcaaaattatacatcccttgagggaagtatggaagtatggtgcttcgttgaccactgtatccctaatgcctgactcaagtatcagacaaacactgaagtcaggatccacacatcaaagacaatccaaatggaggagcacgattctcttattgtttgcaatatagaatctgaataaaattagtgaatcaaaataataaaatgcacactgaataaatttaacctttccttgttccttaggagaagccatgatgttttacataggtagtgataacattgctacaataaatacttggctattttaagaggtggtaattttattactactgaaaataacaaggtagagagaaatttgaaaacattcagtaggtataagctatctgacaaggaagcttgctcattcacattaataagcttcaaatacacatactaaaaggccatgaggctctttgtacttagtgacagaaacaacattgcgatgtgaaggttactctgggtgactatgaagccctgtcccttgcccctgggtctatgcaagccctggattttgtgataactcagtaggttgtgacacaagatgaacaagcctaaaaaaaccccaaaccatgaacatgtctcaacttcactgaaggccttagttaaggccctaacaggagtaaaaaaaattaggaaattaaatctgttgtaataaaagtaatatttgtatgttataggtgggctatttatttttgtccatttaaaaagatttctgagtataataatatgggacagagaactgaaaagtcagtttgataatcttgaccaatctgaccaacatggtgaaaccccgtctctactgaaaatataaaaattggctgggtgtggtggcgggcacctgtaatcccagctactcaggaggctgaggcaggagaatcacttgaacctgggaggtggaggtggcagtgagccaagatcacgccactgcactccagcctgggtgacagagcaagactcgtctcaaaaaaaaaaaaaaaaaaaaaaaagaaaattttcgcaaaactccttccctttcccctgcctgaggatgttcggtttgcctgatcccaggactacccggggcgggaaggagagcagaggccagagccagaggggagagaggagacagcagatttggccggatgtcagagcaaagtctggagctgagagggataaaacaaatctggagacatctggggagatggatggtagagaaacttttggacttactgctctgggtcatgtgattgacacccttatgccacttcttctagagactgcagaaaagaataaaaccattttcccatgcttcacagtgtggctggctcatgcttcttttggatggaacactgaactaaggctgaccacccagcagcaagcttccttcctttgcttatgtgtaaagtgcactgatgtcattctccaagctacaactgttatgcctttgcggatctgactgagggagcactgcagaacaccaacaattgcacaattaattgaactactgcacaattagttttgaacattactattcataaaatatgaagaaaaagttacttagagaattttcaagaatagttctgatgcagaaacaatctgtgctataacaaatttttctcaaagaaaggataaaaggtggctttttagtctaacagggcaagaatcaacataaaactgctggataaagctatagtaacacctcaaagtctaagaagttgacccattattttctaacagagagttatattacctaaacagggttatgtatataattcatgaagctctttgtcttgctataacaaatctaggtggttagtaattgaaaaacaaaataaaaacgtgtttttatttgtgctcttaataaatcttcagcatggaatgtaaaaaataaaaaagagctctagatggtaggtcaagaaaaattctaacaagtagcaagaacaaattgccttaaaacttggtagcttaagaccaccatttcctatggtcatgaattctttgggcccgcaatttggacagaggtgttgtctggggcctgagctgggagattccacagctggcagctgtacttgttggaaaggccgttcactcctatgtctggaggtcagtgctgacctccaggcccttctacgcagccctcgccacgtgggcccccttgggcatcctcccaggacaatgactagatcccacgagagcaagtcaggtggggcagtgttgcctgccacgacctgcctcagcaccagccctgtcttctcttcatctgggcagccatgaccatcctgcccagcatcctcggcagggaaggaggctccatctcctgatgggggtagcaaggctctggaagagcatgtgggactccaatgtggtcgtatttagagcataatctgccatagtggcttggtagagctcatctctgtgagcttcagcagtgctcattttctgcgcaccattcagcaccctcttactcccaagaagggatgacatttcctttgtgaaaaatgctcctggaaataaattccaatgcaagtgctgatggaggaggagaagaggctcagcagagatggttcttagtcagaaatctgaaatattaaggagtgagatgttaaatatgacagcggtaaaggaaaaaaaaattcacgtaaaaccagcgtgctgctgcttcagcgtgatattccagtgccgtccgagaatttggagacggtgaaggtcttggaaagtctttctagtgaagctcaaggtcatataatctatgcagaatgatgtgattttaataactccatgaaaatgttttatcatttacagttcaattcagttcatcaccaaaattcattaaattgcagccatcaatgaggttgataactgtgatccagaaagatggaaatgcaatgcctcagtaaaaagcatccaggaggtctagagcctcggctgagggaagcagcacaggaagcagggttggctatgggcaagcaccagtaagaaccaaggccagcaggccagggaaagagtgggactccagtctctgggaataggatgcaaagacttaagacaagcccctcgcacagcctgagcaagcatagcagaggcttcatgggcaggaggggacctcagcatcccaggctggggccacacactggggccaaatgaactgaactctggccctgagtttgtgatggttcaggcactacctggagtggcgctgggcagtctcctccctacagactgagcacaacagaggcctgaaaaagtctctgggcctggaagctcgaagcaatgctgcccacactcccaggagcctggttttggttatgagagcaggagctgtggcatctcctaaatgagacagttgtatagcgaaattattaaaatcaaggaaatctgtcagtaatttgtggtttttttttttatcactgcagtaagttgaaaactatgattacagtggaaaagaaaagaacaaaagaatgactaccagttactcaaaatgtacaacggaagtgagtgagctgactgcaggattgtgaccatgagccacctcacacgtacctacagcctcgcgccactctgccagcgcgtacccacagccaagggcccatcagcaagctcagccccgcagccactcatgactctccagactcatctgtgtcaaaacaaaactaaagtttcccacttaataaaagcgaaaggctaatagacttgaacatttactgcatgtttttgggtatgccttaatctctcccctggctaagctgccatcatataaatcagagtcatgagttatcattgttctagtagcaataaaaataataataaaagcactgtgaggtcagaaaatgtcaagaccagtcagaaaaatgagcgagacataaaacaaagtataaaggaccagctaggattggaaaaattcaggtactgtacctccaagtgtactacagcaggaggtagctgccactgctgttttatttaatgagtctccacataaatcccagctgctaaccatgtgataagtccatctcagaacacgagaggccccattcactatcggtgttcaggcctggctgccattaatgggaatttcacttacagtaagggaaaaaacagatcttgaaatgttctgttggatctaaattgttagctttttaattttagtatcaattggtttgactcttttttaaacaacaaaattaatatgcaaagtctcttcatctaaatacatgaaaaaggagagcgaacaagtcctggatacttgaaacatttttaatgtgaagaaggtataaaaacattttcctggacaccaaagacagaattcagactgcagagtagaaacaaagcccacatcaatttcataagctgcctgaaatgcgtaaatacagaaaagaggggattttgtttggaatattttttgtgggacacacacacttttgtaaactttttaaccctaaggttttgctggcaaatgcatcatttttcaaagaggagtgtgtacaggactgaaatgtggacctccgcctggtgctggaggtgcggctagtgggaggtggcatgggagagtgtggagaaggcaacccgagacaggcagactgggagcccagacctgccactgcccaccgtgcagccttggcaggttgctcacccttgctctcagtcgcccagatgtcaaattggaatattaacatgtggaggttagacaggcaatgaggaaaggcttggcaagcaagccagaaacaggcacagagaggaaaccatgagtcacaagtaagggagacagaggcaaagactgggagccgaccaaggccacagtcgggagggcgatccagagttcagaccagggaggtggaggaacaggcaggcttaaagaatgcagggcagaattgcacaggtaaaggatgtcttacgcgtactgtgtactccaatagattcttcaatttcttcaaaattaaaaagcaatgggacaagagttaaagggaggcagtagcacatgaatggcttaattctgggggcattttgttggttcctaagaggtatgcatcaattcattcacaggctttactatcctggggtttcctggcagaaatgtctgggaagatctgcctggaaatagttacaagaaagaggtagtttctgatattacactagcaatggaaggggaacaataagacctgcaggtgatgacttcattacttcaggtaagagaaaaagagcttctgtcagaattctcctttttcacaaacctctaatttagggctaaccttcaatctagtcattaagaaatatccaagtttctcaaatgctggaatttggctcaaatgctgttaatggaactctatattttaggtcaaataattttaactctttcaaaagccatttgttggattttagttaaaataaaaaaattaattaacttagatctctggacaccctttcattttcctctatgtgttagtgtaaaactgcaaagcaattctgctgctacccacctggagttaggaagtgactctgcagactgaagggcatgatccccaacgagacagccctcacttcgggcaccagccccggtttgcgggtccccaggtcacctgcacttataaccaactggttataaacctgaggggtctccaccttaagtttcataatttgctaggatgactcacagaactcaggacacaatagtcatgtaatgacagtgttattagaaaggatacaactcaggaccagccaaatgaagggacagcaggggacggtctggaagggccccaaaggcaaagcttccatgtgctcaagatgcatcacccccttattacatcaacgtgttcactacccagaagctgcactgcccagggtttctattgaggtttcattacatagtcatgactgactgaaccactggccgtatgctgacctcacttggctcaaggccctgactctctaagcccatggttggcttatctagcttggccagcccccaccctgaaaccatacaggggcccaccatgaattacagagacgctcctattacttaggaaatgccaaggatgtagtctccctcctaggaatcaggacaaaggccaaattctttattatataagttagatagaacttgacaaaaaattattttttctttttcttttttcttttttttttttttttttttcctgacaggctcttgctctgttacccaggctggagcacagtggtgcgatcacggctccctgcagtctcgacctcccaggctcaagcaatcctcccaccttagcctccctagtagctgggactacaggtgcatgccaccacacttggctaatttttgtgtattttttttgtagagatggggtctcactatgttgcccaggatagtcctgaactcctgggttcatgtggtccttccacctcagcctcccagtgatgggattgtgggtgtgagccaccacacccagcctaaaattactttctaattgtatcttactgctggtagcatagctaaatattatgctagcatttaaagaagtggcatatctgtttaaataatatcacacttatatttatgagcctctatcatttgtgatccactctggtatattctatcagtctttccccatctcgtattcataaagatacatttttctgttcctaaatatatgacattgcatttattgctatgaaagttcttattatttttgatgaactgcttctcacattttcagagtcatcccgaaaacctcactctttctgtcaacaatcttatcaatcctactcacttggtgagaaatccagaaataaatggtcacactccagtatgacagctcagaaagaaattttcagcatttagggcttattagacaagcccctcttctcaaaaagaagatgagccaataattagcaataataataataagagctcacaattactgaatgcctccaaagtctccatgggagttaggcatggtcttaccacagcccagtagggcagacactactattttctttattttataaagaagcaaaagtgaaatgtagagaggctgagtaacttgttcagattcacacagaaagtgaagttggcttttaaaactctttgactctagcacctaaactcgtagctgctgttggcttacctacctgttttaaaggaaacaagcagataaaaatttcatgaggcaaattttacatgaagtttccaaattttccaacatatcgaggttttctatagtttttctatagcggttatatatagtatatatcgtttttgtatagtatatatgtttttctatagtagctatatataattgtatgatttgaattttcatttatatccacatgtaccgaggaatatgtggtcttcagtgaatgccagttcattgacaacaatcgtgatacttagggattaagtgtgaagaagttctgctgctgcctgctttacctcttgtggtaggctgagtaatgcctcccaaagatgttcatgccctaactcctaatcagtgactatgttacctcacatggcaagatggtcttcacagatgtgattaagagaatgctgagttggggagtgatcccggctgtctaggtggacccaatgtcatcaaagggctacaaggcaaaaggtcagaagacagagaaggtaagtgatgatggaagcaaaggacagagaatgtactttgtaggcactggagagagccacaagccaagaaatgcaggtggcctctagaaactggaaaaggcaaggaaacagattctcccccagagcctctggaagggatgtagctttgctagataccttgactataacactcatttggacttctgattccagaactgtaagatgataatttgtgtttgtctcagtttgcttgggctgccaatacaaactaccttgtactgggcgcttaaacacagaaatttattttttcacagtcctggaggctatacttctgagatcacactaccagcatggtctttttctagtgaggatgctcttcctagcttatagatggtggctgcattctcactgtgttctcaaccgtggtgggctgggggagagctctgatgtctcttcctcttcttataaggacactaatcccattatgaagccctggcctcttgaactcatctaaacctagtgatctcccaaaggccacatctccaaatacgatcacattaggagttacggcttcaacatatgaattttggggagacacaattcagtccacagcagtgttgttttaagtcactggttttgtaaaatcagaaaaaataagaaacaagtatggtttgttcccttcctcctaagtggaattaacatattatttcctgttcctagaatacaacgtgcattttggtgtttttaggaaagattaaacctgaatatatttttaaactttactactgtttataatatacagccaaatgacacattttttaatgaatttttaatctaatcaaaatagcatatataagtaatatagaaagtcaaatattgatgagactgataataaaaaacagaaatctcttgtttcttgctcctcccaccttgccagactcttcagagtcccctttcaatacttatagtttgccaaatgatgtgtctattctgttatctcctgatcgatgtatttgaggaattaactactgacttattacagcactacagaatttttagcatatttatatacttttaaactcacttcccctctataattacttctcaatttttggttaagtctatattcatagtagcaattattagtttctatataaatattattttcttcagagtcaactagtataacatgatttcattcctttctttaaaaacccatcccctttccccaccaggcttaactgttagttttttttttttcctcggattagttttccttatatatcattttctcacactctccaactttctataacacacatgccaatgtaatttttcataccttcaaacctgtcagagaacctactgcttcctttatactcttctcctggaaacatctctcttgaagggatcagtgttcaatccagtttgtttcaccttcgatactgatcgtttcacctagaccagctactgttgtctgcttgggacttcctttgctgtcatcctgagaattcccttctctctctgtgttggatctcctgcaactattcctgaatactacaccttcacctttcttgatgtattcccttgttttggtagagtatatctaccaatagctttctcagaaaagtacatggaggataattacattaaaaatgatatgtgtttgaaaatatctgtaataccttgacttggtttagaatttcaaattaaaagtcatttccaaaatttagagggtggttttgctctactggcttcttattccaatattgatagaatgccaaatttactcctgatcatgtgtctgaaatctgtacttctggaagttttatgatcttctttttaactccaatgctgaaatatgacaataacagtatttggtgtgggtctttgttcatccactgagctggacaattacacagcctttacaatctcaagaattacattctgctctgggaaattttcttcacatattcatatgataatttccttatattttccatctctcactatgaaattcttattagacgttttcactcttcagtatatcctctaatccccatgtatctcatcttcacccctttcttgatgccctttccctatctacactcactgcaatagtgatctcttctagtttcaacaaacgacttcttcaggtttcctccaggggcactgtggggcagtttcctgggtcatgatacattccccaatgtcctgtgttctatgatagtctcagaacccatgataaaatgactatgcatttgtgaggtacttctctactccaggacggctttaggagcctatgaatctgttctagggatagagatagaggttaacatgagcttaagagttccagctcacttcagaacagtttacaagaaattcagataaacttataaattccatttccccttaaagtaggcctgaaccagggtgggaaaccttaaatgacctctttcaagaagttcatgaacaaaaatctgacttatgatctttaagatgtccatggacttgatgagtctgcttttatgtcagcgaatgtcatcaactccaggacacctggatgtttctgagccaccgcaggtggagactggagtaccttgtgtacagaggtgatacatatagtttattgtgaaggcagctcatcttcctactttaaaatgccaaaggaagtcaaaagccacgtagaggaaaattactacccttttccttcattctctgcaattttatggtcacctggaattctgggtttctcattttgcttagtattcctggagaaacacaaattccctgccagtgtatctcacatctcagtgcttctcccaaatgtctaagattttaaaaaaacagaaagtttgaccagcttattgccaaaaatgaagaaatgtttgtactcagtttaaaatataatgtgcttaggtctataggacagagtcgccaataatggtagaagtggaatgatggaaagggctttacacacttacgtgggaataacttcattttaagtgaacaggggatgaagacggatacttctaaacaaagattgggtcagtgaatgattatcccaggaggatgagaaaaaagaaacaacaaaatataatgtttggatctatctgaggagtttatcctaacattttgaaatgaatttactggccacttttccaatgccctatcaacacctagagggttctttctccttttatgataaacccatgaagatttccagttaaataattgcattccaaatcccatttacgtatgtctactctaatccaaagatttattaatctaagatattctctaaaataacttcactgaggcaaaaaaaaaaatacttggaaaattgcagcaccatatataaaccactgaggtggtacaaaacatttaaataaacaaagacacatgtatatcagcaaaaatcacagggaaaggaaactacggcattatatagaaagctgggtgtttggttggtggtcgaaaccatggaatgttctatgtctagggacagaatctgaggtcaaatctggtactgagaagctgcagaaaatgtactagccttagagaatttggcctcagtttgacttcataacacagtagggttaacactgttgggttgaaggaatgattaaatatcattttcaaaacttcctctcaactctggatattaacaatggtacccaaatcattttatagattgattgagagctatatacatttcctgacaagacctttatatgtgtactattcgggacacgtcattcttatcccaaatatataaaaatcatatggaacctctgaaaaggagacagatggtccattctagattaaatgtatttaaaagttaatttacaggggtgagccactgcacctggacgatgatatcctaagtaatctaaaatgaggctggggtcaaggtgcggtggctcacccctgtaatcccagcactttgggaggctgaggtggggtgggtgattacttgagcccaggagtttgagaccagcctgggaaacatagcgaagccccatctctacaaaacaaaaacaaaaacacaaaaattagccaggcatggtggcgcatgcctgtagtcccagctactctggaggctgaggtgggaggatcacttgagtccgggaggcagaggttacagtgagctgagacagcactactgcactcttgccaaggtgacacagtcagactccgtctcaaaaataataacaatcatcatcatcatcaaaaatgaatgtattttcatacatagacttctacatgctaccaaagactctgaggtacagattttttgttttttaaggaattcccagttatatctaaaacccacaaggcatcaaaattacactaatgcatacaacactagtctaatggctaaaatgactgtgtggagtctactgatcttccttctgaatattcatcccttttcccatatatctgtatatatacatacagatatatgatgcatatatgcatatatttctcttaaatcatttattaggaagagtatctatgcgtgcctcataaactgtatttccttattggggaaaaattaaaaggtgaatgaaacattacagattttaaaatgataatcaaacaatgagaaatgggcaaatcaggaggaaatatgctttgaatgcaaataaaatttaaagattagttcaaaacagaaagttcacatgaaatgcttcaatggtataataagctttgcaatttaaagaacttgtaaataaatgttcttattctgaaagcagttcattcacattaacagtcatccacatttcagtgtactcaatttaaacatctccttaattttaaaatattcaagaaacatttgcaacaggaccctaaataagcactcagatgaatgctaataatttatccgaaatatataatctgcatagtcacagtgacccaataaacagtgaggccagagatggggggaaggcggggactggccagttctcttctctctacaaactccaccaaattagcaggatgcctgtatcggaagagaaagtggtaaccagaggtgtggcttcagcggaaagagttcttctccccatgtaagcacagggttgtgtatgcttctctattcaacaaccccacaggacctggagggctctgcagctgtgaactgtggacagggctctggggaagagatcctggaatgctggctctggaagtccacccagcctcatagttcctccttgtaggcttaccgagatctgggatctgtagtcattaaatcttaggcaggaagacatgtaggaaaaaaaatctatgtaagaaaaagtatgaaacttgtcatttttcagtatgatagatcttcaaaaaataggataaaaagtgaagctggtccaggttatagactactcttagtgtattttcagacccttgtggcacttttaaaaaatacaaattctcaggcctcacgcctgcagactgcaattaggtatactggagaggggcccaggaaactctaattttataaagctccccaaatgctcataatgatcaagtcatgtttgggagctcagatttgatgctgttttggaaaatttccttgggataatatgacttcaaatcacaaccctcaaaatttatttcaatcttctaatattgaacttctacatacacttgctccattagcaacataataattcactgaccctctcgcttcagttaaaaataacaatcataaaatattaatttgctgtgttttccattcaaatgctcactttgttttagtagcgaaaaacttgaggaagcagagaacaagcttcttccttcctctgcacttaggaaagatgtagctccttcaaactgtagtgatgtttgatacgctcatcagatgctttacccattcccttacagtaagtcagtaaaaaagtgatctgattcagtgaggaatgtttattcaaatggctcaaaaatgtaggaagaatggtgttactatatgcccaacaaatgatccttagatcatgactgctgtgtgctcaagcagggatccctaaaccccaggccagggaccagtaccagtatatggcctgttaggaactgggccgcaaagcaggaggtgagcagcctgcaagcgagcattactgcctgagctctgcctcctgacagattagccaaggcatcagattctcacaggagcgtgaaccctactgtgaactgcacgtgcgagggatccaggtggcacactccttatgaaactctaatgcttgatgatctgaggtgaaacagttttgtcatgaaagcgtccccaccccccagtcagtggaaaaattgtcatttaaatgttatagctggcctgctataagcacaggtgtatctggtaaactccacatgttaaaaaggtaaaaagaactctctcacttccttcttgagcttaggtcataaatattttaatagacttgtgtccacctatgctgactttctatgaaactgaaagctcctctcaagtaagtgttttgtgatgttttgatttgtacaatgaaaagcacagtggcaagtatatgtcagtactatcatcatcatcagagttactaacattttaaaatagtcacagtccaaagctacacacattaatgtgtttaatttcccactggaatcctatgaggtaagtatgaatattatcttcattttacatagagagaaactgaggcagaaagaacttaatagacttggccagcatttcacagctaggatgtgtggcagagccggtatctgaacccaggaagctcagaaattatgttccaagggacaccattcacataaatacaagggaaggtgtgcatttgtggaccccaatgggcacagcttggagtgtcctctataattaccagatcccatgccttggcatataccaggacaggtttgctaacaagtcaaggcatctgcactttgataacagacactttgatgtctctgtttgtttcagttttgtctctgactcatttttcagttctaatgctaggaatgtcacatagttatttcctggttttatatattcaaaagtactcctggaaaacatcttcctgcaattcttgaacaaaggagtcaaaggacacaaagttttcacatttttccagttttggtttcgatctcagtttgtaccagcttcagaaaagcactcattccaaagttctagaaatttcattaactgtgactgcactctgaagaacaaccttgcttaaattttgatgtataaatttacttctaattacagagcacacacacacacacacacacacacacacacacacacacacacacactcctgtcttaaaagttttaagaatttaaaagctatcattgcaagatgcaactccacactgtggtatgattttcatataagtcactgtagtggataattttaaaagaaaccagatttttaaagaaatattaagaaactgtttctgtacttagttctcagataagagcagaacctgtagaaccactgagtcttgtgcaaaccttttgtgtgggtgggtctggaagagcatccaggctttctcgtagctggaatgtgagtgaggcccatgtggaggtagaagcgtgaggctcctttggatcagaaggctctgtaattctgcctaaagccagccacccgctgaatctccaagagaaggcagaagccatcccttctcttggcgtattacttgtttgggagtcctccaagcgaatgtcccctaaatgtcaaacagaaccgagcactgtaaagttctgttttgccagtgcctcccttgcaatcagatcccattttctggttttggcatcgcatactgttggagaatacgagacagctttgttgacacctacaccgggtgtgtgaactgcaggctatgacacactggtggcaacacaaacctgtatcttgcttgcttcaaaacatacttcttccttatggaaagtactggaacacaaataacttaaaaatcccccaacttacttctgtcaaacatagggtgttctgggcctggtccatacttcaccagccagcaaagaggcattttgatcactaagacttgttttcaaataggaactttcaaacctttactcctaccgatccctaggatatcgtgtaggtcaaagattagcgagggaagggactggagccagggatctgggctggaggtggagtaagagtggagaactggccgtgacgagggtggagggtgcgggtggtgaggggaggcagctagttctgtgcttcccgctggcaaagagtcccccgctccctccttcttttcccctcaatgttcagataataaaaaacagtctctttaaaacatccaatttattatggatttaatctctaacgatgatatgctggagtggatggcatatatctaagaaagctcaagccttggcaacacggtgccttttgactcccagccacctgcctttggtctagttttctttttcaagttgtgatacctctgatgggaataatttttaaatgggaaaactgtgatcaagatatacttttaagtctgaaggtcttcattattatcgaaataggtgaaagaagacgagaaaatagggctgtgcttttccttccctactttctagtcacattctagaataacagaagtcaggaaagaaggaaggcaaagcaaggaaatcaagagaaattggctgaggggctggggagggagggagaattaaaactggagggagactccagagaagatgactcttgatatatgcatatgctacccatttaatgctgtatgttgccactaacacacattgttgatttcagggttacagcctacgaaacaaactgcgtactttgttcctagatacactaattttgggactccctctctgaacacacaagaaaactcaaccactacttcaaatacctcctcacacatttatatcggttggagatttgtttagattaacagactctccaagggttaagatagtaggtcattcataccttaatgtctttttttaaaaaaaattaaaatcccagctagctgcaatggtctcagtgattcagagctttgcagtaagggaagagagcaggaggccaggggaagaggaggccagccttcccttccttcctcccaccttgactagggctgcttgatgatgcccatatggtggttggcctctgaaattcttccttctcgacaaggtctcctgaaataaaatttaggtttccaaggtgaataaggtctagtttaagtaacatgatatatggaaataaagaagcttccgattctgagaactctggttgtgaaccctagcaactccaaacacaggttgtattgatattggtgagcttcttcaactctttaagtctcagtttactaatttgtaaaaagtggatagtaacaccaacctttctcaggagggttagacatctataaaaggccagcagaatgttcttatgactcctactcacaaccatttcttttcttttctttttttgagatggagtctagctctgtcacccaggctggagggcagtggtgtgatctcagctcactgcaacctccgcctcctgggttcaagtgtttctcctgcctcagcctcctgagtaggtgggactacaggaatgagccaccatgcccaattaatttttctttttctttttctttctttctttttttttttttaagcagagatggggtttcaccataatggccaggctggtcttgaactcctgacctcagtgatctgcctgcctcagcctcccaaagtgctgggattagacatctatttcttcagagcactgcacagttatcatcagctccttagccctgggtgaagcaggcacagcacagcaaacagctgcaagaagtggatgtgattctgcatctgaaagcacagaggtgggtctggacctccaagaatggagtcacaccaaaagatgtcaaggtgctgagtaaacttctgggaagaactgctggaggagcgaactctggttattggtgattcttgaagagtgtgtcctgtttcagggtagtgaatgtgacagatctctgcagcaggcagctgccacttcatccctgctcctgaaaagtgacactcgggggatacaatctgcttccaggtgctccctggagcccggaccatgaggacctgtgactagaatagcctgcccagagctgtaaaatgtgcttattctatgagacctgcaccgaaattacctttcaggaacagagaaatattctgtgaggaagctatgcaaggtggcctcttgaggaagggggcacaagtagacatttccagtttgttcatgagttttcaaaaaagcaagctatgctccttacaggaatgagaatcttgccttgttggagaataatgagtacacagatttttgtgattgttattcaagctgccaatcctggtagctattcagtagataagtaattagtaacagttttgttggaccatgaatatcagagattcataccctttgaatagaaccttaatacagcagtaaaggtttatagctgtataaagctgtccagctggagtggaggcaacccgcaacattttccatgcaaaacccactcacatgatgcattccccaccccacctcactcccgtcggagaggcagggcaaagggagcagatgtttgcacaggaattttcccagggcttaattcaagaagctaaaacggtgagcacacctgagcaaatgaggcctggctctggcgggcagccccgggcacaagccccacatttttccaagactatgttttccgcacacagagggccatagagggtagaaaagaaaggcattttcaagcttgaaagttggaattctgtccacttgctatactgttcaactttatcagctttcatgaggggacaaagaagaaccacagtaatttttagcttgttgaattttgtggtttatttatttacatctcagagaaagacttcatctaatgctaccctcccaccccgaataaaaacggcactggacactataatgttgaaatagccactgaccttaaaagccactgtctcaggcattgccagtaacaaaattgggagttggatatttaagcaaattgtacttaataaaggccatatttgcctaaatagaaaaacggagatgcagtaccacctaaagtgaaaaaatgttgaaagtttcagtagattattccaatgtaaaataaaatcagcttcttcaaatatttcaacagaggtacaagtcttcatttgagaatttacatttcccataaattaatactgtcctaatgaatgtacaattttgcagacaccagttagtctgggatcttgcctatagtcgttactcaatcaatattacttgaactgaaggacaagacagcaatctgtgagaccaaaaaaaataataaagtttctacacagcaagcattttctataataggcatatctcaaactaataaggcaggaagtatatttaaaaaaatgtttttgctttaggtctaaaagattttcctttccaactataaaacagctgaaatcatgtatcctcagcccaacataatttcacgcctaatttatggaaatagaataccaaaggcctctgaaagggagagggcaggcaggagagaaaggatagtgtgacattaacacagggacctgctccgctgttgttcggcaggaggtaggcctgggcgagtctgccctacagggcggcacagtaagattccagcaaaaacatgtgttatgcggggaggagggggcgctccgctgaatgaacttactgttacctttttccccctctaacataagtcttctttttcctgatactgtctgaatttgaaacatctaatttaatccattggagggccagtcttccttttatttcctgtctgtactgaagcagtcgcctgtttcaattacgactttctccagctcctacatttcttgtgctccagctggctcaaagtgcacttccttggaaggtaaaatgcactaactgtgctgatcggagactgatagctggagagccacaatatttaatagctgcgctgataaggaggtttaaaaaaatccatttttgagcctaaacaaaaggatattatgtagctgcatgttcaattaagatctagttaaattcttttttcccattatgtggaacctcatgcaggcagccgacataactcatagtgttatggcaaatttcatcggcactgtatgtttgagaaatgtttccctcctgcttttcagttagttactgctgatttgggaccagcttggtgcaattatttcaaagaacagaaatgtgggattgatacggcattcttgcaaaaccctggctggctaaaaataagactgttttgcagtcgagaaggcaaaaaacgtctctgggctgtaaacaccagtcaatgtatttcttttctgctttatgaaaaccacaattttttttttcttttttccgtctctccttactcatagtgtagtttaattacagtttaatctctttcagcgagcagcccttgagaccttattgttcaaccacagtattatcaaggctacagctacaatttatggcaaaaggtggaggctcccctttagaaaaaccaaaatgctcccttcccgtccccaaataaataaataaataaataaatataatagttactttattacaaactcacattacaaatttttattaggctctagagatgccaggccaataattaaagaaatacctgagaggtgttgatcaacacttaccctgtttaactctgctgggtcaataaatctgcaggaaaacttttaagttaacaagattgtttgggcctctagttgctgaaaatatttggttacactgaggggaaatgaggtgggagagagtggaggagaggttcagaagtaaaaaatggactctccacttgcttggggtacaggaaatatacagtaaagagtttgctgcaactgaaggggtgaataaggtcagtaaattatttttgctgctttaagctcacaggtatgatttagtgtctctgagttttaatacacattttgaaagaagtgccaaaatcctaggggtttcaataaaagagaaggtaaaacttggctgttcaccacaagaaaacagattctaagcataaggtgactgctcaaattcaaggcgaaactttaaccattaatttgtcgttgtttttgtttttaataagatgcgctgtttcctttttgtcttcattctttaaatgctttatggtcaatttgatttgtaaattcatttgctctaaagaagcaagaacaataaaagctctctgtgcagtttgccagtcctcactgctacgtggcgagttccccttgtgcacaccagcttggttctaaagaggccgtggaagccatgcatttcccgtcagtctgaactcacggctggccagcgggcagatgcccatgtggcgcaccccggccatccctgaggctcatctccaccactggtaactgtggcgtctgccacctccacttctcctctctgcttttttcttccccactgttgggattctgggtaaaactgttggctttattgctaattttgccagtgaatcagaactgcagtgcgtgctgggcctcagcagattcactaccacagaacactcagatctcctatgtgtcatgaattgtatatgctttcatttaaaattatagaacttcattatacattaactttatagaaagaagccagcaaacagaaaattctaaaaatttattaaaaactcacttcgaatccttatcaataggttttttttttacatggcagaaatgtgtttattctattttgtgattttctaaaattctttaacatcatacgctcattttcaatggcagctgaactatattacccttaatattttttaggctaaagtcatctctgccaaactttaaggcatagaacactaagctctcaatggaatgtatttccaagggcttcaaaagaattaatgccttcgttcgaggaaaaaccttggtctctaagtatcctgtagccaaccttctaaagaagttgagtggctttctatttcaaaaagaaatgaagacagctatcttaccatctataacagagtgtgaactttcccacctgctttatttcatttttggagctgatgggtctctcttcagtaacacagaactcatatctctgtctttatattgttagatttctataaggtaaattattagtttagttctttgagatggttcaatgctaagttgttggatttttattaaatattaatataagaaggggtctgacatttatgctttatttttcctggtagttatatatgcactacagtattacaagatacactgtttcttttctgaccaggaggaacatatcttactaaaaagtgtattttgatgtattgacagtcccccacatacatgccactgtacagagttatatggtattctgctgtactgctctaacatgtttaccataagcattctaacagtacagggcagcagttcccaaagtatggtccaggcacctctggaggtctctaagatgctttcgtttggtcttcaagggcaaaaccatttttatgataatactagaaccatacttctttggcatccacattctttcaccgatatacaggagatactgaagcagttaagagaactcaactgtcttctgttaatgcagacattaatgagatttttttaaattttgaaacaatgccactttactaatatttttgtctgggaaaatacagttatttttcataaaaatatttatcacgttatttttaaatgaataaatatcctttaaatgttgcagttttatctcctactatggttgatagatataacccacataagcaaaagtgcttttggaccctcagcatttttaagactgtcaagaggagttctgagacaaaaacagttggagaaactctggtataaggtatttaggttgtttccaattttatgctccttcattatgaaacttcaatttatatgaaaatgtagatatatgtaattgtggtaagtatataaaaatatatgtgggttctgggcttgctggtatgagacagtagtcccagctactcaggaggctgaggcaggaagatcttgtgagccaaggagtttgagtccagcctgggcaacatagtgagaccctgtctctaaaaaaggaaacaaaggaaagaaaaaaagctttaaaaaggtatctgggtaatcaacttttctctccaagtccaatttagtccctcatacattggaggaaggagttagtcattcaaaaattaaaacaggtcctagtatttgcttatcataggctaacgtactgaatactactaaaggttcttataaattgaaaactcggttttggattagagaggcagattcctttagattagggtttatgctgtcaatgtaattcaaatcaaagaaagactgaatttcaggatgggtgctctatcaactgtcaaaagagacctcgagcacatgggaacacacacacacacacacacacacacacacacaggcacgcacatgcatacacacaaatccttaatgagacccgagtctgtaggctcttttgtaactgaacaaatcggggcttaaacattgtttccactctgtccattttgttatttgacaccaaaaccgtctgttattacagctattaatagttggcagtgacatataatagatttgaatttgtctaggttagaatttaggattcttacatatcaaaatgagaaagaggctctgttgatattttcacatactgatactagcattgaatcacagggttttatttaagccatggttacctttcaaaaatagaaccgtaaatatctctcaacttcaggaaccaactaatggttcttcctctgagttgacagccactgctcagtctgtatatgtatgtcatcaggtttaggataaagaaatctcatcattcaaccactccagccttgtgaattatggatagattctgtcttcgtgctataaatataatatgcatatttgtcttaatttagaccagaaaaatctcaatacggggagaggagtggaagcagtttttatgctttgaaaaagcattttcagaattataattttttttttgagacagggtcttgctgtgttgtccaggctggagtgcggtgtggcaatcagggctcaccgcagcctcaacttcctgggctcaagtgagccttctgtcttagccccctgagaagcaggactacaagtctgtaccaccatgcctggcaaatttttacattttttgtaaagacgaggtcttgctatattgtccaggctggtctcgaactcctgggctcaggcaatcctcccaccttggcctcccaaagtgttgggattatactgcactcagcctaattgttttgttttagtcacaatatttagtttaaaaattcaaagaacatattagaggcagtgagatttactgatagggatcccatgcttaagctgacggattgttactctcatacaatcctgtccctgtttcaatcttaatcaaggggtagacccatggactgtgaaccccatgagggcagaaactgtgtccatttttcacccttgttttgacaatacctataccataaactcattagaattcattaggatagtttttataaatgtatctattattctaatttttaactgaatgacaccatcaaagccattcagtggggccaagggaggtgttttcagtaagattccagagcaactggatgtccatgtggaaagtaattaatctccatccctatctcacatcacacacaaaattagttagcagtggatcatagaggtaaatgtgaaagccacaactatggagcttctcaaagaaacacagaatatcttcataatcataaggattaaggcaaatatttcttaaaggcacaaaaatcactaaccatgaaaaaaattataaactggacttcatgacagataaaaactgctcatcaaaagagagcattaaggaagcgaaaaggaaagccacagattcggagaaatatttacaatggacataactagcagaggacttcatttctagactatataaataactagaaattcataaggaaaagccatttcccactgtattatgtaatttgcagtacgcttttctgcctccctgattaaactgataacttcttgtcatgtatttgatcaactgtgtgttcacagttcctaaggtgagtcaggtaccaggaacaaggaacatgcttgaatgaatgaacaagttgctgccgtgctgttggtttgatcctatttctcagggcaaatgatgactgttagttggaaaattgggggctcttagcttttccttatgatgaggcttggctaagttaaaggtagtcctgaaggtcacgtaactagtttcatttccttctaatctcatttttattattgccacttctaccacacatactgaagtcttacttgtccacctcttgctaaacagagacatgaggcaatggctacggtgcggttaaatgaatgacttgtagagcagagagctagctgaacatctagaacttactttcaaaagaaatggaattttcttattgatcactatttagagcttgaatttagatccggcttcctgacagtgtttcatacagtttagtacagaactgaatttctctaatcctaggtgccaggtacatacatacaatggttacatcaaaggagataaatttcaagttttaaaatattaaaaaattaatattgcctaatgttgccatttagaaaaagatcaacttatcttgagaatttcaagattttcctttcctccaaacatattaaaagataatagctagaattccattacttactaaactgaacccaacattacaaaatactactgatataaatgagtaattttttaaaaaaaatcctaagcttgctcactcagacttctttgcactagtgcatgctctctctgtgtgtgtgtgtgtgtgtgtgtacacctatacacatccattatttacctatctctgtgtctatatttaatggaattaaacacaattagtatttaaggaaattttaggtccttatctttttctttctcaaagatgattttatatcaatactttccatgaacacatctggtgtttctttatagcctggatttactaaatgtcatatctaatgaaagagggatttatgttttttcaacataaattcattttattttctccaggctcctccctcactactcaaagttgatgacttcttaaaccaaaatggttggtcagaatccaatcaagaatataaaggcaactgaataaataaaaccatgaagtaagtgtaaaatactagtgtccagacatctgagatgtatgtggctactatgaaacttccacagctgtaccggccgggagctcacgtggttccccaggtttaacagaacccattaccagtaagagttttatttgcttaataaattacattctaaagcacaatagcctaggctcatagctgtaaaattgccaaatattgtcaatgaccactctctggtcataaataacaaaataatcttgtgactcattggatttttgattcccaaggcgattctttctcgccattactcaaaaatgtgaaaaagtgcctctacgtggcattttatggaggatataaattactcaaaggagatgacataggacagatttgtaggccgagtaacaggaaccagccaaccaactgtgtaaattaaagaactagtgacaaagaagagggctagtgaaagaattctgaaatcctaagaacagatcaggattaagatcctgaaaagacaatcttggtataaaagaaaagagaatcttttctcttttcaggggaatggagggagagtgatgcaacaaccacgcatggaatatttacggtaaccggagggtgatacgttacaatacaactcaggttcactttgaaatatattttatatttatagtcttatttgcacatatcaaagggtagacactggtatcaagtgtcacagagataaacattggagggttatttttaataaccaatattaattcttaaatgtggttaacagttccttcggttacgcagctcaactacactgagcagttgctatgtggtagcccctgagccgggggtggggtattgaaattaataaggcacagccctgccctcccctagaggagctcacattccagaggagagggagctggctaactgcgtatgtcactgtgtgctgtcacagagcagccccaggtgtgggatggggcacaccagagggagggaactcagctggataggtgggcaggacaagtgggaggaataggcagggggcagaggagaagtttatttatttttatttttttgagatggagtcttgctccgtcacccaggctggagtgcagtgactcactgcaacctccatctcctgggttcaaatgattctcctgccttggcctcctgagtagatgggactacaggtgtgtgccaccacacctggctaatttttgtatttttagtagagacagggtttcactgtgttggccaggctggtctcgaactcttgacctcaggtgatccacctgcctcggcctcccagagtgctagggttacaggcgtgagccaccacacctggctgaaaggagcagttttatggcagggggagcagggtatgtgaaagaggcgtgaagagcctgatctgccagggaacagacagggaggaggggaagagggaaggttggcaggggtcaaaattactaagggtttcctcagccaaaggagatgactggacataaccttgcagacaagcaggccaatggcgagatcagattggcatttagaacgattattcctttatcactgtggctaatttcattagaacaccatttaatgatcaaagttaggcattttggcttttaaacagaacaataatggaaactaaaaacatacctttgtggcaattatgtatccttgtggcattttctgtggaaacgggaagtatctcacaatgatacttaggcatgagcttgtcttttctcctagttttttttttccctctcccagtattgctgtaaagtggtttgtaattgttttaggaagattctgacaacatgaaacagaatcttgatgagagctggtcctgtgtttagaggaaagacttttacagtcttcttttggttttctgattacttcactgaccacaagacaatgctgtgctgagtaaacgctcatatatttctgaagttgaaatgataaaataattatttaagatctttcacccttgtcaaaaagaaatatgtccttttccataaaagtcatctaagaacatactcttgcgatcttttctaatattcagtatgatgccatgaagtttgaactgccatgaatagacatttggacaaacaagtcatggaagccttatcagctgagttttattaatgtctagttataattctccagtatttttcacagagtaggtgattaaaaacaccttcaataaatgaaataaatgagtactgcttttaactggagtagattatttcattttattgtatctttaagacacaaaatcttatttgtacaataattaaaatatttagactagtcaagcttttttttttttttttttcaactgaagcccttcacaatgctttctggagacttacgggaaagaggtgtcttgcttcctgttacaacaagcatttgaaacatctacaggcacaaccttcgtgcctcactgaaagatgcaaatactgctcatcctccactgccactgcacacagtaggcactccacgtttaatgacagtgatgtactggttttctattcctattttgctatctgcaattctttgagtaagtttgatggtccattacagtacaatgtccacagaattctcttgggctatctaacacaaatccactagaaattaagtacctaattttaaaaagctctgttttcatattagaatcaaaagctctgatattcatttaaccaatgttcattgtacacctactatgttccaggtacactgctggaaatatacaaatgatacctttctactgtccgaggaatcatagtcaagtaggggaagagatctacaattaagatctaataaatgctaaatacagatctgcactagtgctatagaagtaccgcagagagaggaattcgttttgaatggtgtaaaaggtagattggcgcaaaactcacagaggcaacattttagaggaggaccttatagaacgaggaggagctcacaagccagggagaggctgtgtagtccaggcagagtaaacaggaccagcaaagtacacaggactccgagcacagagcaagttaaagaaaggcccaggaccctggtgactgatgtgaagagagcgtgagaagggggatttcagtccataaactaggaccagaggattacctactggggcctccacagtttcgctaacagtaaatttagaaaagtagagcaaaccagaggttcccagtgttggcagctgtagaatcttctaggaaactcaggaggaggatctgaggggaaaaaaagaagaaagggcagaggaaagaaaggcaagggggagagggagaggaggaagaggaagagaaggggcagcaaaggggacacagaggagaagccacaaaaggaagggagcaggtcagagacaccagaacaggaggaggacaactcgattccagttcccaaaccccccaccgactgattcaggatctgcaaaccaggggctgaggaagctgcagttattatgcaaccaggtttgagatttgttagtgtaaattctcagtctcattgaagaggaggtagatggttttttcatctgtttttgaaaagaaaacaaaaggctcagtttgatgtagatttcttagacttcagtacaaaaagaatgtatactgggaacagaaatttatttttgttagtgcttttattgctttatcttttttattattctctaggtgcttctaaaataagttattaagccaagcatggtggctcatgcctgtaatcccagaacttcgggagaccaaggcaggaggactgcttgaggcggtcgagaccagctgggctaacacagcaaaaccccatctctaccaaaaaaattttttttaattagctgggtctggtggtgtatgagcacagtcccagctactcaggaggctgaggcgggaagatgacttgagcctaggagttcaaggctacaggaagctgtgaatgtgccgccgcactgaagcctgtgtgacagagcaagactctgtctcttaaaaaaaaaaaaaaaaaaaaaaaaaccttaattaaaaaaattgaaataaaattagatattaagaatcaatatgttttcaagaatcttgggaaagaataagaattatttttttctaagctaatcactttaaagcgttcgttagatgaaggttcagaagagaaacccagcgctcaatgcctaagtgaggttattttagaaactgctactcctgagccattcctatcttcacctgacttgagaaaaagaaataactttttgaggcttcttttatcatttgaaaactttacatgatgtcccaggagacagaaagaatcataaaattcctaaagtgatgccttgagagtaattagttctagatagctaataatggatggttgagaaaacagagagagctccagaggtttaaataagagcatctttccaaagattacagcatccccatgcgacacgtaaggtcttcaagtaagagggtaggagcgatccactgacttttcctctagtaataaagcctttactgatttgtgctcatgtattattttttttaattccttttagatttttattagtatgagtcaactaaatacagaattatccatcttattgtcttataattggaaactgaaatattagggggaaaatcagagaatagattccatgcattgcttaacataaacagtaatattcgggcttatataaagacatatagagcctgaattgtaaaatctaattgcttcatgtgagtaaattttgaaaactgacattatgagagctgtgctgtactttcaaaatgaagttcagtgttctaagggaacctggagcctatttgtgatttgtgtttccactttcatttcagcagattctgacatgttgataagaaaaactaagattgaccacataattttaaaccaaatcagaatgtcagttctagcataagagtctgattaaatgcaatgtggctacaagaaggtttttagttagcaaaactgggaggctttcattctccttagctgtaggagtgcctgtaccagagacaggcaccttctccactacaggaagaagcatcccacactcaaaggaccacggctagaacagctttttgttttctttcttttctaaaagaggtgtgcattttgggactataaagactactggaacattctgataagtcttacaatgttttcaacactattactcaagataagggcacccagaaaaaaaaaacgcagctgcctttggaaccctcaggaccacccacactgtatgttctaagtttggggctgtgccacatgaggcaagagagcacgttaaacacgtgtgggatattatgaagacctgagcaacttcatgttcatagttttaaggaactctaaagtaaaagatacagatttaatctgaaggtattttgtgtttttatgaagaaatatcacatggatgtaatatatatatttgactgataacttaaaaattatattcatatttaattatactaaatctttagatgccatatgtgtacgtaaatatatatatattcaaaattcatttatatgaagcaatcctgttttataattcagtctctaaacctctttatataaaacaaattaaacaactggcatttatttcatgattctgtaacatttcctgatatttcagtttccaattaaaaatgatagtaggaacagttctgtatttaattgacttgtactaaggaaagaaaggtgtctatttcaaatcaaatatggaaaacaaaataggtcacatttgtggacaacaggcatgcaataaagtatcataaattctaagacaaaacacataatcatgttataaaacacccctctttaagatgaaataaattctgctgtgggttaatctcccacgtacatagtacatctttttcacatagaaagctggggctccactctgtgttcaaatacttcagatcatttcagattttgtcacccaatgcatgtattgtctgcaataaaaatgcaattcatctaccgaaaaaaattcagcaattcaccttaggcaggcttagagtctcaattagccatataagtaaaaaatttaccccaagttattatatgcaaatgtatataataagggatattttcacaaagtattatataacttctgtacttctggagaaaaatagttacagcagaaaatttcagtgccttcatttttactgctaagttctaaacgaaggctacatgtggtctcaaccttattgatcccactgaatagatccctagacctgcgcaacagccttatatggaattaaaaggggaccttccacttggtgaatatggccatggaataatccatttatgtgaaaaccaaacgaaaaacagtctaaatttttgttttctcctttgtgatgggccacatgcttttttcaaacatcttttattaaaaataatctataaggttgttcaagtgagattttaaacataaacccactcccactcacaaggcaaaagatgagacttccaatccctttctttttgctttcttttttaaatgaaaaggaacacaagaagaaggccaagacacattctacagagagcgtgctgtcgttagctcagctgtttttgatgaccctctgcctgttttacaccttatcctgatgtcaattcttgttttcactcttccagatttctttcacaagaaaacagctgacagaatgttgcaaaataaagaggaaaaggaagaacttcagctgggaatagaaagtcttcatccatgacaccaaatccatttccccacctctgacacactatggttgctaacattcccggctctctgcaaggggaagtaaacgagcacgcatgctcactgccccaccagtgagggcgctgagccaagttgggggcttgctctcctgccttgatctgaccctgaaggtggtgggatagggtaggcggtagagggtgggagaagaagtgaccattcattcgcctatctattcactcggtatttatgagagcctactgtgtgcttggcaacatcccaggtggtatttatggaagatctgccatgtgctagcaggttttaattatctcatctttgtaccaccttagagaaataatatttttatgactgccagataaggaaatggattcagagagcttatttaggagtcttaaatcacataaaacgactgatttatgactggattccaattttgtctcattccaaagctcaggtgttcactgatgactgtatcatggggacccaacaaaataccaccattaattcgatttattcatatacagtggcagcactcccttctaaaatacggatattatccaaagaggtaatatggaagacagtactgggaattctcagtatactgtaaacgattttgctttgttttctgttttttataactcatataaaagtaatatattctcattgtcattaatcaaagaacacagaagtgcacagaattaacaggtttctccaccttttcaaccaattaatgaacatgtaaagtttagtgtatttcttttcatacttctatctctgctcacaaactgcaacaaacaaatacagatttgtttttctccttcttcttctttttttaaagtggtggaggtctttctttttgtctgctgaccataaggcacaggtggggataggagtttcaatggaaggggggtggtagagtttggaagactaggaaaactgccagagaaaagcaggtctgggtggggttgtcacagagtttaacatttcatcgagaaaatatttttttccttaattctaaagcagtatctaaaaaaatttgtcattagtaaattagcagtgtccatacctaagaaaagcggcatgactagatagaagctggtatttatacatatatatttaatacattgctcctttacacacacacacacacacactcacataacacacatacaagatgctactgatagattgcaatctagaacatgccttcctgttctaatacaaatgggtctgcattttcttttaacttggcaaggttgaaaaacagactcgtcataagtgtgtaatgtcttgaaccaaaatagacttccttaatgatttgttttctccaatttcaccacaaaatgtaatgcagccaacaaaagaactattcttccccccacgtataataacatgttattcaacaatcatgtaagaaagcctatacataagactgccaaggttctgaaattgagtttctaactgaaatgtttggaaagaaatcttttcttttttaagttttactccgagggtttgagtgaagtgatataaatatctaggaatatacagttttgctttactactataacatgcttacagaagtagttatggtttactttataacatgggtcactgaaaacattaaccataaaaacatataaaagtacaaacaagttctcagtagaccatttactctgtagcagaacaaacaatttaattgcttctgtccttgtgagggcaatagctccagatgaagctgggtcaggagcaccccttggtttgtggggagtctacaatctgcatgctattcacgtgacctgactctctcaatacttcaagggtctgcaccctaggacggaggtaaaagcctggttaacagcaggaaaagcaacccattcccagtacggtaaggaagattataacagaatgatcaactatttttctttttctttctttttttaatggagaactgcaaaggaaagaaaaattgtaatggtgcaaaaagctaaaaagggggaaaaagtgaatccactttttacttttctgaaatacagagcttgccttaaaagtatgccccataatcactagcccacctgaaaactatagaaagtacagaagactgaactatgcaaatacataatctgaatgcacattaatgcatgatgcatatttatggtatgacgacaggtataaatattaccaaaaatgaatatatctcctgtatctgttaaatttctgggaaataaccaggtcaactaaaatgtgttagccaagataagacatagttaatgcatttttaaaaattagattatcaaaacacgtttttctaacgagtgaaagttaagtttttctaaataaaagttttctcctttggctgggtgcagtggctcatgcctgtaatcccagcactttgggaggccgaggcgggtggatcacctgaggtcaggagttcaagaccatcctggccaacatggtgaaaccctgtctctattgaaaatacaaaaattagccaggcgtggtggcaggtacctgtaatcccagctactcgggaggctgaggcaggagaatcacttgaacccaggaggcggaggttacagtgagccgagatcgtgccattccactctagcctgggggacaagagtgagacttcatctcaaaaaaaaaaaaaaaaaaagtgagcaaggggagaagaaaggctaactatctggtgggaaaaacactagtacaagcacatctatatgtatgtatgtacatatatacacatgcatatatatatacatatatacatacatgtaataaatatacatagaccctggatcatcaaaaaagtggttgattttgtatttctgatttaggtggggatcccaggtttaaactccaggtccactatttatcacttatgtggccttttgttacttcgcttctctttgtctcaaactagagataataccactcaccttaattctaaagcatatctaaaaaatttatcattagtaaattagcagtggtcatacctaaggaaagccgcatgactagatagaagctggtatttacacatatatatttaacacactgctccttcacacacacacatacacacactctcacacatacactcacatacaagatgctactgacagactgcaatctagaacatgccttcctattctaatacaaatgagtctacattttcttttaacttggcaaggttgaaaaacagactcatcatagtaacttagcagtggccacacctaagaaaagcggcatgactacacagaagctggtatttacacatatatatttacatactcagagaaataaaaagttaatgcaggtaaggcccaagtgttataccctgcaattactaagtggtttattttaataaactcaaatgtttttattcgacggattcattattttctgtgaaaagcactgagttgtaccttggtgtatcagaaaagtcacatggaaaagctcttctctttgaaagatatttctttatatccacttaaaaatctaccttgggcctgggtgcggtggctcctgcctgtaatcccagcactttgggaggctgaggtgggtggatcacttgaggtcagaagtttgagaccagcctggccaacatggtgaaaccctgtctctactaaaaatacaaaaattagccaggcgtgggggcaggcgcctgtcatcccagctacttgaaagggagaggcaggagaattgcttgaacccaggaggcagaagttgcagtgagctgagatcatgccactgcactccagcctaggcaataaagtgagactctgcctcaaaaaaaaaaaaaaaaatatatatatatatatatatatctaccttgggttatgtttctcatagagatagaatatgacaagtagacattttaggagtaatgtttgtctccttgcttcactgtaatgataaaatcattaaagaaaataaaatagtatgatacagattaggaatcctcatgctaagcagaaagtattacattaattttgagtgtttatcttggtacactctacacaataactacatatatcacacaaacatttctgtctggtactaatataaaaagctctctgaaaacaattattttatgatattgtacattttctagtttttcttatagtttataaatacatatttctgacttagcattaatgaaatgaaacctaaaatcttgaaaacatttaatataaattataaataggggaaaagtacttagggtagttagctgctactcatgtgttactgaaagaagaggcatgaattttattatgaaaaaataaaatgtggataaagaatgctttggtagtaaaaacatacacacaaaaagcactggatttcacaatcaaagtccaatgagaattttccccctttggcagtcaaacaaaaattccaggaaaatagtttaaattcccttcacaaagttcaaatgtagctattggttattaacttgcaaatataagaaataacatttcggtctgggtatctgactaatggttatttatggaccctataaaatttagaataacttttgcatttaatatatctcacatgaaattactgtttcagtagtccaaaatctgtttactgcaattccatacagatgaattataattctaaatagaatcctcaaattctgtttacgttttaatgtaaacacttcacctacaggaataagcagcactcattatttctttagagacaagaatattgtagagagctaacaactcacttttgaactgagtaagttcactgaatttccaaaattctaataagcactatagtttacatagtgctttataactgcaagcctgctgctttttaaacaatgatgcattcccctaaattcatattttaaaaatatgaattatcagttgagatttctctgcctacaacatagaaatctctgctcctggccactgggtggtcctgcacgcatgggcatggggctctagcccaggcctgcctgtcactaacttctctatggcctcagagaagtcacagggccaatgttttctaaacacatgtatatttttaagttatggaacatgcttacaaaatgccacctcattgtgtcttgtatacatggactctatatatggatgcatatactgcaaccaattatagctatcccagagtgaaaggatattttgagagaagcaattattacagcaaatgagacaggaaacatccttttccattgctcaagaaacacagatatttgtttcttgtctctcggcaaaaatggaaaaactctcttgcatttcggaagtgagtgggtctcccggaggttctgagaagggtctatgctaagtaatcctaaactgagcaaaccctcccagctccttttgagcggagaggctgaattcaacactgccaggggagccgcggctggtgggtggggacggggggcagctcgctgtcgtgggctttagggagcaaactctgccaagctgggatgggcgaggataaggagggaaagacggacagttctttggtaataaaaatgcagtttatataaactgtaggagacctggtgagaaagtaaaagaggtaattgtgcacattccaaacgttttaatatataaactgtgtaaccatcactcatgaatagcgcagctgctaacaatttatttgtttttttttttttttttttttttttttaccaagataaaaatcatgctaaagccaagagatgtttctctagtgaatgatattttgaaactctggtcaaaacataactgtgacataataaatttttaaagaagtcatgaaagcttgtagtttgaaatttgaaagaagacctagttttttccccaattaggaaggaccacatttcaactttcatgacagtggcgggctcagtcttgcggcgggggaggggacgccaattctgcatgcacatctgtttccagtgcaatgctggtatgcaaactattgtctattggaagtgtgtcgtggtaacgtttgccagggttaaaggctgggtcaatttgatcaagacgctaaaattagcttctgtgtgttttcctgaaaagaaaaaaaaatactgtaaagctctttgttttccttcaagtaccattctcagatttcagtttctggtgtgtaaactaccaggaaacagacggctatgacaactgacttcttgttcactgagtcctgcataatgaaatggtaccacacgtcaccaagctggagaactcagggtgaaaggtagctttctgacccaactcacattttcccatttaaaaaatatcaacattataaaattacttaatgtgaatgcatttggaaattcaaaaccatagctatattttaaagtgtgtgatggcttggcaaagcccaaacacatttagaaactcatcattctgagaagtattggggtaagatttaggtcacatatccctggtagtattgacagtgctctgattattttcacaggaagtgagtttgttaggatgaaaaagagggaaaaaaatacatatacaaactccggtaataatctgacgaattccaagagtagaaaggaatcgtggaaacaatacatagtcatgagatagttcaagaaaaatattgatatttttctagattagcaaaattagaaaattacttaacagttaatattccaatagatgacaaagatgaaaaaaggagaaatagaattatctgttaatgtttaaggctttgtgatgaatatacaaataaaccaaaagtagaagcatgtttgaaatttatttacatacttggagacttgctttttcttatatgagatgctaagtcaggttacaataatatagaagtaaaaacttcagtgaaatgcctcgcctatattttaaatatttcaatactgttaactttaaaatgacctataatgtaaaaagtactttttgtgtacattttactataaatatttccgattaagagaagtctgacagaagaaataaacaggttttccccaaattacaaaatgcaatagaaaaatccttcaatctagttacagtatggtgaaaatactataaatttgggtcatttataccacaggatttccttctttgcaaacatcctctcaattccagtggctttttgtacttttataatttagagctcattaaaaagatttggtatggatactagaagtgtgtaaaatatttggcaaaactcatttgtaaaatgaaacttatttgtacaacatacataaaattacccaatttttatatttaaatgccctctagagccaaacacagcatggtagttactactaattgcttattttcttgggtcagaaattagtgaaaaattactatatatcgtgacaccaaattaataagattccgtattatctctaatttctcacaaccagctcttcttcagtttaaaatctgacctcttttctcaaagttatttgtaaaaatgggaaggataatattgaactgcaataactcatcaagtctaaagtttttcagtcatgatcttcccaattgtatgttcttacacagctgagcacagccttctggtggaaagaccctgggctcctaggacactacaaatggcaggttcatcttcttcctcctgcatgtgtcctgaggattcctaccccccaccactgcccacatgccctttctggcacctgaagtttagcatttcctaaggttgtgaccttacctcccccttcttttccttttacatactgttttccagtaaatttacccactaatatatatggcttcaaatatctatgtttttagcctaagcattgttaagctaggcacagagggtctatggagggagtttgaatattcattagactcctgatactatgttagaatatatgcataaatagatgcattttttgttgttgttgagaatccaaaatggtcatggaaagctgtccatgactcaaaaagaaaagaaaacccaacctcaccaccacttgctacaccagaatggctccagcagcctaactgagcaccttcactggggtattcccagcatactagtacttcacactcaggctgttctcatgacgggcctcctcctaagaacatcccttctcctgtgtctcctgtgtgcttatgctattaccaccctaccatccctgagactctcctttctccctcatccagcaactccaactagtgcaagcctgaggcttctcttctcatctgtttccaccaccatccctttagcccgggacccttgaagtatactatgtgattgagttgccttataaccttctcctcatccagggtggccagtgttgcaccattccaggggctgcaattcttgtcacattctctgcaaatgcaacatatctccatgcaacgtgacggaaactccaaggctgtgtgcacaaccagtgaattcaggtgtgcacttctacactttctacaacatcattctcacttccctgtacagcctatttcaactataccgccgcgccccgccccccatacaaaattaactattcacattccctgaatacgtccacactttttttgtctttgtgtcacaacgcctgctgatctgtgttttggaaaaatatcaccaaatgcccacctctcacaatgcctggtggtctgtcttctgttggtctctcccatgaagttttcagtagggcagagtgtaagcatgtgggtatcagatgaggatccaaaccccagctccactaacatgaactactcaagtagtcttttgtaaactacttgaactctccacacctagggcctccttttaaagcagggacaaaatttaacagttaggatgtgaggattaaatgaaatataatgcctattaagtacctggtactttttaagtgctcaatattttttagctgttattttaatatcctcactcccagtaacgatttcattctcctgtatcctctgctttggactgtggtaccatacgtttgttgttttcctgcctcccaaatatgattttagaagtcaggggcatgcactatcatatttaaatcacctcgggcacccagcacggtgccttacacatagtaggtgcttactaaatatgtggttatttttctgaagtcactctctcttgggccagaatttactggaggtcaaggaggcaaaagggtggaagaactacagagatgttagatccttcacttgcagataaatcgcattacgaaagtcagtcaccatttcagagttgcacacaggacacaatgcctagtgggtatttacatgtgccaaagcaacgcattggctgagaagatcgctgatgacgtttaacttgtatagcatccttcaaaacatcatgactcttgggagaacatgttcattggatacagaaaacataaaaattctacaaagcatatattttcttacctcttaaaaatggaccaaaccaaatgcattacaaaacctcaggtttacaaaatagcagacaaataaattaaacactggcataattgagctatggtgaataaatactgccagtctaatttgaggaactagtttgaacacagtcatgcatcatttaacgacagaaacacattctgagaaatgtgtccttaggtgattttgttgggcccaaatcacacagtgcacttacacaaacccacatagtagagtctactatacaactaggccatatagtatagcctattgctcctatactacaaatctgtatactcatttaagcaactataacatggtgataattatttgtgtttctaaacatttcgaaacagttttactgtgcagtaaaatatagcataaaagatagaaaatggctgggtgccatggctcatgcctgtaatcccagcactttgggaggccaaggcaggcagatcacttgaggctagctaggagtttcagaccagccgcctggcagacatggcgaaaccccatctctactaaaaacacaaaaattagccaggcgtggtggcatgcacatgtaatcccagctacttgggtggctgaggcacgaggatcacttgaacctaggagggggaggtggcagtgagcggagatcacaccactgtactccagcctgggcgacagattgaggctctctctcaaaaaaataaaaagatagaaaatggtacacatgtacaggcactcaccatgaaggaagcctgcagcactggaagttgctctgggtgagtgagtgagtgagaggtgagtcaatatgaaggcctaggacatgactgcacactactgtagaatttgtaaacactgtacacttaggctaaaggaaatttaaaaataaggtaattgtgctatgatgtttggatggctaccacgtcactacatgattaaacaattttcaagtccattataatcttctggtatcaacactgtatatgtggtctgccgctgaccgaaacgtcattatgtggtgcacgactatatctttagtaagaggatcttggaatatttctaagtagagagcatatgagatccaaatttacaaatagacataaaatttattttagcaaattgttttcatgcaaaaggaggttctaaaattattttaagtgcttaaaagtttgttgtaggtgtgcattatttggaccttgtctaaaccattaatatgctaaacaaatcctttctgcagatattgtcaatatagttataaactccaaattaatgaggcaagttaaaatagcctgactttaattacacataatacctgattgcattttcaattctgaggttttatcaagaatgtcctgaggccctatataagtttcaaattgttatctgaaatcatttcattttagaagcccagtatgtacaaaatgaagtttgtagagctattgtttattataatttaacaaatatctggctgggtgtggtggctcatgcctgtaataccagtgtttagagaggctgaggtgggaggatcacttgaggccaggagtttgagagtagtctgtgcagcatagtgacactctctaaaaaaaaaggtttctttaattagccaggcacagtggcatgtacctgtagtcctagctacttgggaggctgaggcagaaagatcacctgagcgtaggagttcaaggttacagtgagctatgattgtggcccgcattccagcctaagcagaagagctacgctgtctcttaaaaaaatatatatgtgtgtgtgtgtgtgtgtgtgtgtgtgtgtgtgtgtgtgtgtatgtgtatccaggatatatatatatatatatgcacacacacacacacacatatccaggatatatatacatatatgtatcctggatacacactcgcttcaagggattgaatacaatgttttggaatatatatatatgtataaatacatgttttggaaaacatgtatatacacacatgttttggaaaacctgtatatacacacgttttagaaaacctgtatatacacacgttttggaaaacctgtatatacacacgttttggaaaacctgtatatacacacgttttggaaaacctgtatatacacacgttttggaaaacctgtatatacacacgttttggaaaacctgtatatacacacgttttggaaaacctgtatatacacacgttttggaaaagtcctaaggtagattccttagctttaacgttttacataagctttagtaaaagataaggctttgatatcattatttcaacttccactggctgaagcagcttccaagggattcaaaagaattgcacatattttttttggctattcaaaacagctgcatagatgaggggatttaggaagccaccatgcatagccagggtgaaatgcagactcagaaaagacctcacaagatcttaagatttcaatttgggatgatccctggcacagacacaccctacaacagttagaaaacccacaggaaatgctagggaagggaaagaactggatttccaaagttaccacattctaagattcaaatgtccaggtttcaacaacaatggaaaaataagacatagaaaggaaaaggaaagtacagagcattcaaaggaacaaaataaaatgacataaaacatacctgaggaagcctaaactttggacttaccagataaataactatctttaaggtaatcaaagatctagggtaagtcatggacaaagacaggaaaacaatgtatgaacaaaatgagaataacaacaaaaagagaaattttaaaaaagaaaccaaaagaaattctggagctggaaagtataataagtaaaatggaaaatacaatagagggggctcaaaagcaaatttaagcaagcagaagaattagtaaatttgaaggtcaaattactgagtttgagaaacagaaagaagaatgaatgaaaatgaatgaaaaaaagtgaacagcgcctaaggaactcaagggacaccatcaagcagaccaacataatctgcaggagtcacagaagaagcagagagaagaaggggccagaaagtgtatttgaagaagtaatggttgataacttcccaaatttgatgaaaaacatgactctacaaatccaagaagctcaccaaacaagtaagataaactcaaagagaactatcctgagacatattcaaattgtcaaaagccaaaggtaaagatggaatcttaaaagcagcaaaacagtaacaattcatcacatataagggatcttcaatatgattatcagccattttctcatatgatatcttggaggtaagaaggcccagtggctgatatattcaaagtgctaaaacaaaaacaatgttaaccaagaattctatatttagcaaaactgtcccatgaaacaaggcagaaaataagacattcccagataagctaagaaagttcattaccactatacctctcctacaagaaacaccaaagtgagtctttcagcttgaaattttaaaaatgtagcatagttgacccttaacatggagggttaggggtgccaaacccctgcactgtaaaaaaattacatataatgtttgactcaccaaaaacttaactactaattccgactgttgactgcaagccttgctgataccaagaattgttgattaacacatattttgtatatgtgtaccatatactgtattcttacaatgaagaaagctacgggaaaaagtttcattaggaaaatcataagaaacatatatttgctattaattaagtggaagtggatcatcataaaggtcttcatccttgtcttcacattgactaggcttgagagaacaagaaaggggaggggtcggtcttgatgtctcaggagtggcagaagtggaagaaaatccatgtataagtgaacctgcacagttcaaacccatgttgttcaagggttaactgtgtatctatatttctaaatgaatatatatggatataggaagatacgtgtgtgtatctatgtatgtgaacgtgtgcgtatgtgtatataattttaaatgtttgtataaccaaataaaaaaatatattatgcataggcattttcccctaagaggttgtttatccaagttgaccctacacccaatttgttttgtttgttttgtttctgggacacagtcttgctgtatcatccaggctggagtgcactggtgtggatcacagctcactgcagacttaacattctgggctcactcaggtgatgctcctgcctcagcctgtaaagtagctgggaacacaggcacacgccaccatggctggctaatttctaaaatgttttgcagagatggggttctgccatgttggctgggctggttgtgaactcctgggctcaagcgatccaccctcctcggcctcccaaaatgcagggattacaggcgtagccaccacatctggctgcttacacctagtattttaatgaatcttcttattaggtggacggggggaatcaaatcatcatcaaatattccaagccactttatacataggcatatatggtacattttaactcttcaacacttagctcaagaatcaccctctgtgtgctatgttcttggaaagctgcctcttgcctcagcctaattcagaatcctttttctgtatgttctcataactactgtcacaagccttggttttgagttatcttacatagagctgtaatcactagttaacttatcagtctcttcttctagactgccgctgtccaatatggtagacactagtggcttttttatttaaatttaaattaatcaaaattaaattaaattaataatttagttcctcagttatactagccaaatttcaagtgctcaaaatctacatgtggctgttggctatcatgtgggacattgcagatatagaacattcccataagcagataaaattctattcactaaaactactctagatcaggatttcccaacctaggcactactgacattttgtgacaaataattctttgttgtggagtctgtcttatgcattttaagatgcttagcaacttctacccactaggtatcaagaccattcccccagtagcgacaaccaaaatgtctccacacattgccctggattgagaaccactgttctagactctaaacatcttaaggagagggagtatgtgtattcagctttgtattacatataaccaaccacagaggatatagtacaggggttcaatgtatgttaagaaataaagacaagaagatgagacagaagcaagccctaagcagtgagtggttttccactctaacaaaggtacaacacttctctagtttttttaagccaacaataactacagcaataaatgatgtagttgcttttgcctagaatgtaagcgaatgataaactatatctggcacctgttcagaaatctatgtgatagttattatcaacaagatattaaattatctgaaatttatataaaattgaatcctccacactatacactatagtatacacactatactataaggcatttcagggataagaaatatatataactcttagaacctcttcgagaatatgcctgttttgtagaccgatatgtgaaaatgtacccaaacacttcagaaaatgtagtccttccattcatgtctaggaaactatttgcccaaagcattataatttttaaatggttcttcaaaagtaatgcacataaacatgattatcttgtttgctatatttggccaatgcagatacaggttcaatattcccaaatcagaatgatccagcagagttattctggtaaggccatttgtaaattgtttcctgattggctacaaaggcattactgccattataggattaaagtaagtcaatggctttcttccctctaaatcattccgctggttacactggcctcctggacgttaggtcaaagccctcccatcctgaaactaaaggagaattcagtggctgtgtcccatctgccatgtgtgacaagtgatataagcaagaatgcctgtactctggatctgccacttaccaatgtgccatttctcagtttctttagtaaaacgaggagtccagataatcattccttaagggaagcgtgaagggaaaatctctatgaactgcaaaacactaaacagatgccaattttaagtattttaggtaaggttataaagtttttagcaaagggactaaagaagagcactcatcaatgagaattacaatcccagaggcagttagggaaacatgacttagtaaaataaaaataaacactgtaggatgccatgtcactcaggcgatagaagaaagttttttattccagctttctgaggattcatccgaacacacatattcctaacctttttaggttttttataaaatcttgaaaattctttaagcacctgtagggattatttatctgaaggagctgaagcctgcttctagaggtatttgccagagcaagctagcatattgaaaaattagatgttcaatccctggtagcctagttccagcccacagtcaccatctctcaccaggtctctacacagccaatgcacaaaggccaaagaggagtttcagccacttttaccctccccataagaatttttgtaaatacataattccaaggaaatttctgtctggtcacagttggtttgtttttagaacaaaaaaccataaggtggttgataacgtcttcagaaatttaataaatatataaaaactaccatcttacgtggtttgattagcactaagtgaaggtagggtacagaattaaaatctctttagaacagtggctcatgtctataatcctagcactctgggaggccaaggtgggaggatcacttgagcaacttgctatattgcccaggctggtctcgaagttgttcaggagtttgagaccagcctgggcaatataacaagaccccatctctacaaaaaataagaaaattagccaggtgtggtgtcatgtgcctgtagtcccagctactagggaggctgagtctggaagctcctcgaacccaccaggagtttgaggttgcagtgagttatgattgagccactgcactctagcctgggggacggagtgagactctctatacccctacaaaaaaaacaatccaaaactccttagagattaatttttatttgtagcatttgactctgtgactggagtgatggcttttattttttttatgtgtgttggagagcatgtaaatgcactgacagccagtcacagcatgatcacctacttttgtgcccattacacaagcagtaacttggctgttccggactcactggatgttcaggatgaagaagtggagaagtggaaaaggacaggtaaaggtaagccagagccaaagactccttggtcttaaaaatagtccaccacatgcattgttagcttgactgcaaagctcttttcagtgagaaaagaatgaacaaagtgaggccgacacatttcagaaagcatatctgcaaactgcctataaggcaaaagcgaacttttcattttctgtctcgtaagttctgtctttgcctgccacagacctgatgagcttcagcggaaaagtcagcatgaacatgtgaagcacacgatgaactttatcaggctgcgtctctgtggccactttccagatcacatatttacccagtaaaaacattcaggccacacgaggaaggaagtcttcggctactgaagatcattagtagcactgagtgcaaccactgtcagttttgtggggttggcctctgatcactcacacaaaggacggaaaattgctggcgccgctggacctgtgcccagctcacccggcagtggagcgtatgaaagcctttttttttttttttttttttttaaactaatgcactggaagggggcaaagggtggcatggaccctcaggcacattaatcagcaggggaattggccaaatgtcgtctcccgctgggcttcaatgccaaaactacacgtgtcagtgacttccagagaaggggaggccccagaacaacactggacacatcaaatgtcctcccttccttcatatggaaagctcatctcggaggtgtcaggataaaacatgagaacagcatctgtcctcagagaccaagcagagtgattcactatttcatggcacaatgaggggaggaggacgctgtaataaaaactttataaggtgaaatctaaatcctgaatgcagcacacatttttaaaactttttttttttgccttttcttcctttcccttctcctccccttcctgagggaacataacacaaggtaattaaattgtaaattacttgagagagaaatgtttagactcatgacaagtctttgtgcagaaaacaaaacttcacaccccacacatattttggatgacctaattcttccagcgaagtttaaaactataaccaaggttgtttaaaaaaccattttcacatggaagggcagtgggttgaaagatcctcattattcaagagaagggaaatttatgaaggcagaaattaataccaaacccaaactgctcattaaacaaacaaagtaaattaagaagttgttggttaggttttctctatttctagtcaatatctaaatgagaaacatgctctccttaaaatcacaatgcatatatcgcatcaaatccatagaacaactctaatattcttactcactcaaaaatgaagacatgtatatacaaacataactgaatcacaaagtcagagcttaggttctggttaaaatttacaaaaaaattaaatagaaattattaagaattagcaccttaaaatctagtagttaaagttcaatcctggtaggttacggatttgcaggttaaaatgcttggcatgctttgaaattaaaacagatgatattaatttcatcaattatcaagaaaataaaagctattctataaggattcattaaatgtccattgaagatttaaaaatatttaaatctaaaagagattccatttaaaatgttctcagtggtgggggaaaaatgctgggctattttaaggcactaatttccatctggtagaacagatccagacctacaatgttgcatttccctgagcaattgctctgagggcctggaggttaccaaatgtcagaggcaccatgatacatcatctgtctgttggctccagttgggatccatcttttcttagcgcttgacatctatggggagagtcggcaactccctttcattaaataacaaaacacaacaaaatcctttatttacagtgcttttgtaagatttggtttaagcatcagaagtatgttaagcttttaacatacttctaagttaaatgcaagattactctgttcttaaagagaattgaagggcaatttcttattaaacaatttcctattaaacttattaaacttatataaactataacttattaaactatacaataattccagaataactcatttttaaagatcagatattgcattcatatggttaaaatctcaaaaattaatgtgacattactcgattttctccatccaggtcccgggaaccctgtttgttccgtcccccttcctgcaaccaggcaaccacaggaacagttttattacccccatccacctttttatactactttatacacactattcttgttttttcaacttaatgtctctgagggcatttcagtttcacggagaatgttcttgtactttcctacagatgcaagcaaatcacatgatagatttaccacagtttaattatttttttatttagatattaattagttctctactgatagagagggagagggaaggagggagggaatataaagtgagtgctaagtgctaacacggggcaaataacacggacgggaggggcacagagtctgtgttgcgtaagggggggtctgtcagggaagttttccttgaggacatgacattgaaactggctgaagaacaccctaaggcagccagaagaagagcacacagggacagatcactgggatagggtggaggtggcttatgctgctgcaggtcggaactcagggcagcattctacattctgtgtctctagaagagtggaaggaggcggctttgctctcctttcccaactcagctcccacaacatctcacatgctgggagatcagcagcattctttgtagggagttgttataacaaatttggtgaattcttattctgcttttacagaaaataatgtgaaacagagtttacatagaaggagatatgtcactataaaataatctttaaaaatctagtaattttcacatttaaattactaaattagatttatgtctttttaggcttgataaaccaactattttataagttcttagatctcttttgtatttctaattcaaaaaacaagtgcaggcagatgggcataaatatcatttaatttgttgattgtgaggaaccatgaataaaactgcacataataagtgcatttggagtaaaacaattctttaagatatcaatttggtaatagggcaaaaaataactgttaaatcaaggaaagaagaggccatcaatttaatgttcatgggagtcattagacatttttttcatttgctttttattttattttattttttatttattttattttattattatttttttgagacggagtctcgctatgtcgcccaggcaggagtgcagtagcgctatctgtagcgctcactgtaagctccgcctcccgggttcacaccaccggagctgtgactacaggtgcccaccaccacgcctggctaattttttggatttttagtagagacagggtttcaccatgttagccaggatggtctcgatctcctgatctcgtgatccacccgcctcagcctcccaaagtgctgggattacaggcctgagccaccgtgcctggcctcgtttgctttattttttaagtacgtttttgattcactagtatcttgtcatgcctgatagtctcttttaaagtctctttcctggtggttttgctgtgtaaatgaaagaaaaactctgagacctgaactcaaaatttgaggtatgaaagctagtagaggccaaatgaaatgctcacagatcggcatatgtatgttaccacgtcaccatcaactaagcaactgctacgctatttcactaaactgaaaaaggcatttgtgttgcctgttctaatttgtttatggttggatgtctatcatagtattttctattatgttgctagataaagacatttttagagtttcactgaatctgcaaagtgctggtgcatactttatgataaaatagctaatgtcctttcattagtataatgacatctactaactacatcagtttgcagaaaaatattcttacgaaaatagtccataaaagggagattgggtagaagcggctgatgaactggttacattaacatgtgtttcttcactgaatttcgtatggtttcccctcttcttcttataaaactctatggactctggcaaacccttcattcttttgcagccaagctctcattcaggatagaggacacctgaattacataaatctctatcacaaagttacaatttctgtgcagagcaagagctgtcaggaaaaaggtaatgaagaagaatagcttagacagagggatttaatgatatccagctgctattctttggtacttgctgataagactttgttttaagtttacaatagagaaagtttgggaaaaggctaaaaattcatatacaggaagtggaagtctttatatttcatttcagtttccgctaactcttgcaattacgttcatacaaagtttaattttcagaatgttcaaatatgtcactgtaagtctttaaaaataaaatgtaaattgcattaaaatgtgtagaaatattgtaccttagggaaaagacaaccaatttgggctcaccacatgttcagatgataagataaacctgggaaagtacaagattcttaaatgtttattataattgtatgtcatcattgtggtgatttttctgtatttacaaaagggcaggggtgggtggagggaaagttctttgccaatggaagggacatagccggttcttcaaaacatatagtaagttaacataaaattacagaaatgtggtctttgcagaatgggaaaccctaaacaacttacattttactcaggatttagattccatgacaatgtggcctttttgcttcctaatctgttacttgcatacacgatgcttaatggcacgactcaaagtgttggtaagtgtggtgtacccccgtcccgaatcctgaattttctgtggacaggaacacattttaataaacgcttgcctagtaaaggaagttactgggaaaattctctgtgggagccaagcaatgaagactctctcaagaacttcgacatcttatatgtgaatactgcactcaatggactgactgccataggggccaaagagttaaagcgaaggcacgatattctttcaggctaatgaagccttcctgctgggagttccttccccagtgagtgggaaagacgcaggatgaatggctggggctttgtgcactttcccacaggtctggacaggatctccagctcagcatctacagctcagggaggaaggagacccaggcctcacagggagcagacaggaggactagggggacactgctcaggccgcccacaggctccactgcccaccaagtgctctgaaaggcttgacaaataaaagcattgctatttttttaagggcaaaaggtgcatgaaggtcagtggtaggtacctgtctggaggcattttatgctattggtgcaaacctcccacgagttgaacttaaaggaatgttccatccttgcaggaagtctccagatacaggaaatgctaataaaagaaaaagggaggaggctttgctctcctttcccaactcagctcctacaacatctcacattacaaatttgcaaactaattacttagagccagacatattaaaaaatttccctttacaactaagtgaatacagaagagaatcaaaatagagctcttggctccagacttagatagggctctgaatttaaaagtctaattaaggcaaatcatgtttgctatgtagttctctcaaacactagcattattgaaattactcctaacaacttaattgatataaccaatacctcaagtaaagatcatgcagtaattagttcagcctgcagaagttggagtatcagggatgatgaggttttctataaaggctttggctgtttttttccacataaatttacctctgtgaaattttgagttagacaattttattttacactgacttggcaatgcaaataaaatatcgaaaatagctgaactgttattaaatgggatgatttcttggttagtactgtgattggtatgaagagcggaggaattcctcttttgtctctttcccttggagctctctattgaaaggagaaaggggagatggcagtattttatgagtcattctttggaacagcattccaagtgtgatttacttaatatagccctataaatcacctaatgcagaaacaatctcaagatctgcatgtaaacatacctattaaaatattacaattactctgtttgcttagtgctcataaggtatatctcatctgaaggtaaacagctttttccctgaggtgggacatccaaaggagcgtccaaattacatgcccatgtaaggatgctgaacttgagaaaaatatcacattacctaagtacaacgacaagtgtttgactaggagagggactattatacctttagccgacatttttctgccttcaatttgctgctctggtttgaaaatccaattcatctaatttcatagttggctacagcactggttggtaattattaatcacagagaaaattttcagctcagaaaaaaaaaaagtgagcatgtctacatttgttttagtgatttgctccgcaacagccagagggcatttatttttaaacaagaagtgagccaggggacccagatctatatgcttgtggtactgcttatttttggctcataagacttaactttctttagtatggtaatctgtaactgtaagcaatcatcctcccgattagtactgggttaaaaactgtaaaccacctacaattactagcatgatccctaacctctgtaaggtggtaatccagtattggttgttagctgtcaaatttatttccctttggtgaaatataccctggatttaattagcagtcattctagatactttatggagctgagcccaagcactgtggctttgacatttaacccctgacccttaaatatttaccagcttttaaactggttgtgtacaattatcccttcaagtatatatcagatccatcattctgaccactctagtctattccaagtcagatgtactattccaactgatgttgtaattttcaccctggaagtggaaataaaatcatgggcttcacaatgagctctgtcaggcaaagctgaaagcacttgttactagatgctacccatggaaggggcagggtgtgctgccagtcaggagtcccagtgatgagtgtgaggagcaggctgcagccgaggggacgtgggttgctctttggctctggccagccctctgcgcctttgtgggatgctttagaaccagtttcgtcttcggctcgcaatcgtgaaaggaatattttggaaactgttttcatttgtttgaaatcaactttattgaggtatgatttgggaagtgtattatttaaatttccttgaggtttcctaggcagaaaatgcctagatagaagcaatgagaggcgaggactgcattttttctgctatggtgtaaaactctcacagaatgttacgcacaaaaccagtgcacttcaaatgtcacagttcttgaaatgtattttaatccaaaagatgggctagaaagggccctcattaggcaatacccactttaaaaagataagtgaatgctattctgttgagactttgcaagacctcccacctggaaggggcacccaggtctctagttcaggagtggtaccacccctctcacgctctgcctctcctcaccccttccagaacatacatcacgtgcctggcacatagtaggttctccaaaactttttgaatgagtgttaaataaacccagcagtcatgaaaatggcttacagaggcaaacatgccaaccagaaatgtcaactaggcttgtgcaagtaaaaagaagaatgttactggaagtgagagagtccaagccaggaaaacaggagcatgtattgctgatatccagcccccacactataccccagcagagaggaaagagggcaagagacgtatttgctgctagtggggagcccctacgctcagtctaaattagggccagatgctcgtttttggctactctaagaaaccaaagtgtgggtcagccgcacttccaagtggagcactgagtggagaccgggctctggtggccagctaatccagaagcctgctttctcaaaggagccaaaactggcatgtgactctgctagacttaaaaaaaggaaaaatttgtagaatagccgtaatgtgtggtcttgagggtaatctcaacaaacagcgttcgggttggttaaaatgcctcagtggcagtttggagctcaccggatctggcagccactaatgacattgtgagggcgactgttgcaccatccagctacactgtacacgtaatgcaagttacaaacaaacaggacagacggaaacttatgagtcaaatttttttcatgtttctgccaggtggacacactgcataaacagaatgtaggtatcagagactgaactagctagacatttttaattctcgggatttttttaagctttgttgactaatgttttatagtgatataaaaagatcctatgtagtaaaagaataagggtggtaagtcatgggcatttacctttaaggagtgctaaagtgctggaagtgctaaaaatcaaatgaactctctctcctagaatcccttgctctcagaacatcccaaaatatttcaaggcgttccttgttttcagtttggtcttagttcagaggtgaactttatgcagggaggaggttggcttaagcatattttagtcctttgtaagaaacatgatcctggaaaatagtgtttcctcccaaactctcactgcaaagtgaaacttctatcgaacctaacaaactcacaagctgataaccaaatgctaacgtttttgaaatgattgcttcctactaaagatccatgtcactgctaattagaaattaccaactcatttttttcctcaaataagcataattgtttatttaaaagatttccaaagattaggaaaggggacgctattaatatcagaatgggtaacacaacaaattaacaatattttgcacatatatccctatttttgctgtagtgtcactgctatagaaattgtctctctgtacaggtacaggtaggtggtgttcatgtgtatgtttgtgatgtagagacacagataggaagggaggaagaaccatgaggaaggacgctgacacaggtggttccagtggctggaggacacgtgacttgttcatatccaccacttgactgctttcttctcactcacttctatcccactggccagaacgtcctgcaatgcctatttccctaaatgccacttcctctccgtttttcccaccattgtcttaaccaggaccttcctcatatcttctctggatgctctcacaattcggaatggcattcagacttctacgtgacacacatggactcttccccaggctcatcccctgtgactctaaccattctccatattcacatactcacagttccctctcaaaggctgtgttctctcccacttctgaactttctgtatatgatgttccatcaacttaaaatctccacctcacctcttcctaactctatttattcttcaaaacccagcacaaaaatcccctcctccaaaaagtcttctgtagtggctttgctgtagtggtcgttacagtcccaccttctcctttctgaagggaaccccactgtagtttgggtgtttgttcttgcccttatgcatcagggaggctgcccacagcagtagcctaaggaaaggcaatcccaactcctctgactggcaaatagcctgggtctggatatatgacccaactctagctagggagatgggagaggaggcctgctgaggacttcaggaaaggccagggaagtcactctgtttctccaaatggagaagaatgtgactccaactgctgctggcagccgacttacagccacagcagggaccagtctggggatgatgtcaatactgtggacagcaaagagaagcctgggtcctagatgactctgtattagccaactgcaaatcccagcctacctccaaatgtcggattacaggagacaatacattttttaaggttaaagccaatttgattcaaattttctgttacttgaagctaaaaatatcctattttgaggggtggggataggggataaactgcctagtatttcttgctttcaaaggttgcaatgaggtacagaggctcacattgtatattttaaataagaaaatttcagccaggagccgtggctcacacctgtaatcccagcactttgggatgccaaggcaggtggattgcttgagctcaggcattcgagaccagcctgggcaacatggtgaaaccacattgctaccaaaaattagctggacatggtggtgcacacctgtagtcccggctacttaggaggctgaggtgggagggtcagtgagcccaggaggcggaggttgcagtgagtgagctgaaatcgtgtcactgctctccagcctgagcaacagagtaagaccctgcatcaaataaaataaaataaaataaaataaaataaaataaaataaagagaatttctacctggattctgcctggttggtacagaacagacagtacagattatgagggttatgagccgctgaccagtgagccaacatcactgtccatacccaaggggatggccctcagattggcagtaggtgctggtctcaagcaggcaggcccactcatgcacaaagcaggccatggccatgtggatcaaaaggaaatgtctgtcaacttctctgggtctctggactcctatgttagaaaagaagctacatcaatgtacagtataaggtgtgagaacaacaaaataaaaaagaccagagccctatagggtctctcttaaatgtaaggagcaggccaggaatggtggctcacgcctgtaatcccagcactttgggaggccaaagtaggtagatcactcaagctcatgagtttgagaccagcctgggcaacatggcgaaaccttatctctactgaaaatacaaaaattagctgggtgtggtggcacgcacctgtagtcccagttacccaggaggctgaggcacgagaatcacttgaacccatgaggtggaggttgcgctgagcagagatcgtgccactgcaactccagcctggatgacagagtgagaccctgcctcaaataaataaataaatgcatgcatgcgtggagtatgttggttaaagccaacctttgctgagaacagggtagcctctgatgctgccatgctccatcccaccaggcccctccaaaagaagaaaggggagaactgaggccatagcgtctgcatgatctgtcagaaatgcaggagagctgtggtgtcggcttgtcggcaagagacttcaactcgccctcagcatctctcttctcaccttgttcacagggtgcgctttcaatgtgaggatataagtaatcacaatagcaacaactactacttacggaatatctatcatgtgctggcactgtgttaggagctttagatatactgacagatcgaattcccatgataatcccattcactagggcttattatccccaaagtccacaattggttgaatagcagagctggggtttatatgcaagtttgtctctaaaccctgtatttttcctagtgtggtatattacctaaataaaatgaagcttaaaaaaatctaaagtagaatgaatttttctcaaagaaaagactaggatgaaaacttactgactactgagtggattgtatgtacttggattgtacatttaatgttgtgatttggtctttaaaaatagtattacagcaaacctacctcaaacagtttttacctatgtcaggattaaacttaaaattcttggcataccatactttttgcattcagcttgaattttcagacttaatgcttggcatatttattacagttagcttgagttttcctaaaatcaattataaatagccttcattatctgagaaaatatttcaaaactttgtaacaagaaacattaacaacctacaccttttttcctggatctgagaaaaaaaaacctgattttagcagtgtcttctcttgtgtttaaaatatttgggtctgcaatcatgacaaagaaaatggaagttcaagctgcacctatctagcaactttcagtgacattaacagatgaaagtgcatctcgaaatgacttttggctcaagaacaaatatatacttttataaataggttagcttctttctcagacaacttcatttaactagaagaaattaacgacagagagttacaactgtaacctgagggtaacacttctttataagaatggataataactaaatgagtggccctattcaggaaggaaaatttggcctcagaagaaatccttaggttttactgtaccagtctgtaagtgctgctaaagctcagtgcatttagatcatgtactcttaatatttttctcatgttcaaactgatgatgaaatgtgactctggttacaggaggaaagtagaaacatctgaaataatggcaagacaaattgttttcatatcacacagcattttacatctgagattgaggcaatttgtcaatgtcatcatctgactctctaatgattcctctattgtacattaaaagtaaaataagtgacttatataaggtcacagactgagttaatggcagaaagtgtaatgggtttcacggtcatagtttattatcccatattcaacattgtacttatgcttttagaggaagaaaaggatacccagattctctttgtaccatttatcagtgatgagcatatatatataaaacatagatcttgtagaaaatgcacattgaagattatagtagaataactatctggtccagttttattagccaaccacttcacggcttataaacattaaatgaatatctagcatatgttgagacattctcaggtggctctctactactttaaattcttcacagggtacccttcctctgaatgctgtaagtcagcggtccccatcctttttggcaccagggactggttttgtggaagacaatttttccacggactgggggtgtggggcgatggttttgggatgaaactgttccacctcagatcatcaggcattagattttcataaggagcgcataacctagctctcttgcatgcacagtacacaatagaggctgtgctatgagaatctaatgctaccactgatctgacaggaggtggcactcaggaggtaaggcttttccaccactcacctcctgctgtgcggcctggttcctaacaggccatggaccagtactggtctgtggctcagggggttggggacccctgctgttaagtcctcatagcaatattcaggcatgaggacatagtggagtagcattgaatccttggcctgaagcatatgatccctgggataccaggtgtcctgtggtctttttgataatattagatggggagtcaaggtccagggccagacaccatgtttcttttttttttttttttttttcctccttgagacaaggtctctttgctctgtgacccaggctggagtgcagtgccacaatcacagctcaatgcagcctcaacctcccaggctcaagtgatcctcccaccacagcctcccaagtagtgggggctataggtgtgtgccgccatgtccagctaaattttgtatttttcgtagagacagggttttgccatgttgcccaggctggtcttgaactcctgggctcaagtgatccacttgccttggcctcccaaagtgttgggattacaggtgtgagccactgtgtccagccagacaccatgattctaatgccctttttctctctaaaattctcaatatcaataaaaggaaacaaaactactacaatattgggttagagtgaaccatagtttataaaaaacaatgaataagtttctctccattgataggaaagatgggaaaactctaagaggctggcagggacagggaaacgatatggaagccatgggaacatggaaagagaagctatgctctacattctttccaatcctagattgtgaacctctgtttcccccaatgaaggtgaaaattgcaaaccgtactctgaaagacaagggctaggcaaagcaacgtactgaggggaacactcagtgacagtgagagatgtggccagaagactgtgtgtaccggaaagcaaagcctcagggcagcatttgagcaggtattttacaaacacttagaacatttatgtacagctcatatcttttaggatgtatcaaatatatcactgtggactctactaaaccaaggaggcaaaaactccagcaaaacaatgacaagtatgaagctggagaagactcctgataatgactaaggtgcagggggagaaacagcagatgaaatcatgcttgacctttcagatgtattgaaatagaattatgatgtaccttttactggggagagggtaaatatttcccccaccccctttttaaaataaaagacggtcttgctctgccacctaggctggtgtgcagtggtgcaatcatagctcactgcagtctaccactcctgggctcaagtatcctcctgcctaaacctccctagtagctgggactacaggtacaagccaccacgcctggctaattttcttatattttgtagagacagggtcttcctgtgttgctcaagctggtctgaaactcctgggctcaagtgatcctcttgccttggcctcctgaagattacaggtatgagccacggcacctgccctagggtaaatattctttaagaaatctagaagatggtgagaaaaatcatgggggaacaacaatgaaatagtcattcatggcaattttcagaagatccaagtaacagaagcctattcagtctgtcttggagcggttttaaataccatcacctcagtggacattcatctctaattccattccctaagttcccttgcacatgtcccatgcttactaatctctccacaccaataccaaccaacacttcaatctcagtgtgtccaatacagaactcagctactttctgcagaatgtgtcaacctatgtttcatagatagaaatattaatattagtaatccgaatgtaccacatgcccctattaggaaggtttacaaccttggagtcattcttaattcatttttcactttgccccaatactaatcagttggtaagttctacacagtgtctacccaggcaacatctctgtcaaccaggctgatattttggtttgtgcggtctgggtgttcgagtacactgaaatagacttggtgagggtgtactgtctaacgggaagatcagcactttaggagaaggaaagagtgagacgagatatatgaaagagaagtataagacaccctgggagtgtacggccaaggcattaagccaaaccatgggtgctggagaagcctctccaaggaagtgacatcgaaatgagacttgaaggatgtgaggtagaaggcaggcactgctgttagtttgtctccaaaaatctaccacaaatcatctcaatttccaatcttcatagatccacaccggctacagagtgaagcatggacttctcacctttgcatgtaaaatctccaagaccaggtcccaacgtaccgccccatttcatcatctaccgcttgtagagtcacagtgctccgttatgtagcctctgctcatggccctgtttccaacctctgtgcctctgctcatctgttcccaccacccagaatcccaggtgattaaacgccacttatccttcatgctcagctcagttggcaacttctccacaaaatctctatggattcctggcctcccatcacaccctggctcctactgcctttaaagcaaaaagcactttatccttattctgaaaactctcgtcacctctcttgacattgactactctctgtcttgggtaccttatacaatttgatttaacaaagttttttggttttcttgttttgttttgtttctaagtgacaaccatgtgcccagcagaatgctgtaagctaatgtttgagtaaaagatggtgaattccaacttggttgctctgtgcttgaaagagcttttgaagatagtggggtgggaacgtccagagggcaggactgcatagggctggacttcatggagtggtctgggctgaagacaagaatttgtaagtaatgatggtgcacatggctgttgagggtcccatgagtgtaggcatcacctaggagggtgtgtgaagtatagtgaagtgggctgatagggagggatgggtgagcatacactgtctcttctactagcacagtttttcagcagtggcatcactgacgttttgggccagatagttctttgttgtgggggctttcctgtgactgcaggatgtgtagcagcatacctggcctcaaccactagatgacagtggcaactacctccctgttccccatccctcagttataacaatcaaacctgtctccagacattgctaaaactcccctgggggacaaaattgccaccatttgagcactgctggcctagacctgtaagtataggttctaagcaagtttctttcttcctgtgatttagtcacttgttgattaaattaattgttaaacaaatgcttgatacacttctattatgtataaggcacactggaggccaatgctagatgcttaataaacatttagtaaataaattaaaaaatgctacatttcaggaaaacatctggtaatataaacctagggattcataaaagaatatgaccaccatacgcatgctgatcaaactgtttcatcttcatgcacctacaggccacacgtgctcatgaatgaacacaggggagtaggaatgtagtgacttcatgtacatgatgctctttcttaaaggaggtgacaaagggtaaaaaagcaaacagcactgttatttctttttactctccagacccaggaaagtttgctgacttgctaataaacgcaaaaatgtgaaggctttttatttgggaataacctgtgaatacccagtaaatgtacttaagttatgtggaataaaataattttagcattgcaaaaataaatcctagaattactgttgttgtagcttttccctgaatttgactttccaaaatgtttattataagctctttattctaaagagtctactataagaattaccctattatgtctagagactcgacagaacagaccgaagctctttgccatattatataaaacagcaacaccatcaatattatggtgacacagttttgcaatcccttctatctaacaaagaacttttcaaaaccctttcgtggagctagaattgctcagaaaaaaagtgggtgttttttgcaaaataggaagttcgtttttcaaaataaggaagctaggtcttaaagagctttttacacctgaagacattcactgcacataaaatactatttgtttccccataaatgatcatcatgtgttccaacgtaaaatatcagagacaccttatttttcccagtgccttttcttcctaatcctcctcatgcaatctcatgggtcttctgctaactgcctccaaataaaggcataaactgcagcaaacagatggccaaactcctgaacactttcttccttgtgccaagctgctatcggatgtaaatacattcctagactgtgttaaaagcaggatctttctggtttcgcttcagtgtctattacccaggttctgctcattagaaactcattattatggacctaagtgtcaagatacatgttgtagtgaggcgcttctacacatgcacagtaaaacttttatctaggccactaaatactgcttcttatctgtcagttttcagttaatttacaatgctaacttatttatcagaactggaaatgggccaggccttcagtgtatttgatgagccttacaataaccctgaatgcacctgttaattttgcctttgggtaaacagttgaaaactcctcagctatttcctcaaattgggtggaaacaaagaaacatgagattaaaaaaaagtctagattagggaattggagatgcattaatttaaaaagggaacagggtcaaacgagggctaggaggctaataagcacagagcacacagcaaaaaagctcccagcagggtaagagttcactcaatttatccggcgatctattccagacgcagtcaatgatacgttattggatccagacctgcaactgcttcctaagaccaacctcacttaagtgtcattgccctcccttttagaaatattgctattacccaaacctgttcgcagggcagctcactcagctggcagcccactgacttgtgttctttatgatgctccctctaactcccgtctctgctgtgggaattaggtataaccaccaccatgcaaaccgcagaacacccaagttgatcctactctacgagacttttagtactttattacacagaaagccaatccctgggataacagactataaacaacagcaaatgctctatcaggcaggctgtacgaggttaaggactttgagagatttactggagaggttgtggacgggaatgttccatccatcaaatgcgctttcttacacattagataaaagaagaagaagaatggaacgtaggacattttggctaagacatttagaaaacttgtatgtttgtcccaaacaacgaggggaaaggccgagtgattagctatgtaattaaggctgccttctaaccttttaattattattaatgtggaaagttgtgagactgagaaaacgtgtattttattgcaacaggaaataagttttaggtatttgctgatatcatttcaacattaaaatatttaaattcatttggcaaacaatataatattatattaaaggggcttattggaaataacatactttattaaagttaggaccttcggggcagggatttgtttctttcctgtgctatctaattgtttgaaaacacacatactgtatagcagaccccatactggacagcagaacgaggcatttaatacatttaataaggggactgtgtttgcggggctataaatgtgggccagctaatgaggaagtgatcaccagtattccagtattggggagctttccctcactctggattttaccactgaacactatattttttaaaaataataattttaaaagaaaaaaaagaaaagctggagttcagaattgcccacagaacatgaaatgcttttaatggcagtctgaggtgactgtgtttcttgttcacaacaagcacctttgatttgtggagatgaacactttccaaacgacaggctccacccacagcagacatccggagcaggcacacacgtgtgtgtcttgtcaccacctgggcagcttctgtgaccatgggtactaacgtctcagcaccctatcactggcagggagaggcaggaggagaggctcccacacggaatcacaagggtccctgaagggagcgagaaagagatgcagaacgtgtttctggacagtgccatctactttgttctgggccatagcggaggctctgaaataagtcttttccacagtggtcactccaaccaccgcagttttgctggcaactcaaattcaaagccatgtgttggtgcagtagcagcagatgaaaactcagcggggcattacgcagttccctcaaagccacaggcctcaagagctcgcaaaatgccctttaaatgaaggaatggttaccaatatgtagtatgcatgccaagaacttaaaatcaaacaataaatttacagtatgtccttttgttcaaaatctttcaaggatattttctgtaataaaagctttttgcttaacgagtaaactcaaaaatggcagttgaggtgcatatgaaaaaaacttcagtagcctttccattgtaggcacagtgatacattttctgtcctgtgcctgagagcaaacgagtttaacagggctttttcactatttcttttattttccacaagcttcccctccactaaaaaggtgcgtttctttataatacttgctttgaaaatttagcattatgtttttcttagtgtctttttttttctcttaattttgttactaactatcctgaactattttttctgtccctggcaatggtggaaggacggtgggacgtgggatccgatttttttttttcccgagatggagtttcgctcgttgcccaggctagagtgcaatggtgtgatctcggcgcgatgcaacctctgccttccgggttcaagcgattttcctgcctcagcctcctgagtagctgggatttcaggcatgcgccaccacgcccggctaattttgtatttttagtggagatggtgtgcctgtttgttggtcaggctggtctcgaactcccgacctcaggtgatccgcctcagcctcccaaagtgctgggattacaggcttgagccaccgcgcctgcctgggatccgctttaaagtctgcgcacatcttggagaatgttctcatttctgtccttgttgagagaaaggggaaaggggaaatgcaggcaggacttgctaggagaattttttcccctttcctactcactaagggcatacaagaaactctgaaaagtatctgagacatgaaatactgccaacacaagacacaaaacactgcctttttggaaaaggctgtctgaagattatataaggagggccgggcgcggtggctcatgcctgtaatcccagcactttgggaggccgaggcgggcggatcacgaggtcaggagatcgagaccatcctggctaaaacggtgaaaccccgtctctactaaaaatacaaaaaattagccgggcgtggtagcgggcgcctgtagtcccagctactggggaggctgaggcaggagaatggcgtgaacccgggaggcggagcttgcagtgagctgagatcgcgccactgcactccagcctgggcgacagagcgagactccgtctcaaaaaaaaaaaaaaaaaaaaaaagattatacaaggagataactcatatgagtgtgtgtgtgtgtgtatacacatctggacaaccacgtgtacagggcaagacataaaacattatttcaagatgtctatgtgggctgttagtagccacagagcctaatgaaaatttcataagttatccaacagaaaagtgattagctattgaagactcagttaaaatagtctgggagatagaaccaaaagacattcttatcagtttgagttgtccatatatggagaaatatatcaattctatgtggatcaaacttacttattcattgtagaaaatcccccgagttgaatgaatgagtcataaatgcaaggtgtatttttaatttccccccttctgatatcagtgccaaatccttcccctccatggtcctttagcactattcagaggcagacaatgctgccactgttttcagaacatggacatggtcaagagtggaataatataatgataccatttcaagcagggcagctaaggttgtgtcagcatttccattataaaaacctcttttcaaggattaatatctcaggtgtaaaaattcacacccaggcaagatttggtagcagaaatgcttttattctgtaaaactgaaaactatgcttgtcttaaaagtcgtattttaatgtgcaccaattttccatacacagatatgtgataacagaacttagagaaagatggattatgagtctgtgtgtatggatgaggccactgacattgagtttaccttaatggcattattttactgcaaacaagggcaaaaataccacataccaaattggaatttcagacttcagaactcagattttgttgtaaacaccaaaacacaacacgctgatgacaaacttccaatgttctctgttaatcatgtcctccagcactatttagctcctatctatccttttagaagagtggtttccaactgggagtgattttatcacccaagctatatgtggcaatatctggagacatctgtgattgtcacaactggggctgtctgggtgcttctagcaggcagagctcagggacactgttgaacagaacagctagaattatttggtctaaaatgtcagtaccacattgcagagccattctcattcagcatgtgggcacaccagatgctgcctgcagactcgcgatctagcagcaagatgggccacattcatgagcagccttatctccaatgtcttgagattgtcttgtcttcttttcacgtttagaggagaggagatacctcaaaatctcaaattatcctggaatatttcctttattatcatcctttcttgctaagggatagctcactctaaagcacagagataattagtaaatggaatgaaaaagaagatgagaaataagccattcttcactattaactgatggttattttttgtgttttctttagagaagaaaagtctgtgggtctgagatgtgtagttgtcagaaaaaaaataaaagttcctcatctgtggtagataagcacttggcatctaaaaacctttctgcatttattttgttgatctttgtttacctatgacaaatagagagagctaactcccatactttatatgtcagttgatcagccaaacaatctctgcatatggtgtcaggaaagacatcaggtggctccaagtgcctgtatgacctgctctgggaaaagcacttggggatccatagacctaagacattcagagtcccagagctgttagccattcacatcaacatcttctctaggtgtcagccatttgctcaaaccactaatcaagcaaattttggtgacttaaattacaactcattttctttcttatttctaccattgaagggagggcctacttagtaaagaaaaagtaaaaatgcaagaagctggagtctggccaaggatttttcagttaacactaaacagaacagagttctattctagaacagagatcactgcagagtccagaatgcagtctagagagggctggtactactccccaagtattgagagggtacctgacttgttatgtaaacagctgtcaccaggaagtagtaaatgaagttaaatatcagaggaaaaagaactcaaagatccactgagagaaatattcaactggaccaagtgataaaaatgttacttttgttaaccaaaatacagtctgagagcaggatgctgactagcaggttgacaaagaaacaatatttttcaagaaaaaaatgtacacaaattcacccttctggaaatggaaacatttgaaaatgaattttaatttactttttcaacaaattttaggcaccatacagtctaaccttctcttttctatctgctactacaatgcacacacacaaacacacgtatggatggatggatgcatgcaggtacattacagggagattctgaccgtgacaaattggatttataaatacatattcatacagacagtgtgtctgtgtacctaatctctcaaatccaaaatctccccacaaccgtttcaacatcctccagaatttcaaatggctgaacaatgaacagtaaagtatcttgggaatccttaacctccctgtaagtacatagactgcctcagggggtcagttttgtattttggaattatggctggtgaggatcaaacttgtcggtagtgatggtgataatgctggtgtatgtgtctttaaaataccctaacttttttcatcttctgattttggtgaataaagttgctgaaaatgaaaactctctttataattcacacaggcttgccacaacgtcacagaaatgtgctctaacctacctgtgagaggttgcctgtatctattcctacttacaactcagcagctacactctctccctttacttccataaatcagaaaactcctcctggccctgaaaacattattagctaccatatggagtgccaaactctaccactgctgtagacattagctcttcagatggctgagagctaacgtatttgcccaatttgcattttaatagtctgcagctgcagtggactcctttcactttatgatggggatgccccagctttgctcaagacaggcaatcctggcatactgcccagagcaaggaagctgtagcggatctggacaaaatgcaagagtacagactcttatttccaacagagttcaacaggtagggggctccaccctagacccagcagctagcttagaagtgtttggtgtggaactctttaggctgcgtagttttgatattccatcctagacatcttacccttgtgaccaatcactttgttccctacagggccatgtggatgtgaacagaatccttccttatgtccatcttggaggtgagaggcatcaactctcatgtgccactgagagagagggcaaaaatattaaaaaccattgctggaaggacaccttgtgagtttgtaagtttttcagcacacttatcatctaagaaactaaactaatgaactcagtcccagaatgcatagagttgtcccacatgcgaatagatttctacctctatcaagagttccctgtgctttccagagggaatgagcaccagcacttgccattcgaatctgtcatcaagatgctctcaggctcttatctcagacaatgttgactccactaccaagttataaagtataaaaggaagtgggtcttagagatggtacagaggaaaacattcatacgacattccttgttgtagtgaacgtaactgggttttgcagttttcccacttcaaaaaatcacctgacagtccgtatgctgcgttcagttccactcatcataaagggaagcacaggattacctgggtgacagcttccaaagcccatgaaccatgaataaggctggggacatacggagacagcagcctctgtggtgtgttacattggatctgggctgagagttgctgtctgctctagtatctttatctcctttcaccttggaaattgctgtttggctctggctaatagttggttgacttcaggatcacagtagggactaacttggaaagtgcccttaaacttatttttatcaggatgcctcttatggttaaatatatttgcttcctgtttgtgagttggagaattgccaagcagaatgtacacctccctcagccttgaaaggatggatgcttctaccttttttgcattatcgaagagataataaagtgtatttgtgttattcactatatttttagcaagactgagccctagtccatgtgcagacttcttggttttgtttattaataaaaatcatatatatggctgcaaccattctgacagtctagaagttgccacccttgttaggaactgcatttctgtgattatgatcaaaatatactaaggtagttgtctataattatcatcttggaacactcatgggccattctaagataaagaactaccacatccaccataagcttgtgttatgtttatgaccatcaatgtcacaccatgttagaggaaagcgcatatatttatgaagatcaatgtcaccctgtgtaagagtaacgaatgtattatacttacgaagatctatgtcatactacctaagagtaaagttacagagttgagagtcaagagtcttatatccaattagcctacaactccaagtatctcagtacatggaataaaacatataaaacagacaaaaaaagaagctataatgtaaaacctaaaaataataataaaacctagagaaaagtgcttagacgttacccctcatttcttgcaaagtaagctcatatttaagttcagatggaccgggttaacaatcgctatttttaatgttaaaatgccctagggaagttataaacgcaccaaatatgctgttaaccttactttatattgtgtgcagctgtatggctttgtaccagggaccaaactttctaactgggccagcaaagtgaaagaggcttttttccaaaaacctttcaataacaatgctttgcttgtcactagatttccatttcatttttttctactacttcacactagtatttggtttagattttacttatttccaattactttctttggttgttattttcactgagaaatgcacactatatattactgaatagggataaaaacagggagagaaacgtaatggagaaagaagagcaaattcaaatgtttatttctgacaccgagagccaatgcttttttaactcccaagatcattctctctggcaagtttaaagagacactttaacatttctatagaccttcctgggatcattaatattgagcaccatttgctgatcttatgagaacgtaataaaaacgacaatttttgttttttccttactgtctacataagaagttacaatctattcaactttaaaaaatgaattttaatggtttaaggtcatctataagccttggcagggtacattaaaggagaaatggccgtatctcagtgctttttttgtgttttggggggggcaggcacttaactgagatgacatagaagcacactggcaggattctcaggtctgaggtgacgcagtctgccctacaggtctgtgctttgtttgcagtcagacctgcacagagatggtgcttccagccagccctggcagtagctgattgactagcaaactgtcttgcagctcttgctgacatccagatgcagcacttacccaggagtctgaccgtagacattgatacctcactggaaaagaggattccaacgtggaaccctggtgctacttcggcgctgctgacagaaatgatgtctgcaaatgctgctgcttggacaatggccctctacaaactatttactaaaatctgtttcatgacagagaacaataaaaataaaaaccttccaccaggtagaaagtcaaatggagctaggctgtagtttgttggatgaaaaaaagtaatacaagaaattcattcaatttggcataaaactgcaacatttcagctgtaatggccaccaaacgtgcaatgaaatgaatccaattaccttcacaagtttatgcctcatgatgatgctgcacttcaaacctttgccttttttggttttggttttttgagccaacgagaaagaatcctaaagcccttgtttctggatggtctgtcaaaagaccagtaaggtagcctcagaggaagtgctgaggagcctctggaagcacagcctggaccaggagtgaagactgaggtctgcccttccactgagtgaatgactgaggggtccctgcatctgttgagattccctactgtgaaatcaggggactgacaggtgatgtctgcagcccttacaatagtcacatttgatctctgaatcagaacccttgattgtatctgaagaacaaacatcataatgtattatttaatgccttcaaacatattcagtccttattttaagaaaataatacataggtaaaaattttaaaaaattagaaaatcttactttaatatgattggagtagaggcctattatacagattgacctatagattgtcttgcagacagtcctgagccccactggccttctagacttcatattgtagtgaataagataaactgaaaataacagtaaaacaaaacaaaaccctatataacaatgtttaaaagaggaatacaagaattaaaaattaaccattgtatctcagactttaattatatataacttaaaatgttaagaatacatataaatgtgatatgtaataaaaatcttataatgaagttctatgattttgtttctgaagttaaaaaataagttgatctatacaatagattaccattcagcaatcaaaaaggaatggactactgatatacacaacatggataaatctcaaatgcacatgtgaagtaaaagaagacagactccaaaagttacccagaggattattccatttatatgatatcctggaaaaggaaaaacattagggcagaaaacattagagattataaggtgggggctggggagagagaggaggaagccgactctgaagatgctcaggggaattttgtgcaagatggattgttctatatcttgatgatggtggtagttacaggcctatatgcagtttttaaatcatagaactacatactaataacagtacatttaactgtatataagttacacctcaatacacctgcctaaatggctgatattctccaccaatatatgtctggtgtccaaaaaaaggacgagaagagtcttctcacattgtcaaccgtgaagaagagaacggctggtccacaggtttgggttgtaggaacttgatggggaaggcaaaatccaagggtactttaagaagattaaataagctaagaagttctccaacttgctgagttacatggcaggcacacactgatgggaaggagagaggaacctaggcaggtctgtgtttgtgatgtgtgcccagaagggctggtgccttctctagtcttgctccactaactgcaccagtcagcagcacactctcactcacatgcccttggcccagactccactgttagggcaatgaaatatcacgcttctccattcaagaacagagttaccgaaacaagatctgtctgtctttactctgccttccagttagtgcactgttaaactactaagtaagatgtctgcttctgagccagatcactggaggagagttttagaaatcacctggagggtgacgtgcacacaaggggaaagcaccctcagtgaatgaaggagcaggaagccgactgacatctctaaagttctgggctcagtcctgtgttgagttagtgttcattctgggaggatacatgtgtataaaatgggaagagatgatgaaacatatttaaacaaaacaaaagaatggtttgcataatgaacaaacaggactgagaatcacaccgtctagaggaccaggaggggccactccagtgtggtgcagctggggatggtgaggggtttaattttaccacacagcctgggttaggcatcttggaaactacatttttgatcaggagaggctgttccagtgggaataccagcccacagggttggattgctcacactaaccaggctgagcagattcctctaatttcggggcatgaagcagaaatgtcagtggctagagggcatcactgctctttctcccaaaaaaaaaaaaaagaaaaaaaaatgcgaaaaggcaggaggtatcccataggttacagggaaatgggctaattggctagagtgatctggtctcctatcagcctcctgacctggtgtcgtggcctcttctgtggagaagccaacataagagaatgggaagaaatgcactttagtccccagtcacaggtgagtctagggttttataaacacattttgtcttttcggacttcacctctgaaaaagtgagtagatagcaaagtctacataaaataaaatacattttatctgttgcactgaaaattatgattgttaaaatctgaactgaaagcaggtattcttgaatatatttaggaaaagagaacaacggaattacccaaacttttaaataataaaaaagcttcacagagaacattcacttcaaccactttcccaaccatctaagtttcattacactttaaatctttgagtacttaactgggatttacagacaataactagaacaggaagggagttgatgatgaggaaagagcagatacttacttctgcactgggacttcgcattcttcataaaccagaccaataaaataacgttgtttgatgacttaagctcatttatttatttttgtggcagtgggtgatccatcagtattgaaatagaaataaaaattattttgtttaatattttaaactaaaataatggttctccctttacatcaatacaccttgaacaagaggtatcaggaaaagacaaaggatcctgctggcacagcttcgaatccggggggacatcactgaaatgtattagcaacacacaccactgctttactcaatgctaggtgcagcttatcaagctatcaaagagaatctgctgaatataccaagtgtgtctcagaaaaaattctttgtattagctagaacaaggttaacaaacattataactgttcataaaaggattctgtgattaatatatttccacaacttgctggagcttgtactgattagtctttgccaaagaacctttcccagctgcattcagcaatatcctggaatgacaactctgtcaaattaacttgaaaacatctaacgttttattcacatagttccctgggtaaaaaaattccatacttcttattatgttgtgccggtgatctacattcttctttagaataaaataatggggataacataagatttattggaggagagctatagtttttatgcatataatgtctataacacttatgagtaagtctttcaagcaacattgtctcttccaaatataaaacatacaacttatacaaaacactgagaaaacatcccaaaaattggataagttaaatactaaaggtatagataattcattatgagtaataactgttaaaggctaaactagccacattattctactttttaacatgtaaaatgtttgcatttttatcctgcagaaaaaagaagcttttttagtaactctgattttaaacattaaattcaaaggtttctgattgttatctgttgcatcgatggtttttattacctgtgtggctgtaaggggctagggggatcttaatgaactggccctatcaattagctcttaggaggtgttaaaatcacccataaccattagtttctttcacatgtttaggaaaacccaccataggaaaaattctcgcaagtaaaaaagaaaatgtttttacgatttcacttcagagggtatatttttccttatttaagtacatatttgtgtttaagaagggtgggagtggaaacagcacccacaaacgtttggctgtaaaactctaaggtattatgtaatgtgtccacatattaattctttatatagcacttataaacacagaaaaatattgtgtgtgtgcgtgcatgtgtgtgtgtgttccaatataagtggggaaggggacattcagtatctctcaatttacatggagtacccacatagctttttgtgaataaaagagcagtaatttaaaaattctgacacgtcccacaagcttcttttaagtcttacaaatgaaaattcttctttaaattaaagatttagacaggtttacaaggttgcctgagatcacaccggaacatcataatatatgtgtctgaagagtatagtagtttgataatctataaatcactttatcattattgcaaagccaataaaagccaaacatctcacatacatgtacatttcttcacatttctgcattttagcaaatcacaaattaccaaactttaaagttttcaggtttatctcaaaataaaaataaaagtttaatatatattttctaatgtgtcatttaaaaaaagcattaatcaatttcaaacaaattagccaataaaccagcaaaaaagtgtggccattttcaattgatacaattaatttctctaagaggggtgggtcataacgtttcatttatttaagttttgtcactttttgcaaaaataaattaactttctagtttatcatcagttcaaaaaacaatcccaaggagataaaacattataaatatcaagaattatttctctaaacttttctcattatttattagcattactacataaaatgatacttaatcttttatagcagagatttgggaagctattgttaacttctgtgttagaaaaaagataatttcaatattacatatttttacataatgcagctcttaacagcatttttcaaaacagaagtgtaaacttaaagaaccatgacaaaggaaaaatgaattaataaaacagccctccattcttaccttcaaacattaaaattattgagctatttattttcacaataaataaaaaatgttaactagagatttatatgatcagactactagtcaaaactatgaagcaagggccactctatgatgacatgaatttttctttttctgcagtggatgctagaatataaccagggaggaaagcaaacccatgatccccatttctggtcttggttcatttagtagtgttgactaaatgtggcaaaggcagatttgctggtgatgaactcaggataaaatgggaaaaatgtgaaccttgacctttttaacaccacttaaaaatcagaaccagacctgtcagtgcaccgcctcactgcctatcgcctaacaaattggaaacctgatctcccctcctctgagtagaaagtaggcttgtcaggctaagctgagcagcaaacacccgacaaggctgagctgagcagcaaactccccaaagcagagaaagaccccaagtgtaaagtcaaacttcatatgataccttgagtttacaacagtgtaagatgttaaaaatagttttgaacattgtttcctttgccttgttttcatatttcatttgcaaaacatagtacagaagatagagtttttgaccaaacaagaaaggatgtttacatttttattgccggagcttagaaacgccatcatctgtgctccccaactccatgctcccatctctctctcttcagggattatcattttagattgaccaaaatatcctaacttcatcagtcagcacttaccacagacataaactgctttctgtaagaaatattcctcaattaagttttcttgagaactttatcctcttcattttgtccttaattatagaaccttgtatttcctatttctctttcatttctccaacctagcagatttgtaatagcagaaaaattactactaggaatattacaactacttggtgtcaagtctagtacagaattgagtttgtgtatttcaaggaagaacagagactgctgaaaatatctgttgtcttctatttctactttattttaaactggaaaacctggtactaggcaaaaatgaggtgaaattttataacaaattaagctagagtgataaaatccatgaaggaagaagagaagcagattaaatgacatttaaaaatatccaagccttcatttgattaactttaatctaattataaaaagttgctgctcacttccctaccaaacaaggagacctcagaatgcttaggttaaaaaagaaaaaaagaacgaaaggaaaaaagatgttagagaagcaaaaataacgctgaattaaagcacttggaggccaatggctttgaacctgggctccaccagtcattccacccagcgaagcggtctgcagaggcttgggctcctgttaacagagccctcattgtttccaaaggcagttagaaaaatgctgctttatatctcctcacaccacaggctccgtgcacagccccaagaaaaggcggctgagggcgtacaatccacaggaagaaaaaaaaatgcatggctatatatacagcccccagccccacaccctaccaacacagaaaaacactaccccaaactcaattcctggctggcaaactgtggtaaaggatgttatggtggtgcataatttacaactggaaatttctgattcatgtgggatttggggcatttctttgccctttacccaccacctctccgtttccacctcaagcacagggaggtgaaagctgtcaggcagtggggctgatgccatcaggcagcaaggagataaacactgcatttttgagagtgcagttattccacacctgtttaaaatgtttatatagtaattaaagattaatgcttattccagaccagataaatattagacagtgcatgtgtgtatatacatatatgaatctgcaatgctgcagagaacaaagattttattgtatcaagcgtacttagcgaagggtatacattttaaaaaggcctgagcttcacgaagtttacattacagaggggaaaaaaggcttaaaaatgttaagtggttggagctactgagtgccatacagagagcaggtagttagtagtgagtatgagctaattctgctgctaatcatttggttttctatttattaaagggcaggtctcagtttactcctgagcagcagccagttcaatgggccactctgaattgtttcccgaagtttaacaattaaacctgctgagaccaagaaaaacaaaataattaacctttacaaatgtagtagttacaatataaaagttttatttttaaaaaaggtaatgcatgcactgtgtttggtgaagagctctgggccacactacagcaccaacatcccagaaaagagcagaaagcctgctaggtgagcagatgctgctgaaccttgggagtacacttgccacacagtgcccccccggggtacccctaaatccctatggtcagcacatacagcatggacagtatgcttgctcaagtcctgctcaggaaggagaatcatctgacacacaccatgctcactggatgataacaacaatatattccttggtttataattgactgttttgttaacttttaaatcgacaacaatttttaaaaagttaaaacaatcagtgttacatttcaatttatgtaaaaattatgctcctgacaaattacatggatatatttagctacatttcccaattcactgacaataatttacagagactcattgtattccactctgatgatatcaattctggtgaaatctttaataaatgcaaaagttactttgaactcaaaaaagttgtaaattgtgaccattttaaaagtgaaaatgttcacatactgcatattcttatatgacatgctaatagggtcaactaaggattacttttaaaagtagttaaataagtctttttaaacattttctaaaaagaaattattttcctttgtgaaatattaacgaaaacatattttacttatactactacagggcaatacaaacaattaggtgtgtgtttaaaaaggtaacgatcggtaggatgatgtcagtctgacagatgtgatagagtgtgcaggcaaatatagacaggagcaatttgtacaaatctagaatccatttatctggattttacaacattgtagacacagactaccagaatgttttcatcctaacactcaccagcttactgacacctacccagccaaaagctggacccctggacattccctaagcactgaagaaggtcctgtcacagggatctctagaaacaagtggataaatatcttagaggatagggagatatgagaaaatttccctctattaattaggtaattgtaaattattcataagcatgactaagatgtttagtaagtcagtaaatcaaaagaaaagtctcagaaaacaaatcagaataaaagttaaaattgagaggtaaaatgataaagaaaacacacattgaggaatactggtaatagaaggcaggagttttggaggtacaagaaacactcctgtgttatttgtaggtgttcctcgtgtctgtggatgggtgcttcccccaacagatgatcctaggaagggaggctcctaaatgctgactttccttctcaacagctgttctttttttttttttccctggagtctcgctctgtcacccaggctggagtgcagtggcacgatcttggctcactgcaacctctgcttcccgggttcaagctattctcctgcttcagcctcctgagtagctgggactacaggcacccgccagcacgcctggctaatttttatatttttagtagagatggggttttaccatattggccaggctggtctcgaactcctgaccttgtgacctgcctgcctcggcctcccaaagtgctgggattacaggcgtgatccaccgcacccggccctcaacagctgttctgtcatcatgtttacccactatgtttcttcaccagtctattctaagtgtctaatcaggtaacctggaacatattttcctacatggatgaagtaaatatggagtaaatacatacatggatgaaccaaggaggaccgcagtgatcccggttgaatgcatttagtttcccagacccttcatcacaagactgcctcacattcagggagcacaagtggatggaaggaaatcgagagccatattctgcagagcactgaggtaggcgtgtctatatttcttactttatttaataatttttagtattctttaagaattttacagatgaaaaattttatctcaaagtcaccaaagtggcatagttgggattcattcctaaatctctgaactcaagtgtagggctcgtcccagtataatgtgctgcaaaggttacaagtaaatgcttagtgactccagaatgtgctgaatatgttatgtatggttgtgaattcagaggctcaatatccagatcaagtagttctataacttagaatcttataaggcattatttgtacattatttgaaatcagaaaattatgaatatgtttaaaatatttattttaatgaattactcataatttgtatctactctccttctaaaaatgatttaatatgttcttacaatgtgaacacgtacaagtgaaataataaagtgcaaaagaaatattaaaatagggatatgaaaccatccgtgacagtggggaaatgccccagagctttgcatagcatggttaaagcttatgagcaccatcttgtcactctctgagaagatgaggcaactgcagcaggaaaaggctctactgggggagatagctcacgctgcttgtataaaagaaaaatactagttctttaggtaatgcttttctctggcactaggtacataaggtctcatacatggatactgatgaacacaagtgggaaggttttcaaagtcgtagattgttcctttctttgttcctatttttttaatagcgttcctaaataaaaatcaagggcgtaagtcacaggcaggccacaatgagaggaggaggtgatccatctgtggcccaggtatgtttctctatggtgatctaatttgaggccgattgagggtttagacagcaaagaagagggtggcatggggtcattctttcaacagcaattacttcagactcacttgtggcaggagctgaagggctgtcaaggtctagctcctggtcaatgtctggtattcaggtatttggaactgttgatctgcataagaaccacagccttcagatattcaggcagtttctgacaatggttagaaataatgaaaaacctgcgaccattttacttctgcttctcagcaagggaggaaagtaagtagcaaaaacacaggcagaaagaaacttttactgttaaaaaataaaaaagaaatcggcacagaacccagtgtttgggaccacagtgcggaaaaggaacatttagtggatggcgtccccttcacactctgtggaggacccactgatccctggctcttcctcctggatgtgctactgttacaaaagcagggagactaatttcttggcatatttttccacacactctggacaggagagggcagccaaacagccctgcatgcctggaggggtccttctgccgcagggtgggtacagctgagacggctcagaccacgactgtctgctgtccattctccccaagtaggcagtgcctgttctctcacaggttgtgcctggggcctgccttcctgggcagataggaagaccatgccaggacaagagccacacagggctggcgtctgccagcacggtgtctctggcacttgagttgaaggctttaattcagtggccctttaatgtcattttcctctttctgtccctccttgctcctcagtgctggatgacaccccatgatcaatacggcaggtttgtacagagaagtgcacttggtggtgacagctatgtcactggacactgagtaagaaactaggagatccattctatgagctcttccagaagagctaaggatgagcacttcatccagcttgtactttcagcaacgaagatacgcccaacccttagaagcatgatatatgcctgtgccaatcaagccacaatgtcaatcttcctcccccaccccagccccacaaacacctacacacccgcacaccaagcacagctgcaaaacagtccgagccacatcaccagagaggctctttgcttgtgatttcggatgcctcagactggctgtgtgagtacagtctcagcacattttgtcttttaagggaaggagctacttagttcagtgctagttatcttgagataaatatctttaaatatactcttccttatacgtactctttttaatagaataattacttttgttacgcccaagacacacctatgaagtttaagatgtcacttagaaataatatccaaaacaaatgcaaaacacacactattaaattaagccatattaagagagtaaagttttatttcttcagaaggcagaaatgatacttttttaaaaccagctaattaacttatgtgaacaaaagtaaacacaaacagggcccagggaactaataatgtcacctgttccaaatgccagataggtgtctgggtctgctgcagacatttactattttgcatatgaaacaaatcgaggtttgggtggcttccgctaattagagagaaatgcctctcctttccaaactgcatccacccatccatatcactatcccccagcacacacacacacacacacacacacacacttaaaccactgtctaattactctgaacatccacaaggagagttaacgagtaccaagggttaaaaggggctggccagaaaggggaggggagaacaagctgggggaccctccagctgggacctgtttgtgacttctcggcctcactgtttgagacgttctggcatttttattgcctgttgtctcagtgataatgtgcaagcatagagatatattaaaaacctacgtaaatacgtttaaggaaagaaaaagagtaggtcattaaatagtgaaagaacattaattttgaaatgacgtctacagagaatgtaatattttaattttaaaaattgctgtaaaaatatgagttaaggccattattatttcaattgagtacttcagggaacacaatcaaataaataacaataaatgatgttccctgacatgaggagttgaaagcaacctttggtaaactggaatttttctatccttctttgttacagaaattactttttttcatgaaataataaaagggttcatctaccaattttataatagaaaaacgtaatgatccttgttttaaacatacttgatacttgttccatgctaaatacgacaaaattctgtcctaagctgctgttgtgaatagtaaggaaagccaattatgatgtattcttgtaaggattttttaaaaacagttacaaacggctcaattattttcctgttactcacataataatactttctacaagagcatagttcacattaacagcacggcaagttacttgccttcttttcttttctcttttgtgaatgaggacgaagatactgctatcaaagccagccagcccagatgtgctggcactatcctctttctgtgagacgctgtgagcacctacagtcaacagattatttattaggcaagagaagcacttaattctaacttctggctagcaaagcatcctcctttccctattactggacaattactttctcagatcccctctttcaaattaatctttccctcatccatggtcctctctatcccagttgtcaccctccctgtcttctggcagtagacaacaatgcccttggcacagcccacagcacaaacactggccggaatgcagtgctgagcgtagctgggccgagcacatccaccgggctggctagcagggattgcttgttttcacaaagggaacagataatattttaactgtaataattcagtctatatgaactagaataattcagtacttataatttctattcttttgcctatgacttgcatgatgtctgatgtatgtgcccaatagccaagaaaaatgatagttatgctttatggaaaggttgaagaactgaacacatttgttagtaactagactccttttagcattttttccccaatcgctctgtcagaactaactctttttgcagggatatgatagtcctatggataaaatagcccacatttgccagctacttgtgacaacgtccaaaaggggtacaatatatcactgaaacagcccacaaactggctagtcacattatttattacgagccacacatgtgacaaattatttaactcagttgatcctaataagtcaaagagcaagcaattagctaactcggtcagagggctgtttgtggcaatttatagatgcgctcaagctgtcccagcacttcaaagccccattaaggggaaaccttttaatgactcacttgagatgacaagtattacacagcacatatggcagtcaggaatttggcagcctattctgttacactctgcccgcccccagcccccgacagctgtttacaagttttcagtctctgcgccttgctgttgtaagcagccacagggctgcaggagcaggaggcatggtattttctagagcaacaagtggcagtagattcctgtatcacacaggtttctgggaaccgctgaaatccccactctttcgtcagtctgcgtgaactgtttcacaggaaagatagagacacctagacagtgagggacagcccaggtggcattcggcaagtcgcccagttctttaaaggcaacgtgaagctattataataaaaacttatctccctacagggctgttggtagaattaacgaactaaatgttagcaaaatgctttgaagagaaaagggttatctataccagtcctaaagattatgattatgcattgcaacattgctgcctgtcagacggtgtttgcatttgacctcctcccaccgcttctccttcagaaaattttcacttgggctggatccacatccacatccttaattccatcgccaaccatcctgccccacctttggaagaagagtgcaatgccacaactaaactgtgcaataagggaatggaattttgagcaacagcttcccagaaggatgcctatattggggccactttttccctggaaacagggcacacaacaagcttagacactgagaaatgaaatgccagctgacatacttggtaattttattattgtccacaatattcaggcagcactgaagaaactagcactaagactgaaggactgaaaaagacaggaaaatgaagattttgctatgtaaaaagctgagacccaaataccatatcagtgcactaaatttttaagcagtaaagatcctctttatctgtgatttcaagtacttcagtaacgccagcttggtgaaagacaagcttaatcaagaggagaagctggtgacagcaggaaaacacaacaccctaccctgtttggatggggccacaatttcctaagaaaagacaagtgccaacctctaccaaagcaccagaaacccaccacaactcatcaaatcctcttataccacacactcgctttattcacatgaaacaatcaatcgattgtgcctttgtgttccccaaaggccacagctgtattagggccgtggtgtaattacagcttgcaggaggcagacggaccagtgggaggaagggtgaccactgcctcgaacagggcaccggcctccagagacgacctgcttggaggcgtgccaccccacggggactgcacggccacttggcctccggtgctaggagtcactctgttcttgacttcacttttagtttttcactgtggcttgatggagtttcaagtttgttattttgattatatagaaaagtttaatgaaagaaatgttaggctggtagaaagaaatgtgaaaatcaacagatagtatagaaaaaacggtggagaagtgaacatttaagttgtggtttacactttccatttttcctccctaatactccttagtaaaaagagagttggtccccttatactcaagtactatcaaaatcccatgtattatggggcaatttctcaattatattattttgaagaactaagtactacgttggagtggtggagagagaggacatgatagtttgaaataacattaattaatcctagtttccatgcttcaagggtcacacacgacaatctcttcaaaacaagagataaaaatgtagctgtcgttatcctgagtatgctcttataagagttatatgtcagtaaccctttaaaaaagcaatacattaggaagctaggggaagcatgacaatatttaatatacatgtgtatatataaaatacgtatatataatatacatcagcacaagtcctcatatatgcgctgaagactcatggcttgggatggacttccctttggcagcactagcaatggatgtgaaagccctgtgtgaaaatgtgctctagaaaacagatgaccaaaaagtgtctcgtagtaataaagacacagatgatgaggatgtgttaaaggatactgaataaaattgtttttcaaaatgcgagaagaaaaaaccccaatgtttggaaatattttaatgttattttacaaatgtatgcgtagctattcagtaaattaaacatttaaagtcacttgactattttgtccacattcttaaaagtttaaatattcagttggcttagaatatttttttgtttcttctcatttggaaaacatgggactgccccctatttgggttacctattcttgggtatataaaattcaaaataaaaagaataatatccaatagagttctattcaaacaagtcctttgaagttaataaatttaaattaagagaacctcaattttgatgtttataatatttgaatatctctgatttgagatattcacatatttgaataactctgatttaaccaaatacattttatattgaagtctttttttgtatttacacacacacacacacacacacacacacacacacggactggaaagatatgtatcaacaaactctctgaatgttagaatttaaaaaaaatttcaaacatgtataagtgccacaagatgtattacagaaaaattgtagcacactcccccgccgacacacaaataaaacccacagcactatatattactgtctcaaaacctttaaacatcagaattatattggtagattcaaaatcttaagaaattgccagattttaatattcttatcactattcttaaagtcactatcttgtatgtcaagatgttttcaatgggtttttatccttgtaatactgccaaatattttcacaatttctattgtcatatattaaatttactcaaaataataatagcacattgttaatcacatgtttaaaaatatgtgagcatagctgggtgtggtggctcacacccgtaatcccagcactttgggaggctgagggcagcgcaacacctgaggtcacgagtttgagaccagcctgacgaacatggagaaaccccgtttctactaaaaatacaaaattagccaggcatggtggcacatggctgtaatcccagctactctggggcagaagaatcccttgaacccagaaggcagaggttgcggtgagccgagatcgtgccattgcactccagcctgggcaacgagagagcactatctcaaaaaaaaaaaagaaaagaaaagaaaaaaaatgtgagcataaataatgcagtcttctactatatcttcattttaaaaaattatgttaaaaaaattggctgggtgtggtggttggcacctgtaatcccagctactagggagactgaggcaggagactcgcttgaacccggcaggcagaggttgcagtgagccgagatcgcaccactgcactccaacctgggcaacaagagcgaaactctgtctcaaaaaaaaaaaattctgttataccggaaaggacactttctaactatgttttctgctatgctcgggagctgaaggtgatgagaaaaaaagacgtgtttgaagtgaaacataaaagagataatttattgatttatacattctttaacctaaggatgtaatccttacgatataataactaggctctgaaaataaatgtggtgatttgttaaagaactaaacttatgcccaggttgtcaggaggctgtgctctttggctggtagaaaagagaggaggtttgagtagaaagacgagggttcatgcctagctcttagacaattcctgaacttctgggatctttatctccctcacttcaaatggtaataacaatactaacttgtgctattgtgacaactgatgaaaggaggttattcataggaaagccttctggaaactcaatataaatataaatacaatataaatgctagatgtgggacatttctgtttgttagttcaacgaacttttatttggaatataccataaaataaaatgtttccttcctttttgatttctagtaaaaaataagacaattaattctcctatgtaaagaggttctctgatcatctttaccccttcctacagtggacaaaccaggagaaagtgaccacattgttaaaaaatgccctgagaacagttatggctgaaacaccagtgtgatctgacatcctgtatctcctttgttttggaactgtggtgctctcagaagttctggctctggtctctgacatgctggtggacagcagggtaagacttttttccctcctcagtgtcaccttggaaatctgcctgctggggctgaccaccacgtcccacccggtgatggaagggaatgaattcacataacatttcttccatctaacagccagaggcacagaagtctcggtgtgctgttgattcccagatgttcagttgaaccactggtggaaaatataaaagaggccaaaaaaagggaaggattgaaggtacaccttcttctgtcaagtcttccattttcctcttcagaccttagatatccattaaaaagtgcattttggaggaaaaatttacaattaagatacatccagcagagcatggtggctcacctctgtaatctcagtactttgagaggccaaggtgggaggattgcttgaggaaaggagttcgagaccagcctgggcaacatagcaagatcctatgtctacaaaaaataaaaattagccaggcgtgacggtgtgtccctttagtcccaacaactcgggaagttgaggagggaggatcacttgagcccaggaatttgaggctgcagtgagctatgactgcaccactgtattccatcctggatgacagagtgagaccccatctcaaaaattaaaaaaaaaaaaaaaaaaaaaaagacaggtccaatacaggttatttgtaatacactgaagagacatttaaagaatgaaaaggttggcagctgcgttgtttctctggccacctggcacaagggatcttaaatatgtacatcccaggatatgggggtcagtggaatttcacattttctgagagatgcttcatttggaaagtaaaattatacaaattatatgatctaaaagcaaaatatttttgctatttgaagcaaacttttaagatttagaggttagccacacctatgtgctctcttcagccctcttggccatttgattggctacatccttggtatgaggagatgtaacatataactgtatgtagaaatgtcattctttaagaagtcctgctgggcgcggtggctcacgcctgtcatcccagcactctgggaggccgaggtgggcagatcacgaagtcaggagatcgagaccatcctggctaacatggtgaaaccccgtctctactaaaaatacacaaaaaattagccaggcgtggtggcgggcacctgtagtcccagctacttgggaggctgaggcaggagaacggcatgaacctgggaggcggagcttgcagtgagccgagattgcaccactgcactccagcctgggtgacagagcgagaatccatctcaaaaaaaaaaaaaaaaaaaaaaaagttatccaggcaaaacaatcgatgtgaaaatattccccaaagacatccttccagttttacaactatgggtcttccaaaagattctaggagatgttagccctcagaaatgctgacaaccaaagggggattcttggctctacggatgtgcccaaagtgtacagacacagacatgtgacatcacagacatgcgacattcattccggtggggcaggctcagacacttctgctggccatgcgggaatctgcttgtgtggaaaaaagaaagtaacatttacagaagtgtgaggtgcaaaatgcaaatgtacatgttaatacctgacagcaattatttaatacctaaaaatattaattatcagtaaatataaatatgaagtataaatgaatagagtgtattttctatagtatatagtacagtaagtgattggatatacagaaaataacacttaagaatatcatttaaaagactctaaaagggtgaagattttcccagcagatacatactgaaaaaagcaaatgacagaaagcagggtttgaaagagccccagccttttctaaatatacctgggccctgagctatcatcagcctcaccactggtgattatacttggtttctgcaagcatgtttctttgttacacagtgggcccagtgaaggcagaggctctgctgtattcatcctgttgtccatccccagagtgaaaaaacagtttcacctaatggctggtatttttcaaatagttgctaaataaatgattatacaaagttgcgataaagattaaaaagaagaattcaagaattatttcccaaatttcattacagacatggaaaataaagtaattatctggttattttctatttaaacaaaattaaaattaagtaaaaattaaaattgggtataaaatacagcaaaatatttacatacaagtgaggaggacttgagcacaagaagaaaaaacattaaatacgctactaagaaaggtggtggaatttatcagcattctcagaaacctttgaaataaatgcacccctcgcatagggtgaatattcacctgctaaggagtcaagcttgctgggtgagtaaacttcaagtgacttcagagcccctatgggccaatgagccaatatgggcacttttatactaaataaaacagaattataagccaatataggcatttttatgttaagctaaaaactaaatatttcttgaagacagaaacctattcttatttcttattatgttaccaaaggtttttttttttttaaagaatattgagatagagagaagtgcctttcactatagattttctgatttttactcctctgtgttaaagcagtattgaaatctgtagtactgggtggtaatcatgctaacagaataatccactgactcttttcagattaaccaactcagacatctgttgtatttctaaagcatctctaaaaactttcctcacatatagtgagatctgatctcgatatcgtgtatgagacctcagagatagtacagcctttctaggatgataacatttttgaaccctgatactgtatttaagggtataagaggcacgacctacactgcaagaacacatgacctcgtcttacatatgagatgttaagggaaattaacaaagatgataggagagacaataaactgattttattattcaacgtatatctgagttgatttgggagaagaatgaataatgataaatgatgatgaatatttcttaaatagagtttctattacaggagtagaaaggcacacagtaaaaataaaaagaagaggaaggtaaagtcacaaaagtattttactgttataaaaatttttaggctgggcacagtggctcacacctgtaatcccagcactttgggaggctgagatgggaggactgcttgaagccaggagtttaagaccagcctgaacaatgaaacgagacctcatttccacaaaaaaaaaaaaaaaaaaaaaaaaatcaccaggtgtggtggtgcacgtttgttgccccagctactcaggaggttgaggtggaaggacttcttgagcccaggcatttgagggtgaggaggccctgatcgtgccactgaactccagcctgggtgacacagcaagattttgtctctaaaacaacaacgacaaagaaatttttaaaaatgtaagtgagctacgttgagggcttactactcttgtttaactcaacactgctgagcactcttcctttccctaacactgtaagtttactgctttggttcctagccattgtggttaacatccaaatagctgctagagttggtatttctgccagggtaaccagcaagtatacacttccatgctacctttcactgtgaaagcagacgagcaatatagttgaccctaatattttcctaattctaactaacctccattaatatacttcaaaactctttagaaacaaagataacttcagcagcagaaacaatggccttatgttccaacaatggccagctggaaatgtcaaacactgcctacccattataatatctccacctgtatttaggtaatcactgaaatgaatatcactactagatagacaggtacttagtagaaaaattaaactagaaagaagggtatgaattgttgatgaaatattaaagtagaaatccaggataaagaaacaaaagaagaaaatcctagtatcttaaaaataatagactgcaccaaaagtaagatcattccagcactgcgtttctgagatgaagagaaaatgttagaaaaaggtatttttctatcatcagtaaaaaagacattcaactattaatttaaaaacaggcaggagggaagtgggggcaccgataaatttaaaagaccaaacacaattagaaaagcagcctttcctgcagaaatggaacaagtgatacagacaataaacttggaatgtatactgagaacatgggagaaacaaatgagcagacaaaatcaaataggagaaagtataatatttcacactatattttaacccatttgtagccaagcttgaagaatctaacttacaagattcctctcccccaaaaaatcattaaaagattaaaaagaaagaaagattgaaaattaagatgacttactttctaggaaaaaaggagctgaatataggtttaaggattttgaactgcctaaagcatgtcaccataaatctgtcatgcagccttgtaagagcattactgatgtagtcaaaataagtgaatctgaagaaataatgtgttctattttaaactgcaaagatgtggttaaagtacaaggcaggtatacgaggcaaatcaatccacacacaaaaaaatgttctgttttcagcaaacttctcatctctcattccagtttttcaatgggactcctctaattctcatcccagaaatccaactgagttgactggaaataacaagattcggattactcaaatgaccaagagcatctactttcctgcaagatgcacagcaggatgaagcaaaagacatcactcaagatctggcaagatgaccaacagtcagcgagagatctggtaagaattaccattagaaggaggcagacaaaaccttccagaaccacagacagcagtaagattcaaagtctcacaagctacagtaaaactcacagagtttttccaagacaaggtcctatgtcaccaattcttggtccacaaaagataatctaagtgattatttttaaatacacatgtaagtaggtttatttctggtgagtattttatttttagaacttcttttctaaatcaatgaaggaaggcatgggcttaaaaaacatggtgtggtattttcaaactggaacatacagtttatgctgtctaaattaagcatatttagcaggcatctggggtctgagaattcttcatagcccttggtccctcagagctggaggcagagaaaactgacatacaatactctcagtgtactgcaccaaagagctatttaattggctttttaaaatggatatataatattgcttagaaatgcaaatattggttaaaattcccagtttagttgagcatgcacaaggatatatgcgtgtgtgtacataagtacaactgtatacactcaaatatgaataaatggctagaatgaaataaaccaaagtgtaatgagaggtgctcttagaatagtatgacaagttaattacaagattccatattttgcaattagaataatcatgacacagaatcaattaaacagaagagagagaaataattaacgaaggactttgcatagggagttaagaaagaaaaaagaaaaaaatccaatcttaagaactcaacgtcataagcagtgtctagcagagggtcagtgagcaaaaggatccaaacacaattattactgctgattatctaataagcactaatgtggccacagacaggatatttaaattccacatcatattgtcttgaagtcattatctaatggatttataaggataaggcaacatgacataatagaaaactcatgggttatccaagttcagaattccccggtctttataacttttaggcttagctccaggtttttcctttggtaaaacagaacaaatctctatcacgagtgattgttgtgaggattagaagaaactgtgtatgtaatctagcttggttcctcataggaactcatatcatggtaggtatgctggcagtactagcatgagccatttcctagagaaaaggattactctttttgcatatgtacaatttgtggcattaaaaacaaatatataagtaggactttgatttctttaaaaatataattttatgggccgggtgcggtggcaatcccagcactttgggaggctgaggcagaagaatcacgaggtcaagagatccagaccatcctggccaacttagtgaaaccccatctctactaaaaatacaaaaattagctgggtgtggtgaggcacgcctacaatcccagctactcgggaggctgaggcaggagaattgcttaaccctaggaggcggaggctgcagtgagccaagatcgtgccactgcactccagcctaatgacaaagcgagactccatctcaaaaaaaataaaataaaatgataataataattttatggaaatcacaattgtccatttatcttttttatacattgattaatggatttttaaaaattaaacaaattaaataccttaaagacaatttgaataaaaagaaccttccacatatattataaaatcatagattttaaaagctagaaatactctcagatacatgagctcactctaaaaccctgttttgctgaaaaaaatctaggtaagtctaattttcacacacatacatatttaaggagcagacacagcactacaagtcagctcccctcgtactgaaagacatttcctcctacttaaaaatgtacaaattattttgtgtgctgagccaagcaatgaaaaagcttcaccattaaaacatgaatatttaaattttaacatttaaatatatctaaaaggaattttgaccccatatactttgtttcagtattaaccaaataaagggcataaactcaaacacattattacacatttatttaatcaaaactaggcatttcccaatcattacaaaatttattacctagttttaatcccagttcatttagaatagatggacagaacatggccatctatataatatttattatacaatttttaactagtaaagattttgatttaatgtaattacaatcagagcgagagcctcaatgtaaggaaaaggagccacaattaaaccacatataggaacctgaaatagtcatttcctttctccccatatatcttacttttctaccaaatggtcccaagtacccaatcaaatatctatgtgaaaagcagatcaatacaaccattcattaaacttatacagttgagaacttcccttgggagaattatccaaagaccaaaacactgccaacaaaggaaaatatgatataagagggcaatttatatttaactcaaatgatcacacttaataaaaagcacaaatcccagagttctaaggggaggaaatgatgtagcgttaaccagggaaagtctacaaataggactggtggtcagctatgtcttcaccaaagtggcatttttgccaacaagactcttggcagcccttaaggggctaagctagcacaattgaccaaatatggtggggaatgtgaaaacttcgcagatattagcatttatttttgaggctaacataacacagtccacaggcctgccatcagagcctgcagccattaagtgataactgaagcagtggaatgcaaataatccattggttcacattagtgtcatgctcatttgtaaatgttcccagtcctcttctggcccttagggtacctcacttgcattttaggggcaaaacccatgggcagtatatttaaaaaggagttaaattatgagcacaccagttagcaatgatttactcattaaaaagtgcattaggctacggtgccctgagctgcgcgacctcatagctgatcacttctaaaatgcttgaatagacattatttatctactggcagtggcccaagatttatctatttcagtcacaaagttctatcatttatctatacgctccctaactcaatgttaaattttgaaatggtgatttaactataggaggaaactacattgaaatgagtgaaaaatgaatgtagcactctgataaaacaggagatatttaagcaatctggcacctctcctctgagatgttaaaaggatgttttaagtaatttatgaatttaaggggataaagccctcgttatggagaaacaaggtcagaagtctcagagcacttgacccagagatgccattttggactcctgattctggaaaagagtaaaactctgtaatttattagaaaagcctgcatggaaattaatttacagcctagttatctccatgttacagagataaatataattatttctcattttgaagttgaaaaagaaaagctatcttagaataagtggattctcccccttactctctggttctgcttgtttatctttatcatatatcaaattaatgtgccacaaataccagtgaagaagtgaaatgtttaatctgaactttatttcactttctcacaccaaggaagagtaggagaaaccatgggagggatatatctaaaccgacattggctggagactacaaaggcaaagaacgaagtgttttcatagtgctaagacactatgctttagtttataaagatcacagtggaaagtgacgtgacaaggtcgtgactgttccttggtctccgaggttgcctaagtattagagggcagagtccaccttgtcagtctgtgggctgcccgcttcccacgtttaagtgtctgatgttaccatctacttgctattccctacgggacatcgctcctcctctggtatggaacgtgaagaccacaaaccttgtttaaactactgcagtggcaggctggcctgggataccatgctgcatccagccgcaggcagaggggccaattttaccctttcctcttgttccacagctcaaaacaaaggagtcttctgaactcaccaggctgcactgacacagactgagtggttcccagaccgctctgattactgctgtctgtagaaacgtgaagggcagggtaaagtaaagtgactgagccgggaatcacagcatgctattcaatctgaatgtttctgtaattcataaaaaatttcctgcttggtcatttgtctgagaaaagaagaaaagttatgattttcctcctcccgtcctcccaaaaggtaaaagcaatgccaagaatgtcctcttaaaatataacattaatttccaacttgaagaacttagcatacttccatcaagttcaatctccattagaaatccactgggcatatacttttaggacctatcaaatcattctttctcagttgtgtaattctgtcggaattttactctaacaactaaatatcaataaaaaatgagaatgaccagaaatgacacaaattttattctgtgataaatcaaaaaatgtcacatatcatagatggaaataaaacataaattagagacccagttgttgtgaatgcaagtagattttatattattaagacatttcatttacaggggcctataaatctaatagttactttattagcagcattctcaataaaaaatagactactagaattactaatagcattctcaataaaaaatagactgtaagtgtatcttactgagcagttttgtaaggaacaatgaccaccttacttatttaattttaataattacactgatttttttaaatcaagaataaaaacaatatttatcttatatttatcaacaccagtgactcagggaacaaacactaaagtttctgtgtcagaggtaataatgtctggttattataataagaattagatttgactctttcagcaaatattaaactttttttccagcagctccaggctttaatttgaaaaatgattaaattagtagaactcattcttattggttagctctcactaacaattggcagattttttcttatttgctcttagcatttttactctgagtagtaaaagtggtggcaactgctgctactactttcaattgctgagcaaacttacagatgtgccaggctctgcacttatacagatgttctcatttattcatcttcaccaccacatgacataaatacttctatcagatccatttcacagatgagaaaacagacatgtagagagggtaagcaacttgtcttggattcaaacccatgaaagtctgttgtagggccctgttctttaccacttagcagctatatatattattcaataatacctttttgataatcttaataaaaaccttgcaagtagatatcattaccactttagagatgacaacgcatacttggagaggtttacaaaattttgccaaagctggtaaaaggcagtgctggcttctgagctcagggtaccaggagggatcttacaaagactccaggtgttagaaggccatagatttggaaacactttacaaaactgcaagttatcaacgtttctaggtatatttttgattaagtaaaaaaaccccaaatttacaccgaacatatttatgttcggctacctccaaaacaggaagaaagagctatgaaggtgagaatgaggtaccacgtgtttataataactggatccagagttttattctgttatgaattttcttctgctctgccttcattatcaatcatccttctctaccggttcctttccttctgcctttaaatcttaagatttgctcttctaaacaatgtcattgtcattagcaaaaacaaaacctttcttcaaccctcagcaatttattttcttcttcctcccaaattacttaaaaactactccatacaggtattcttcagtatttacagaggatcggttccaggacctcctgcagatacaaaaatccaaggatgctcaactcccttatgtgaaatggtatagtaattgcatataacctacatgcattctcctatataccttaaatcatctctagattacccataatactaaatacaatgtagatgttatataaatagttgcactgtatttttagtttttaggtttttttgttttgttttgttttgttttgagacagaggctctgtggcctagcctggagtgtaacggtgcaatcatggctgtctgcagccttgaccgcctgggctaaaatgatcctcccacctcagcccaccaagtacctgagactacagggatgtgccaccattcctggctatttttttattattattattattttttttttttttttgaagagatgagggtcttgctgtgttgcccaggctggtctcaaactcctgggctcaagctatcctccccatattagtatgttttcacactgctataattactaagactgggtaatttataatggaaagaggtttaatcaactcacagttcagcaaggctggggaggcctcaggaaacttataatcatggtggaaggtgaaggggaagcaaggcaccttcttcataaggcggcaggaaggacaatgccagaggaatgaccagacacttataaaaccatcagatctcgtgagaactcactcactatcgaaagaacaccatgggggaaacgacccccatcatccagttacctccacctggtctctctcttacacgaggggattatggggattataattcaagatgagatttgggtgggaacacaaagcctaaccatatcattctgcccctggtctctcccaaatctcaggtccctttcacatttcagaaccaatcatgccttcccaacaatcccccaaagtcttaattcattccagcattaacccaaaagtccaagtccaaagtctcatatgagacaaggcaagtcccttctgcctagaagcctgcaaaatctaaagcaagttagttactgccaagatgcaatgagggtacaggcattgggtaaatgttcccattctaaatgggagaaattggccaaaacaaaggggacacaggtcccattcaagtctgaaatcagctgggtggtcattaagccttaatgttccaaaataatctcctttgacgtcatgtctcacatcaaggtcacactaatgcaagaggtgggcccccatggccttgggtactcccaactaggcctcccaaaggagggctgggattataggtatgaaccactgcacctggtcagtatttaaaaatatatatgtatatattttgctgtattgttattttttattgtagaatccatggatgcggaacgtgtaaaaacaaagggctgactatgctactttccttaagccttcactcattctccacacactcattaaaactttgtatgtggcttccacctccactggatctatatgaaaaacagcgacctcccaaacatcaaactcagtggctcgttgagtcattccatagcatttccctttgtgactgcccattctgtaaacctgcctctcttccttcactttcgttattctgtgccatcctggtttcttccttatctctcaatcattcttctaccttcttcttggtccttaaaaaaagagccgtgctcccaggttctgcattccaacaacttcactgctctccctccctccacattctccctggacagttggttcacttccacggcttcgactactcttccatgcaaggaacttcacgtttccctctggcacagacctctctcccaagttccaaacgtccactggattttaccctggcatttattcttggtttcttaagatttttactacttaaaaaaatcttcattgatatataattcacatacaaacagattgattttagtatactcagggagtcacacaaccattaccacgatctaagtttagaatacttcatcacccaaaaagaaacactgtacccattagcagtcgttccccatttctggtacctagcccacggcaactacagtgtactttcagtgtctatggattcttgtgttctggacatttcatataaatggaatcatataatatgttgccttttgggtctatcttcttttacttagcataatgttttccaggttcatccacattgcagtgtccattagtgctttttatggttgaataatatgacgtattatggatgaattacattttatttatccatttatgaattaatggacatcattctaccaaaagttccactttttggctattgtgaataatgctgccactaggatccctgtgcaagttttcatgtggaagtatgttttcatttatcttaaatatgtgcctttcttgaacaccgagaaactgtcaaactgctttacaaagtggctaagctgtcttacattatcaatgcacgagggttccaacatctccacgtcatcgccaatacttgttacagtctgtcttttttatcacagccagtctagtgggggtgaagtggtatttccctgtggttttgagcggcatttccttaatgactaatggtgcggcacatcttttcacgtgcatgtcctttcatgtcggctgaatattttctgtggggaaatgtctatttaagtcttgtgcctatttttaattaggctgtcttcttattcttgagttgtaagagttctttatatattctggatactggccccttatcagatatatgacttgcaaatgttttctcccatttggtaggctgcttttttacttttttgatggtgtgctatcagaacagtttttaactttgatggagtccattttatctattttttccattgttgcttgtgctttaggtgttatatatctaagaaggctatgtctaattaaagttcaagaagagtatctctcacctgtgttttcaatcaatcagccttggaaatctggaatctgcctgtaatgtaccttttaccaaagcccacaataaatccacttttaattaagcttttaacacttcatatgaattacttaaaaataacagacacaaatttagcagggtggattaaggttcaatggtgttttcaaaagaaagtgttactattttttaccccagccgtgtcaatgtgaacagttgatgcctcaattttagcacttacatttccagctaggatccattttgagttaatttttgtgacgttccttccccactgatttgtctgggtaccattgttgaaaatcaaccaattacaaatgtatgggcttatattttaaaaatcaaccttattttctttcacaaagccaactcctgatttttactggtattgccatctattctcctggtctgatacataaagccatctttgattcgttcctttcctgtgcctcccccacacaggcattagtcaaaccacgtggtttccatttctacaggttgttttcactcatcctttcctttccattttcagtgtcattatatcaaatcaaatcctcactactgctgtcttcagaagggctgagaaataaattcatgtctaaatgggcatactgtgctgtccaaatccaacctactatacagctagtggccagagaagaggagtttaatgtgctgggataagaaataagctggtgctatgaatggctgtgtcagaacaagagcccagcccattcatattctagcctaatccctgaacttccagagtagattatgctaatttggaaaacaggggcagtcctggaggattcaaaaatttccaagttatttaaaagaaactgccacttagtattaagtacttgatctcctaatttaacaagagaggctaatttttaaaacttggttaccacttccttagtgttaggtcaagaagaggacgaaccgctagggcagtcattcttaaaatgtgggagcaagagtagcagcatcagtatctccagggaacttgttaaaaatgcacattcgtgggtcccacccagatctactaaatgagacctctgggagtgaagaccaaaatcagtgttttaacaagactaccaggtcattcctatgcacactagaagtttgataaccactgagctagaagacagatgaggatccagggctgaggtcatatgacaatatcaacacctcttccacatgctgaaattgccaaggaggccacagaactccacaaatcccatcgactgtaaacattcagtagttacgccatataaattgttaggatccatgcttaacttctgaaggtagcataggcttttgaaattattcaaaatttagtgttctcttaagaaaaaaactataaataatatacttgcttatttttataccacaaatcccacataacagaaacaacatagtagagatgtaagtagcacctattattaaagtatgttcctacttaaatatgacatttcttttctctcgggggagactgaaatatatatccaaagagaaagccacaatacacatacagcttttacctagaaatatgtcttccctagacttgaaatccatcagccttgggaatctggaatctgcctgtctgtaatgcatttcagtaacaaatctgttaccaaaacccactaccataaatccacttttaattaagcttttttctttttagatggaatctcgctctgttgcccagggtggagtgcagtggtatgatcttggctcactgcaacctccactacccaggttcaagtgattctcccacctcagcatcctgagtagcaggattacaggtgcacaccaccatgcctggctaatttttgtatttttagtagaaatggggtttcaccacattggtcaggctggtctcaaactcctgacctcaggtgatctacttgccttggctcccaaagtgctgagattacaggcatgagccaccacacccagccttaattaagcttttaactccctatatgaattacttaaaaattaactattggatctaacagacagacacaaatttatcagggtggctttaggttcacagtgtttgcaaaaaagaaggtgttaccactttttacccctagctgtgtcaatggaacagccaatgccttggcctactgtgactggacacgcattctgacttgcagctgcagtttcccttcttatggctgctcccagataagaccgctgcacagaacccagtcctggcaactgctgcctggtcctctccagcggcctgtgcagagttccacactagctccttgtttatatcagtcccgtaattaagccagggccaggaagagaagtcccaaagagggcaacgaaagtgcaaggcaaagaactggctttcggctgcagcttccccatccacctccttcccacctgacctcaatttaagagagtggaaatgggggcccagctgggaagaaggaaggagcatgagcagagaacaacagtttctcatctctggttttttgttttcttttttttttttttttttgagacggagtctgactctgtcacccaggctggagtgcagtggcgcgatgtcagctcactgaaacctccacctcccgggttcaagccattctcctgcctctgcctcctgagtagctgggatcacaggtgcccaccaccatgcccagctaacttgtatttttagtagagacagggtttcaccatgttggccaggctggtctcgaactcctgacattaggtgatccgcctgcctcccaaagtgctgggattacaggtgtgagccactgcacccggcccatctctgttcccttactgctttgctgccgcaaccttctccatcctctttttcattctcagttgccattttgagctttcttcacaaattgaatcctgttttccaaattggccagtgaaacgtttttgccatgctgaagtcatttccagagctaaatcgggaaagctgaggcagccaggccacctccagctggctggaatgcagctgcaataaaaggcagtgtgaataaggtgtattgaagctacactggactcgtgtgaagggccgtttattcagagggggtggaggtgaaaggagagaaattaatgaacagaagaaattaaattagctcaaccacgcctttaaaaaatatactgaaaaataaccgacctgccatgaacctttttacaaaaatggagacctctgggtctgttctttgcccagccccgctggcaggaggcgctcctgagttagataagaaagagcctggaggggctgaggaaaatctggtttctcttactgcagccagaaggatggaaggcacagttgggaaagtcaatatgcagctgagagacaagaggtcaccggaactgatgaaaatatttaattaactaatcacagaacacctgacacaaaaataaacatgtcttttcatcttagctatcacatttttcttcaacaaaatgaaatcacgacctatcatgttctcaaaaagttattgatcaatttatgagcctaatgctttaattgattgcaataatattttactcacacttctaatctgatcttactgccactctaagaaaagctatggggaattccaatggaagaatgatggtgtagttacaagcaaaaagtcctttatactagacgtatatttcatattttgtgttataggtatttattttatgttttatattataggggtatttattaggacagtgttatggaaaattattccttccttaagtaaccacctaattttaatattaaaacatttcataatattaaaacattaagagaacaataatgaatactggtattaaatatcttaaatgctgtttagtgctttctttacagtttcaaagtgagagcacccgtttatctcattttcacctaaatgtgtcttattacatagagagtgagatgttatacctattttttaatttccacaatcagatatccagtaagggaataaatgtaaatcaagtaccacaggatattttgtcaaaagcattatagagaaatgggatggtaatacaatcatttttttaaaaaattctgttttatacaaaagactgagctccatggagtttggaggttaaatctaaaagtactcttaggtatggccccattgtctatagacactaagattaaagcaacagacatttaggaaatagttattagttgaggtacgggattttactttattacctactgaaaatcttaccctcaaaaatcacatcccctcaaagtaaattccagacaaaagatgttctttttccccctttagggtctacaatttatcaaccggttggatatcttctagaattactttatattccttcccatttgaacacagcacactctgaacctgttcaaaggtcagacaggatttaagagtccttataaggcattgttgtggcaggagttggcacttggactaactttatccgatgggcaacgagtttggggagtgcctgagggtgtggtacctggcttgcttgcccttcatgatttttgatgactgcccagctaaacctgccttccgtccaccatttactcatgatgtgactcagaacactagggtttcttggaaagatgaaccgtttctccgctgcattttcttttaaacctttgtgttatcttcctctggtcaaaatgaactatagtaagcttaacaaaacactgccaagctatcatgtgtagtggggtcagccaaaaaacagacttcagctatgcattgcccactaaggtaaccagtgaccacatatgaccatttaagataatatcaattaaaatgatacaattaaaaactgagctcttcatgtgcataggccacactcaagtgctcaatacacatgtgtggccagggatactgtattgaacagcactgataaagaacatttctatcactaaagaatcttttattgaacagacgtgctttacatgattattcttcccaccttctatgtaaactctggtcattatcaaatagaaatgtgtaacaaaatgaacatgcacgccagttatgccctgtcagtttgaaactagtatcctgcccaataggttttgtacatagttctcagtttactcaccacttggcccctctctttgtttctaaccagaaccaccagatacagagacagatccagagctgacctaagtttaaaacataaagcggtgaaatatgccatcagcttcttctcctactcctttctttccctatccattcttctactcaactattacttaccgagccacagtgcaggcactgaagctacaaagctgagtgattcatcgttcctgacctccaggagcacaatctaatgaagaatatggaaaaggaaaaagaggaatttcctaagggctccaataaaggcacaagcagattgggggagcagagagcttggcttgaggatgattatgtaagggctggagctaaggcagagtttctcaaacttggcactactggccttttagcttggaccattcattgttgccctgtgtatcggaggatgttcagcagcatcctcggcctcaacccattagatatgtgcactccccctaaaaactgtcgccagacattggaaacgttccctgggggcaagattgctgcctttagagaagcactgagctaaggcctttgggacatgtttgtttatttactccataacattcttgaggaacttactgcaaacaagtggtgagaataacaagagggaaggacaaagtcctcacacgaaggacctcaaagtctggcgggaactagagtggacaaatgggcaaaggagaaggtgacttcagaacgtggggaaagcatgtaagaaagtatagacgactgacaaatccggggaatctgacagcggggaagggggctcggtgctgggaggagagggggtgtcaggtgagggccatgtgaggcaggacccatgtgaggcgggagcagagtcagatcatgaaggtgttggtgtgctgcaggggttgtatcaaagttagatttcatcgtgaagaaatctgaacaaaggaatacatgggcaggattaccttctggatggtggtgtagactctgtcccatcaaagtgtgattgacaaacacaagtgccatcaagcgtctacactgcagacagactgactgggagtctttttccggttaagataacaaggttacaaatcacaggtgatataatagggatgaacagggagacagggatttgactgatgtctctgggaaggacagggctcactgttggtgttgtagggaagacgagggcaggactctaggctgatttcccagttttggggcaaagacaacaatgtacatggagctcatatcaacaaaggtgggagattcgggaggagcagcaggtgaacaaagaggtctggacaagggaggcgaaggctgcttagctggttagggctgctgtacctgctgcaccacagactggaaatccaagatcaagacgccacaggtttggtttctcctgaagcctcatcttggctgcctgatggctgccttttccctgtgtcctcacatggcctttcctcagtgtgcacgtactcctggggtctcttcctcttctcatgaggacaccagtcctattggataggtccctaccctaatggtcattttaaattaatcacctgtttaaataacttatctccaaatacggtcacattctgaggtactgggggttagcatttcaacatctgaattttggttggggttaggtggcaaaattcagcccatagcagaggctgaggatggcatcctggaaagggagcttaatgtggggttgagagcatggttaaattgcgtggagtccaggttctgtctcctctagctttgggacctggacaaattgtatatcttgccaatatttaagggacaatctgaagaaacaaagtttgtaataaagactgaaaatgagtggccaagaatgttctttacctcaaacatttatcagttctctgagttgggagcatctcatttctcttttagctactttgaaatacacgataaattattcttaacaatagttattctactgtgcaatcaaacactagaacttatttcttctagctacctctatgtacgtactcattaaccaacctcttttcatccctcgacatgacctgtccaatgctgaatgatccctagacagcctttcatgcaaaagaagctcctgataactgaggttatctaatgagtcccacaggctggatctactccacggccacccttgccatcctggacacctatcctggccacccttgccatcctggacacctaccctggcctcccttgccatcctggacacctaccctggcctcccttgccatcctggacacctaccctggcctcccttgccatcctggacacctaccctggcctcccttgccatcctggacacctatcctggcctcccttgccatcctggacacctaccctggcctcccttgccatcctggacacctaccctggcctcccttaccctcttctgctcagggttctccactgggtggcaaatcccaccccggaagagaccctggaggcctttcccctggcttcaggccatcataaaacttactaaattttgctaaagaaaatcaccttctaaataaaattatttggcaatttaaaaatcagaattgcaagataccttagaaactgcctagttgagtctctttaagatgaggaaactcatgcttgcaggtatagacagctctggtgccagtatgtttcatacaagtgatgtgattacagtcagcccattcgcttcctagggtccaacctccttttctataatatgggcaaaataatagtttccaccctccttgtttggagggcatttaccagttcctaagtctgtaggggcgcagcagtgaaaaattgcacaccagtcaagccctcctgacctcacagtctagcatggaagaaagactttgaacaactaaccacaagtgtcctgtcagttacaaaataaaaaacaggatccaatgcaagcttgggaatgagatgccaatgtaatatgggggatcagaacaacttcctgcggggagatgacactctaaaggaaggtgctgtgagaatcaaatcccagcgtgtattgatctaagagatattccttcccacctatgctgggccagaaagtgtgccagtggctggggatttccaatgaacaggactgacggggctcctgccctaacggaacttacagccaacaataaagaacatcatggattacacaaataatgaattaattacaacggcgataaatgtcataaaaggaaatgaaataatgtacataacagtgcttcatgagctttcgcctgccttataaatgctcctctgtgctaagaataatagaagtggcaatgggagaataaagttagaaagaaagcttcctttcttcctgctttcctctctccctcttcctccttttctccatccatcctgcccgtctgtctggggagctggtaagatatctcttgtgaacacaccaggcacatggtaaataattagatagtcatttatggtgttatttttcttctccaatcttacttagaatgtcagatttaaatgttatcagtgtttgttttgatttgtgttttttttttttcctgcatgctttgatccatcagaatgcactggcataattagtaatatctaactttattactaggagaaaatgtaagaccgtggtccccacgcgtcctggctaaggggactaaagtgagtagcagttacaatgcttgatatggcaaagtggaataaaggtgacccatggaactttttaaggagtagactccgttcaagagagaagaccttcgtcaagaaagcctggtgctatagctgcaatgaaccaagagagaaagccggtgggccattccaggagattatggaagaaagtagtagttttaataagttcactataaaaaatattacatttcaaagccaaaaaacaatctcctaaggcttcagtggaaacttagctcacactgttttgtaaacatgacctaatctttatgaaacgctgcatcatttggaatttggcagtgaaggagtagagcaaagagaacacagtcgccactctaaggccccgtggagacctgcaacagggcaccctgtcgttagctgctgaagaaagtccacacatctgcctacacactaaagagaacacagtcgccactctaaggccacgtggagacctgcgacagggcaccctgtcgttagctgctgaagaaagtccacacatctgcctacacactaaagagaacacagtcgccactctaaggccacgtggagaccttccacagggcaccgtgttgttagctgctgaaaagtccacacatctgcctacacactctgagtcaacgttcaaggcttaagtcactctattttctacatgaactgtcccttccctagaaagtcaagcttggaggagcagggagccttatctgggtcagaggcatcgctctggagccttcttcattggacggggagaaactagggttgtggggtgacctccatggagttccaacatagaggtaggtgtggatggccacgcaggtagaggcagctcctgagcagatgctgctaaaatttcacaatctgaggcgttatcatgcagagtctacagtgaacaccgtcaacaatgcgtgcaggaaaaaattttaaaatgtctgatatgctagcacataacacacaagcaccaatgaaatccatctttttataaccacttcaactttaagacctaagcctttattacgattaaaaatgtgttgataaagagcccctgctgttaagtctgatgtcaaatttcataaatcatgaagtttttaagataacttctactgaagtataatatacaaattaaaaagtacacatatcacaagcacatggcttgatgtattttcagaaactagtcatgaagttttatggccaacttctactaatctttcaaataatgtgacaagaagagacagtttggcatagtgaaaaggaaaaaccagtagccagagaagctgctgggtcattttacttcattctggctctccgacactggataaatcagtgacttatttcagtcttcatttccacatctaatcagagtagacaatttctaagtgtaccttctagtctaaaatgttatactttgaaaatgtatgttcccttaactgcaaaaaagcactctcgatgatatcactcacagtgtttcagacgactcagttatgccaacatgtcgcgctaactcactaccacgcaagggagaaagtagttatgctgcaactttttccttcccaggccacttcctaatacatttactagcaagaaaggcatgtcttcagcaaccatccacgtcagagaacggcgaagcgctggtagcagagcgtaagcagcccttgggtgcctgcacctgctttccagtgagccttttagatgtggctccctggttccgtggctcccggctctcagctcctgggggcaagcatgcctggagtcgccacatggtgcccaatattccgggctacagagatggcctgtgctaattacgatacgtttctctccacgaccgtggaacataattctgatgttgactatggcaagctcttaaagtcagccttttctgaattttaacaacgtgttactacttgggcttggtaacgagatgttcttgctcacattgatcaaaactacattaggtctgttaagtcagcttttcatcccattgtaacaaaaaaaacatagaaaagaaaaaatatataatgaaaaagattctattaggaggtcaggccacctattttaaggaattgcagtaactccttcagatcagttgaagaccccatattatggtttccacaaaataaaagggatccaaatacaaagagttaacacattttccaaaaattcttatatgctaggagaattttgttgctctttcccacaaggctttttttttgaagctcagagaactctactgtggcctttgatatgtcatggcaatgactcaccaaactgtccctaactagtctgaaaagacacaggccagcctttgctcattcagtgtatactgagctcatcctatgtgcttgttactaagttagacgctgaagaaacaaaatgaaacatgcattcttgcccttaacaaaccagtcatccatctgaatagggaaacacataaacaataagtaatcagttactgctatggagaccacacacacagaggggagacagggaaaagggctactgtgggtgctcagatgacttctgcgcaatggtaaaggatacagctttatttaaacacgaaaatacttcaaaattaaaatacaaaagaacaacctaatggatgcgaaaatctggggtgaaatatcacatacgctgtgccatttaccaaatgccaactggctcaaagttctagaagtgtgtaattaattctgcacattgagaattaagtatgcaagagtatttaaaatcggcaatggggcaagcttatttatctaaatttccttgctcttaaaatctagtcctcattctggagacacattgtcctaggccattcattctcacttgatgttattaaaactaaaatatagaataaaaggcaatggtaaatacaaaagttatttatggactaagtaataaagcatgacacagaaacccttctaaaaacataaattatctgaactaatggaaatgtaaatttgtagtaaattattttttctagattactgactaaaataagtaaagggtcctagaggaaaggccttaaaaaacaaagtatcatgctgctagatccttaataacccaaaatgatctaccagtcctcagtaatctcaatagaaatgtgtagcacatctggaaaataggtgaaattcctgtttctgggatatcgcacagctatgttaaaattcatttaaattgatacttcaaccacaagataaggtgaatataggataaaaaaatagtaagacgctatatatgacgactcacaatgtcactattaaaaggccagtggacttctaaaaattccttacaagtaaatatgattgtacatttaaatatctgggtcaaataacaggtaaaaacactctgatcactcaaattaaaccataatatttttcttaaatctgttcagcacataaactattgtttattaacaaaattttcaggtctagaatttaaacatcaatataacattgtgaggaagtaacatcttctggggaaagttgaattttccatggataaaagcttaatgttaatataaagataggctgtataatagcaagccctcctagtcacaaaaagcctatttatatctatcaaaagattccaattatttgcatcaaatgtgtctattataaattgcacagcaatcaggagattcactttgttttatttacaaagtttctacatagctgatttacagatattcagggaaggaaagtatacacattaccacaaaaaaagattgtggatttattagtctttgatgatgtcttcttttcccaacttcagaatcaaatttctacaaatagtggtaaaatttaactttaaagtcatataatatgatcacgatatagggttttgaattatacactttcttgtttcctacttcaaatgcagtactttgcacatacggagaattaatgttgcacattgcttttcatatgaatttcttcaatcggaatttaattaggcacccttttgttgagtacatggaattgtgtggaactaaaggaagacctggataagtcctaatccaaaagctattctcgtctaattcaactttctgtgaataaaaatatctcaaaagcatttcatctacacagcttctctgctctaaacaatttacaggttcagcaggaaccaggcataaatctcactgcatttttttaaaacaatgaaacctctttacttggttcattttcttttgtctcctcaattaaagcacaccttctgatatattacatgttccttccctttaaatactgtacacacacagtctgacatagatttttcttcttgccttgctggaaagcttgtcctgttttctccaaactagataaagttcactcagatgtgcttacgggcgcctccctcccctcagtgccctcccaaccctggatgcctttctgtcctcctccatattcttgggtgggcaggaacctggggagatgcagccaccaggcagcttgctactctcctgaagcacatctgggctttatattaggcctttaattaatcctcagtgaaagccaagctatgacattttgactgggcaggctccagttctggacaggtcttgatttattgcgactgagtcccaaccaactttgatttatttcagcttaggggaggaaggcaagcttggaacagaaaagcgctgttgaatgttgagcacgtgatgtcaggacaggccctccagacttccaggggcacgggacaagcggttcagaagagaatggcttctgagaaagccattttaaaaccctaagatttaaataacacgaaattgtaccagacaaaataaatgtaatcacagaggagagaaaatggctcctgaaacagttggctgattgtggcagggtaggaagccccagccttatctctgggaaaaggaggaaaccctgggggccttactgttaatcaggactctcatttgcattcgggggctgctctgtgtggccgtctgtccttcctgagagcaaaggccaggaggactgccccctcctcggcaacaccaacaactgatagtccattaaatgagagcagatttcctttttgcaggcagacagaataagtcaaaagaaggcaaagttactccattaagcaaagacaaaagggtcagtccatttaacgaacgaatttgtttcctttccggccaggctttcctgacagagccgatagtagagtgctgtgctcactgctgtgtccttgagcgtgggttgtcagaacagtgactcgccggctcccacaccagcaatgcgcagtaccttcctgttggccaagttagggctcagggtggtgcccacttaatacctcactgcaggcttcactgggcctagcatgatgcctcgcacatagccaggagcccccagcacagcagctttgactgctgacaaagccctgttccctccttgggggtggcagaaggagtgcatgagatggacctgtccccagtgtcacatggttgacaaagggcaacgtcaacaattctcagaggcaacgttaagttccttaaaagggagataatggtaggaaaaatgtgttgcaaaacaaagaagaggggaagcagaagaaaggggataagggcagaaaagatggatagaggtagcatggcccaagcaagtaagaacagcacaagctctggcatccatgacatgagatccaaactccatcccagcgacttacctgcatgtgctctgtgcaagctacttaaccaagcgatgcctcctttgggcagcgagcacttattctcagggcagctgtgaggtccaggggaaagccttgcaaagctcttccacactgggcctcacccctggtgccgagggcactggccggtgtcattagaggtggggcctcaaaggtgcctgtgcatctgcatgtggggccagcacatagctgtgggtgctggcgtgtaggtgggacctcaaaggtgcctgtgcatctgcatgtggggccagcacatagctgtgggtgctggcgtgtaggtgggacctcaaaggtgcctgtgcatctgcatgtggggccagcacatagctatgggtgctggcgtgtaggtggggcctaaaaggtgcctgtgcatctgcatgtggggccagcacatagctgtgggtgctggcgtgtaggttggacctcaaaggtgcctgtgcatctgcatgtggggccagcacatagctgtgggtgttggtgtgtaggtgggacctcaaaggtacctgtgcatctgcatgtggggccagcacatagctgtgggtgctggcgtgtaggtggggcctcaaaggtacctgtgcatctgcatgtggggccagcacatagctatgggtgctggcgtgtaggtgggacctcaaaggtacctgtgcatctgcatgtggggccagcacatagctgtgggtgctggcttgtaggtgggacctcaaaggtacctgtgcatctgcatgtggggccagcacatagctgtgggtgctggcatgtgacaataaccccataggccatctgggaacacgtatgcaggtgtccctgagaaggagcgcccaggtggctgttgagtccaagccatctgacatgctcaaatggaaatggaaagtacccaccgagactttcttcacagatccacacagaacagctgttccaaaaaacgatacaatgatctttacatgaaactaccaaataagtgatgcttgtgacaagtattactgtaactgttagctttgttgattagtcttaaaggttgagcagcacattagggacctcagagaagtgctatcacatttcaaagctggctgcatggcatatgtatatatgtatataagccatcctacatatgcatataagccattctgtgggtggtcagttccccattcctgcaaatagtcaagtgccagcattgagagctggggtgccaggactcagtaagccagttccaaatgtgcagtgagcctttgcaccatgaaactaacacaatcctagggattctcaggtactatttagcccacaccaaaacactaattgctgttaagtaaaataacctgggtcaaattagatatttgcacaataaaatgcaattattctgtcattgcagtcagcagattttaatttttattgccttttttaaacctaggttatctgaatacatgcactcactgattttagaaatcaaactcttttcacatctctatgatactctagtttttcaaagaaattctcaagaggttagtggggtgtgaagcccaaaatgctggccattcacaagacctgtgaagcctacgggtcctgggtttgcaagccagggggtttcctgcagttccaaaagcttttgtgctagagggcagggagggaggacaaggaaaggagtaggagctctcccatctgggagctatcttcggatcacacagacagaagcggctgttcccaacggtcccaggctactcaaagcacaggctgcaaggtccttttcaccagccattcattccctaataacactttacatagcaggaaatgggcagagaacccaccgtaggggctccctgcacacagccccagcctccgagaggaggcaagggtggatggcacatgttcctctcccagaccatggagggtgagaactcagatgcactgcaaaactgtcagtctgtatgcttccaggattccttatttttctgtcattgtctcacaggcatatatatttgtgtctgcaagcacacactctaacattatttgctgtttcgcatgtgtaatctctctacccatttgacaactggcttatggggaagatggcttggcatgcacgtgtcagtgtatgtgtatcaacttgaactcaacacgcatagactctgatactctaaagctccacatgacagatgaggggaagatgagaaactggtggatgggtttcagcaaatcaagcaccccacggtcccatgtactgattttcaaagctgaattttaacataatttaagccaacaaaacaaacttggcacaaagcaagatactgagacctctgaataaaagcaactttctaaaaatatttaaaaagaagttttgtttaagaaatcccaaaccaatacctaccttgggccaatacagtattgaaacaagggaagtgacaggacaggaacccttctagaaatgttccacctttgaaggtatcatctcactaacataggtgaactctctgttttatgacatggtgtatttcttttcccaggcaaataatttcctaaagcaaccatcagtgacacatttaatgttacgaagtcagtcggacacagagcaagcatgaaagcctgcttccatgggaggcaggtgagcctcctgagctggtacacattttacaaaagcacagaattttaagggaatatagggttataaacataagttgcatgtccatataaaagagacaataactggccaataaatgaactatacagttctcccctcttatctgtgggagatgttccaaagtccccggtggatacctgaaattgcaaataccaaaccgtacacacacgatgttttttcccatgcatacatatccacgataaatcgtttaaaaattagacacagtaagagcttaacaacaagaactaataatagaacaatgataacaatatgccagcatcaaaacgcttgcaccatggggccattattaggtaaagtaaggattcagtgaacacaaacactacaatacttcaacagtcaatctgataaccaaggaggctactaagagactaatgggtggggaacatcgacagtggggatccaccggacaaaggaatggttcacgtccgggcagaacgaagtgggatggtgtgagatttcatcatgctactcagaaaggtgcacgatttaaaacttatgaattatttctgtaatttcccatttaatattttcagatcacggttgactgcggacaggtgaaaccgtggagagtgaaactgcggataggagggggctaccgtaccattctttgtaggttccttttcttatatttttcacttaaaagcttaaactaatgtttctctgtcccaagtagtttacaaatgtagaccaattttgttctgaaagtctcttggcaaaagatattttcttgaatcaaaattttctttaaatttgggctatgctacaaacctcaataaaagtggcataattttaatttcatcattccagttaataaagaggcatagaaagtgcatcactctactcagccatcctcccttcctcttgacttcttatcattcctctgatcctcagacacacacatggcaccataaggcaggaactgctgctcgaaggcttgatgattccaagagaggtgagaggtaagctcttccctacggctgtttgctcagacagctggacatgtattggaataatctgctgtagtcagtttcttcatatgtttatgtagctaaagattagagcagaaattaaaaaatcaagagttctgcgttaagatcccaggtctgcacctgactcacggctgaccctaaaggcaagccattttagctggaggggggttacaccatccacatctctgtaattagcatgcctataaccaaccagttcagacaaaaagactttgagattcccaggggaaaaaaggctacgtagatgaaagaatgacagggtatccaccagaaaacgcaggatattagtcacaccggtcaagttataaacgtttaatttatttgtattgctgccactaggaataaaaagagcatatcatacatcttgatgaaatgcctttcaaacaaagactttacggtttttggaacaagtaaagtttggtgaattaagtgagataaaccccagagaaaggtgcagctaaactgctctccatgatgaaattaattcttagtctgaagccgaggcacttgagtaaagttttttcaaaattcccacttgacaatttaggttctgcctacttgtgaattacctgcttaaaagaacaggtacaaagactctgcctagtacaaatcaaagacccaaaagtatagactatgttctttggttaatcctatgtcaacaaccagatgctttcttaggtcctttactttagaaatcctgggattctccgggttgcaacaggatcttgctgtgagtgtaagctgccctccttttgagtggggcccagtagtcactgagggtgattcttgtgtggttgcttttctccaaggacaatctgtattctagaaggtaaaatgtgtccatccgtgtgtgatgctggctacagccactccaaaacctccctgaagactctccctctggggagaagactgagaagagtcttctgcttactccttccacatgcagggacggcatggctatggccccatgggtgagtcagtaggcacaaggcgagggtcacatgatcaccacaatgaaagtgatacagtgcttatccatcaagatggcatcacagaagcatccagattttcttttctcaccgctgcccctcttcaggattccataaccgtagttaagaacagtggtttttaaatatgggattccgtgtataagaaagcaaactcccgatcaagatccagaggcctgaactgtggctcatctgagatgaggtgtgctgtgaagtataaaatgtacactggattttgaagacgtcgtacagaaaaaggaatgtaaaatgtctcaataattttttaatattttttacatgcttaatatttgggatttattgacttaaaaatattcttaaaattaatgttacatttttactttttatagtgtaataatcactgaaaatttaaaattatataacatatggcatgcatgtatagcttgaattttatttctatcaggtagcactttctatagtattttttgtcctggtatgtttaaaaaaaaaaaaagatgttagcttagcttaagctcagaataataaatgaaactgaaaaaaaaaagaagatgatactgggctttataaataatttgtttcactgagggattgtacaatgttaaaacacaaaatcataatctgtgtcacagaacactacgttctgttagcagatatatttaaaaacaacataaagtttatactagatggtaaatactgctgtacggaaaaagtgttcaaaagatgattccatattctcagtttctaaatcttaacctgtgttgaactccagccccctccctttgaatagaaggaaagtaagatttggaacggtgaagtgattgtaggaggccaggcagcagcaggaagaggctgaggacccaacatacagcacagcagacgctttgcacatacacgagggtcttttgattctggcgtgcagtcaccaacctcaccatgaaaagcctcagtctgaggaaagtgtagggataagactgaatattccatctagagataaattccacaagtatatatagattgttaataaaaacaagtggtgaggccaatgccctccaggaaatgtgtcacaggagtttttctctgaatgagttaagcattgactttttaaacattgctattaaaaaactggcattgtgtttttaagaaaaatctctggaagctctggagacagggcaattaatgaattaaatgtaccactaaaaagttcacttcatttcccaaggtggtctgatggaaaatctgttcccacagcctggaccctacagtcagggaaagatggaggggctagttctgaagcatttcgaaagcaaagaaaacagcaacgtgtaccatatatttgatgtgggtaatagacagggccctccaagaggaacgtttctaaaagtaataagctttccctacatactgatccgcgtaaccagagctggggaaactgtctccagggacatgctaatgtctcccaaagaagggcagtcagaaagttcagctgttctatctttggaccattaatactggatgttgagtcaggctacatcccaaaacacctacaactgaaaagtaattcttctcaaatgaaaactggcatattaagtgtaccctctgggtttggggaatgtttcccatcccaaaataaatttttaagcacaaagagacagttagaaatggtcactctgctgataaccatgctttattcagtaatctgtcaaacaggaaaaaaatggcagaaaaaacagacgtttatattttaatttccttgtgcctgttctttcccctattaaaaaaaaaaaaagccgtggaatttgtcaaaagaatgaacagcaatcatgagagtatgatatgccttccacgctgcatgggctagttttcaagggaaaagaattacagcagagagaggatgttgccacacacatataataacggcatgaaccattctgacttgcaacataaattgaaccattgaaggatttaaatgttcctcattaacttttattagcctcaatttttaacttttttccttcctcttaaaattaaaaatgagcattcccttcaactttgcacaccttcaagcaacattctgactaagcaaggtctttgagggaccacgaactactctgtagggaaaaaacacctccaaaaaccaaatcctctagtacagagtttttttcaatgtctctaaactcttcataaaaaataataggtctgaggctacatttgaagactttttcaaactaaggagaagaataaagatttcataatcttatcattttagaatcgaccatttctgatcactaaaaataagtgatcttggctgggcatggtggctcacttctccaatcccagcactttgggaggctgaggcgggtggatcacctgaggtcaggagtttgagaccagcctggccaaaacagtgaaactctgtctctactaaaaatacaaaaattagccaggtgcggtggcgggcgcctgtaatcctagctacttgggaggctgaggcacgacaatggcttgatcccaggaggcagaggttgcagtgaaccaagatcacgccactgcactccagcctgggcaacagagtgagactttgtctaaaaaaaattttttaaaaagtgatctaatcaaaggactgtggggagcactccaactttttagagttctttctatgtgataggtaacaggttaaacactttgcattaccttacacagtaaaatttgaaagctttaaatacaaacagttataaaacaaagtcttatccaaatgtgaaatgtagtgcctactgggtgaatgtgataccccaccttcccttaaaaaaagaaaaagaaaatactgtggggtcttcctctctccatagcttgtggatctcaactacccgtgggatgtgcacagaccaaaaacagaaaaagagaaaaaatgaaatatatatatacaaacaaaaccttttggtgactgtttctaaaaacaaagatttagaaagcagtatttcacaaagtgaaaaataagtgcacacttggtcagaaaattttcaaaatctgtagaatattacaacataaaaatacagaatttcaacctcatgcacacacccctctgaaaatgtgcccagtgaccagctgggattctctgtgtgtaccacaagcccaaagcagcattacacattgcccttctggatgagactgaccttacctctgccacacaaactataaactgaatgccacaccctttagttatgtaatttgctcattgtttattgttaacttgctcatttattgttatttgatcaagaaaactagttattaataactgaccctttaagaaagtttgcatgtgggccaggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcctgccactgcactccagcctgggcgacagagcgagactccgtctcaaacaaacaaaaaaaaaaaaaaaaaaaaagaaagtttgcatgtggtaaaaatgtctggattatattctcagttgcctcagtttgctgccaaggaaatttggtagcaaactatctaaaagacatttttagaagtgagttttcttcctcaaagaatagaagggtgtgatttgttttaaaagaccatattccagtcacagggaaaaaaaggctatgtcaaaaatgacaataatatgcactttttcaccttggaaactttagacttgaaagaagcccatagtataagttttccatcactccagttgaattctaagaccaccagtgaaacagcaccactcagaaaaccacaggggtggccctgctagaatacacatatagttgctgaggaacaggaaacgaagccagatggttctgctgagggaagcacttttttttctttataaaaccaaaaaagtactaataggtcaaacataaaaatgcagatatggtaaagcggaaagctaacaggaagatttatgtaaataaggcaagcttaagtttgcattatgttcccatctacatcagtgagtggatgtacggggggaaaggaaaaaataatacagtatatccatcctatagatctttctgctgatgggagaaatgctactagcaatcccatttaggcactgctgctaaactgtgggagccaaaagccagcatatgatttgtgttacatagaacgtgtgtcaattatcatgaaagcgttttttgtttgttttttttttttttttttttttttttaattaagagaacttttgggctaggcgcggtggctcacgcctgtaatcccagcactttgggaggctgaggccggggtatcatgaggtcaggagattaagaccatcctggctaacacggtgaaaccccatctctactaaaaatacaaaaagttagcctggcgtggtggtgggcgcctgcattcccagctacttgggaggcgtagaatcctccagttgaggagaatggcgtgaacccaggaggtggagcttaaagtgagccgagatcgcaccactgcactccagcctgggcaacagagcaagactctgtctcaaaaaaaaaaaaaagaaaaaaaagagagaatctttaaatacagagtctgaagtaactataacctagactctggcttcttgcacatctggtttactgtagttattcacagtctcatgaagtcccaatgcagggtgacaagtgacacctgagactatttccagggaagatccctgtgctccaagttcccaaggtgcgcccctcacaatgtcaaaggcagaactgcaccaggcactgggccttagtcttgtgtctcacagggctttggatggcaaattctgaatcctctcctgtcgcgcccaactacccatcattcttgactggtgtctgcaaagctcaacatccagccactgggcctccctgaagcacagcagtgtggtcatgtacacagctctgatgagtgaggtgctaggccctctctcccacacaggcccccctcctgcttaggcctgggcagaagtgtgcgaggttgtcatgaccttgggatggtgaggataccttgggaggtctgcaagtcaggcagtggccagccattgcccaccctgggctccagctacagcaggtggctggcatccactaaagggagagcagcacggaggcctcgcatgcccttagacctcgaaccatccactgtatctgcagagaatatgtgtccccacagaaccagtggttttgcttttcccataaagaagctggacacttggatttgaggctgagttggtttgactgagttcaatctcaggcagttgagcaccggggttcaagacgctgtgagagatgctaggggccagatgcaagcattgtcagccaggccctggcagaggctcacagggctgagaataaagcattgcagacaaggcgggaaatggccaattcttcagtgaagtggccaggagagtagggcccctgaggagggcatctgcagaggcagctgagtgctgagcctgagcagggcaggactccaagggcaagcagcaggggcagcccagggccggcacggtgcagggccagcagctcccagctccggaggaggacgctggggccctgcccaaggccgagaatgcatgctccagacagcggcctttattccatggtggagacagtgatggttttaagttgaaatatgacagtatctgtatctcagaaaggcgactctggcagccatgtgggaggcagagagagcatcacagtgcagggtacagccagcacaagggtcggccgaatgaacgcgcctgatctgggccagactcagcaagcctctctctctatgccttatgttttccctctagtgagaaaaatatgagaatagcacgtatcttaccagactcctgtgaaagtaagcttgtaaaagtgtccagtagttcatgcattttcagtacgcaataaggttttgaacttgaaaataaagactaactggatattttaattcatggtttcaggctcaaggaaggctttgactttaaaataacaactgaccattagagctgttcataaagaaagggccatattgggaggtggcaacaccttcaccattcagacatgtcccgcccagccactgctcacgcaggcttcgcaggtggaagctaagctgtacctgaagatcttggcattcttactggtgtaaaaactgtcattaagcatttttcaatatacaatcatggtttttacgtagtttagccctttattcctatgatgtttttgctaccccattctagactgacaacatggctgtagggaaaggaagaccagcagccacctagttacaaggtagcacgcccacagtgaccagcgctgatgaaacgtgagggtgcagctgaaggaaaatggggcgtctgccagctgctcaccaggctctatcaacccttcacgtgcgggggtggggggctgttcatactcaagatgccattagcgcagattctccaaagtaagagttttcatattgtattcctaccccacaatctgtgaaagaaagggagagagagaggagatgagctgaagggaggggaagggaaaggagggaaagggaagagggaaaaagagaggtagggatgaacagagggaaaggagagtgaaagaaagagagagagacgaaaaagggagggagagaaagagagagagccaatcgtggcacagtgacttaggaagaatcctactgaaatgctcaataaagccagtgtaatttctttgagccccactggactgctaacatttgagagcacaataccacgcgcaattaaacaagcaaacccacaattcattagggataattttaatagatgactcattagccagccagttaatgatgctttgttttcccagaggcccaggcagatgcttaactacaatgaggcttctactgccactgacaaaaggcaatggaatctaaaccacccatgccacgtcttcaagcttcttcaggtttttttttttttgaagataaggatcaaatgaaacgacttctgttaaacttgtatttcctgtacagaatggatatcttcttcaaattatatgattgtacaactattaaaggactgcttaatgtagaggaagtctgtttaggacacagggactggccttttcacatgtggctcctcagatgttctacagtttccttcacactcagttcctcacactggagtggtttcacaggatgattagaggtattaggccagcagtagagatgctagtttatatgtaatacctagcgagaggaatacgtttgctacacaatcaacacttgaagtcactaaaaaaaaatgactttaaaaatctcacaagaatgactaaatataccaaaaatcagcccagaaacatggcacagtatcatggtaagtcactgcactgaggagttggcagagcagggctggaacccactgcctgataccaagagaagacatcaaacaagggtttctcctttcaatgtcagccttttcctatgaaaatgacaaaaaacaatccgtgctctcctaaccatggtcaaatatgtgttgggagaatcaaatacaaagatgtaaatgacaaagcactacaggaatagaataggacaatcttccagggtttaaaataagttctagtgatagatctttatattttattttcaaacttgaaatttgagacccaggcaaaaccagcaagtaattcttgactaaaggacacactgtaagaaaaagcacatgaaactatgcagcccttgaaatcctcatctctgcctttttctgttgagacaaagtaggcgcagctctgctaccttgaatggggtatctgtatcctgtggacttggtgacagaatgccccgagaggcaggatgccagccgagtcaccttcctggaatgcaacctgtaccctccaacacaggcacccacagactatcgctctgctctgtgagtcagaagctggaggacggacccaagaacagggatatgtcgtctgagcatgtgggtgatgtgcgaccagggaggaaatgaaatcacactcacgagggacagaaaatggtactgcagaaggcttttcttttcttcttactgcactgtttccacagatattcccagagccactgtcaaataaatacataagaatctttaaattctatatgtatttaaaaataaagtcctattattacaacatgacctgcttctaatttgcatgtgttggtgatgggtacagactgagagagaggatagagaggggagaagagaagggatgggagagtgtgacggttttccataataatagagccctccttggaactctggctctctagaagaatcctctaacaaatgagatccttgaaaactgagaggaaatagagtgatgatcacacaaaaaggtttctgaatgagctgatgtcaatatcatcaagtactcccatgggtacttggtcttataagctaatggtatattagtgatttttaaatattattttgtaaaacagggccagtttatccttctgcctttccatttttctatctgctcagatattcttcctttaaaaataagaataaggccgggcatggtggctcatacctataatccagtcctttggggggccgaggtggacagatcatttgagctctggagttcaagaccagcctgggcaacatagggaggcctcatctctactaaaaagaaaaaaaaattcagccgggcatggtggtacatgcctgtagtcccagctactcaggaggctgaggtgggaggatcacttgagcctgggagatcaaggctgcagtgagccaaaatcatgccactgcactccagtatgggtgacagagtgagacctacctcaaaataaataagtaaatcaaaagtaaaaataaagctaggaataaagtctaataatagtagaatctagagataatcaggaaactggccactgtgtgagaacatatagacgttacttcctttcatttatgatctgcactcaaccagaaagaaaggtgcttgcaaacattttgctgatatcaagtaaatctagcacaactcaacctaagtgtggtaagatcatattctgggggcaatgtcttgtgctagctaaagaaagcatcttttaatagtaagagaaatggaacacatttcatatatacagatttcatttttataattttataaagaaatgatgggcagggagatccaattcaggtatttactgggcatctgttatgtgccaggcatgttgggagggatgattaaagataaagagggataggatccaggtcctgccttcaaggagcttccccaagagagaccgacatgagatagctaacaaagtcctgactgctcctcagaggtctccctcacttttctctctatagtgagagcccaaccattctctctatgagaaaaaatggtaaaagtgatctcaaatattttacataactctgagaggtacttagggaagctatcctatggagtaatttcatccctttctttgagaactctactaataatttccatatgaggcttaggccaacaatgtaaagacaatttctcaaaggatttctcaattttgcctttacataattcggcttctgtaaactgtacctgtaactaactggccctagtagaagtccaattgtttttctcttctaaaaggaaaaggagactttcacttaactatacctcaaatttatctgtttggggcatatgcagcatagtttctgaagcaactctaacaagtcaaaaatcctctggaaatttgatcccaagagtacaatggcttttgaatattcttcaccttcaataaggcatagagtagaagcacatggaaccaagtccccagcctatattaaacttatttctccagcaagtcagtgttaaacatcttattcttacacgagatctggcccatttcctacagtatccattccgtgttgccaggtcttaccgttgatgccctgggccatcaatcagagtcacagggatttcaggatcaaatcagcactacaaagccatcaattatcccagctgtattgaagtcaacaggtagaaaactgaaataacagatacaaatgacccaacactcacagagaggattgaactttcttctttacctgagaaaaaggataaggagaatctttgtggcattactgctataattccttcccacggaataagcagaagagatgttttccagcatgaagtgaacggggctgaaaataaaatgtgtttctttgctttcgggaacattcaacttaaaaaaggttttgttttgtgtctttggatacaaaggcaagattaacatgcttgtattagagggtcccctgaggatgagcctgggaacctggagcttgggcttgggcattcaggtggcccaaaaaaggacagagcagagcccccaggcttctccaccagagctctgcaaagacaaaacatgtaattttagtcaattatttcctgcaataaaggtgctaataagtaggataaagccaaacagtactttagcatgcattcaaaaacagagatttgacttctagcttgtgtgtgtataggaaagagacagagcaagagagatagagtgattaacgtatggtatgtgtgcaaaagactgccttgattgcaaatacgttttgccctctccagagtgcatgagtataaagatgaagcactgaatattgaagatataagcaaaatcatcactaaatttagatgatgtcacatcttgtgagagatatttacatctatttcctgtggacagtcttgttattaaaattaaacagtcagtttagttcatattttcagattttccagactttcacagaagtcacaaaaaagtgggagacgtcagtgaaagaagagacaggtggggagcagggcagggaaagaggaagggcagaacaggctggggtggactgagaaagctcaaggaatctcatggacttggtaagtgtgaaagtgaatagctaacctaagtgtgaacagttctttagtgtaagaattttcttacactattttcctaggagttttgctctcaagactagcaccatgactttcttaagtacaatgggtcacttcatgatctgcaatggtataatgacccttcacatcaatgagcgtgactaaagggtggagtacaagcttccatcttaatgtggttaattgctacccattagaacttaagcagcacttacatgaagtttcataaccctcataatccacgtccacaggcactatacctaacccattttatatgaacatgcaactttattctctatgcatttgcatcctctctccatacataccctggccaataactgcttttctgatttaatgacatatgctcaattttatgtggtttaaatcaaactgaaaatgtgatctaagaatgcacccagtctcatgtttctaaactatctgtaaatgaaaactcaattcatactagaaatatgggtgatacaggtgtctttcattaaacaacaatttaaaacgggctctacaggttcttatttggggacacagcagcttctgggatgtcattccaatcaagcaagacctagccagataaaacaggcaattgattttctacatttttcttaacttattttaaataatacactgaaaagtttactgcacaggatgaagaagagaaaaaaagagaaatggcaagctgaatttgttatacagagttttccatagccagatcaggaaaatggttttttgcttaatctaaacattttatgtttcaaagatgcaggaaactgttacaagcttttcttttcctataaataaagctgttcttttttctttattaatcaaggcccttgaattgcctttcttaaatgtttggtttgttagaaacaacacagaaaccacgttcttctaaatacagataaaggagagactatttatttagttattttcatttgtatttcttggaatatttttcaaagagagtatattaaatagctccacagaaggctagaagattttttcccacaatggaaaacaatagcaatacctcactaatcaatataaaaagtcaaaataaaaaatcgatgagtattacaacacattcagtgaggaggccactgacatatttcccttccaagaaagaacaccttaggctcctaagtaataatatggaattagactcccacagtgagtagaaattcaattgctgaccttattacctaacaaacagtcacttgacaaagattctaatagaataggttttctaggaaactccccaggtaaatatcctctgcacgtagttacacaatgccttcccctctgctaggaagacaggaacgatgttgttaagatagagagctctcagcagatccctggtttttccagaccactgtcactttatgagacagatacaacctcaccgttgctttctgttaagtaaggccttactaacaaatggattcaggcaccactaacactttagacaatggaaacacaaaaagatactactgctatatgctactctcctgcatatgaacaaacatggtctactgatggtgacagaggcaggaggcagacaggggcaggtccctggtgaagctccaccttcaaaccaaaaagcctgaaactcacggcccaaggcgacaactctactcctgtttgcccactctctcctgaatggttccttcggaataatgcctttttgcccatcaaatgttgcctttttcaaaactaccgatagcccgtcctgtaccccatcctctgcctataaagaccccagactcagtcagtagaagagagaaacgtggtttgactggagagggaaaacttgacttcagagagcagctggactttggaagagagatggcttgactcagggaagagccggctggacgtcaggggaagacttgtcccgtcccatctacagctagctcccgtctctgctgagagccatttccgttgctaaataaaatcctccactaatacagttcagctgcgtcccctttcaaatctcatcttgaattgtagctcccataattcccacgtgttgtgggagggacctggtgggagataactgaatcatgggggcggttcccccatcctgttctcatggtagtaagtctcacaagagctgttggctttaaaaggggaacccctttcacttggctctcattctctctcttccctgctgccatgtaagacgtgcctttcgccttccaccatgactgtgaggcctccccagccacgtggaactgtgagtccattaaacctctttgtctttataaacacccagtctccagtatgtctttatcagcagcatgagaacggactaatacatccaccttcaccatccttcaagtgtccacactacctcattcttcttggactcccaacaagagctcaggacccactgagtgcgggtacccaaaaaaagctgtcacactggccctttgccttcgctggcagagggcagctgctccacgtgacgaggcaaaggaccaaccgagttgataacacactgctgtccacagacggcagagctaagagagcactgtaacacaccctctggggcttcagggtcacaggcacccccacctgtgtaccacagcaacactcacacgaagattgctcctgctggtgaccagagcagctggtcttgctctctcacgtgctccctcccacaaggggttgagcgcagcaggctgagtaaatggagcttgttcctgccagcgcacagagcagcagccagccggatcccgcactcgctcactcacgcgctccctcctacaagcggttgagcatggtgggccaagtaaacggagcaccctgtcacaagtccagtgaaagggtcgtgaaaaatccgacatcaatggtgatgttgcaacaagcaaacttcccttaaataagatctcaaagtttaaatgacgtctcttccttccagatttgtgtaacataggatacaaaatgctagtagaagatggacagataggaaagaaaggactgggcagcagtgggcagttctcccagctctgtctgtaacctatgtacccttccagaggctcctcaccttccccaggtctctgtattagctgagaactgagagctggaatgaaggtaaattcattcagaggacaagggatagagggggctggagacctgactacatattttccccaaacacaccctttacttctttacctgatacagccaatagcataggttcggcaagatctgacagctgtctcagccagactctttcttacatttaaaacctataagaagtcttcaaaagtttctggcatataataagtgcttaacatttggcaattacgtttatttctaaaagtagttttgttatgattcagtctgtgctcactgtcccctgccacctccacacaaaaaaggatgcaggtatatgacgttaaattctgatgaatttcaacgctcacccctaacgatcctcacgtcctctgggttaccagtaggacccttctggagcatctgtgggattagctgtagcaggaaaacctcttgccactttatacatggcttttactgagtcctggaaagaggctggacttaggtctcttgattaaccctgtctcccaagagcaaggggccttttttgtgggtggtaaaagcctgaagatactctggcccagctcctaccatttagcttatcagtcaatatgttctggctatagttgtgtttcacatatttatatcaaagtgggatctcattgggaccatatactgccatttgtagcaaccagaactgtgaccatggcaggaactcaatagaatacatgttgaatgaacagtgccaccctgagaagtcagaggttctctcccttagtgttttctgccaccactgctataatcctgactgctggacattggttgaaaatggcgcattgccactagagtgttctcgtgaagctgcttgagcctatatggagagaggtgggcataaaagcaggttgtagaggggtcaggtaaatacttaagataaaaatattttaaaagtttgaactggccgaaatcgcaccactgcactccagcccgggcgacggcgagactccgtctcaaaaaaaaaaaagtttgaactgctatctataccccataaaatgcaaatttttagtagcttgtgtttgtgcaaattgaatatttgtagctgtaagccattagcactacagtaattacttaaatactaatttttgttcaaaatgcaacagtaattgtagacattaattacagaatctgggtggtacgcaggtgtttgaggtaaaatttattcagttattctgtatgtttaaaaagttttataataaaatactggaagagatctaactgcctatgactttattcagaagtacaatataatttaatatagctgtatatatttttttcttcaagttgaaatacttctcactcatttaaataactttgaaaacatcttgatctaggaagcaagactacagatggatgaaaataaattggaatcagcaacaagtaaggactttttataaatcattgtgaaaatttttacaagtcagaggtaaactttattcatgtatgtatgtatagcacactgatgctaattttttacagggtttatattctgtcctttacacagatggaaaaatcaagataaaacagcttgtctaagctgagaaacaatgtacttgcacagcagggataaccagcacccacctcacaacacgaggagaaaatgctctctgctcttcatgatggaaattcactgacaagtaaaaaagtgtcagtcacttcatctgaaggtttactaaaatttttgcatataaaagagagaggttgtgatacggaagaggggcagggaagtgccgggaggagaagggcaggtccctggtgagggctccacccccaggcctatgcccacggactaggtgaggacaggcactcctgccttcacgcccaaatgctgcatttcccaagaccaccctggcccaccacacccccatgctgtgcctataaaaaccccaagacacaagcagctgaacatcaagaggaacacaccagcagctggatattgagagaatgtcgagagcataccaacaggcaccagcacaccggcaggccacagacgggtggaactatgccgagtttggctggggcggagagaggagagctccagccactgagagacccgactccaggggaaaaccaccttcccacaccatctctcttctggttcccccatctgctgagagctacttccactcaataaaaccttgcactcattctccaagcccacgtgtgatctgattcttccagtataccaaagcaagaacctcaggatacagaaagccctctgtcctggagataaggaaaggggtctaactgagctaacacaagccacctatggatggctaaactgaaagagcaccctgtaacacatgcgcacagaggcttcagctgtaaacattcacccctagatactgctgtggggttgagccccacaacctgcccatctgcatgctcctccaagaggtctgagcagtggggcactgaggaagcaacccataccaccatcacacgctctgcgagggggataagggaacctttcccatttcagctgtataattaaaacgtgtgtgtaaatgagatggtattatgacttgtttgacctacatttgcaaacacttctttattctaaagttgatttcagtgtcagggtgcatgtgtgttttaaacaaacaatacctctcctttttcatttttatgattgctgactttaattttggcaacaaatttacctttagtcataaatctctgaagtaatcttatgttaatacacttaaaattgcaaggaatgatcatatttcttaaaacggagggtaccaagctataaattcttactgaataaacgtaatttagactttgttcagaacacataaatgagaactataaaatgcttcctacatcatcaacatattagaaacccaggagagtccttaatacacaagacccacttgtattatagaacaaatcaaggcttggatggcaaggagaatgacctaactttctatctgtctctccatggaatctgaccatttcaaatttttattcagagggtagcgtgttgatgtatttttattcagagggtagcgtgttgatgtatttttattcagagggtagcgtgttgatgtatttttattcagagggtagcgtgttggtgtatttttattcagagggtagcgtgttggtgtatttttattcagagggtagcgtgttgatgtatttttattcagagggtagcgtgttggtgtatttttattcagagggtagcgtgttgatgtatttttattcagagggtagcgtgttggtgtatttttattcagagggtagcgtgttggtgtatttttattcggagggtagcgtgttggtgtatttttattcagagggtagcgtgttggtgtatttttattcggagggtagcgtgttggtgtatttttattcagagggtagcgtgttggtgtatttttattcagagggtagcgtgttgctgtgtttttactcagagggtagcgtgctgtgtgcacatgctggcttgtgaaaggctgtaatgacaccgccttgtcaaacaatcataaatgacttcactgaacacgacctttttgcaccaacccctactggagccaaaatgtatataaaatatttttattttatgctaattcaaacgtgggcctgttgtgcccagatgtggactacactcgcagcagcgctagcttggcatttgggaagtgttgtgcccagatgtggactacactcacagtggagctagcttggcatttgggaagtgagatgacagcagcgtccttctttcagatctactcgttgacacaagacttcctccttacttacttaacactctcattcattttcatgagactttttggcctgtttctgaaatgtcacctcctaccccggccaattacaaaggtttacacatgttcatttaaaatctatggaaaataaagacagtataaagaagaaaataaacacaacctgtaaaaagcactatcaacattatggtatactgtttccctcactatcaaaatctattagatttccgaatcctttttcacctacgtgcaaaataataaaattgaatgaaatttaatcgatttggttccttgaacttggagaagagtttggataaataatacctatatagggccaggtgcagtggctcaagcctgtaatcccggcactttgggaggccaaggtgggtggatcatgaggtcaacagatggagaccatcctggtcaacacagtgaaaccccgtctctactaaaaatataaaaattagctgggcgtcgtggtacgcgcctgtagtcccagctactcatgagtctgaggcaggagaatcgcttgaacccgggaggcagaggttgcagtgagccaagattgtgccactgcattccagactggcaacagagcgagactctgccttaagaaaaaaaaaaaaaagaatacctatagcttactatgtagctctatgcagatgctgatggctagaaggctaaacaataaatagatattattgagaaaataatgtatttttacataacaagcctcatatttttcagtaggtaaggtcatttaggttagacaaaagaaagttttggcttctcttgccagtatctactttctcataatttctaagcgtgaacctatatattttttgatgtgatgttctgaaaataaatctaaggattaatgtcataaaatgcttctttgtaattatagcttagaagcacatatttaaaagatttaggctgggcacggtggctcatccctgtaatcccagcactttgggaggctaaggcgggtggatcacctgaggtcaggagtttgagacccgcctggtcaaaatggtgaaaccccatctctgctaaaaaaacaaaaattagtcgggtgtggtggcgcatgcctatagtcccacctacgcaggaggctgaggcaggagaatcgcttgaacctgggaggccgaggttgtagtgaggcgaaatcatgccactgcactctagcctgagcaacagagagagactctgtctcaaaaataaataaataaataaataaataaataaatagatctaaatgttgcactattcaaaatctaaagtcaaagctaattattttgtgcataacagaaatcagtattagctgttcaaacacacacacattttttattgttatgaccaaaaacaagatggcaggtgagcctcatctctgcactagcaaacaaactaattgtttgctttcttttgtaggcattaaagtttctttttgaattgcataaatgaacaagaaagctgggtccagtttcctagagagacatcattcaggacagaaataggctcatgagcacaggaaatctgtgagcacttgaacaaggacaggctactccagggaaaggacaatgtctctaccatgcttgctcatgtctgaccacagaaccaacatggatatttaaaagcagggagatcagggcaaagtaaaaggtaaccatttgtttataaaagaaaaatcatactacttgcgtatgtaatatatgcaaacccaaaacagcatgtctaggaatgccaagaatgaaaatctgaatttccctttaacaatatccattatttcacaatagaatcattattaacatctttctctatctctctttaataggtaaagctcaacgacatgcaatataacatgttaagaagtgtgtgatgtaataaccagactcttcagcagcagaaagcagagttccataagaatattactcttggcgggacttagtagaataatgtaagtccaagaatcttgaattatatacattgaaatgaggcagtatttctagaagatctgagaactagtacttttatacccccaaaataaagaggagcaccattcaaacactttttccatctatctatccatcatccagcacaaataattggaagagtatttgtgaaagttttcctcattcaagtaccattcagtgtaagctacctgtacgtctgaaccaccaatccctgaacgactgatccctgaagtgaaagcagcatgagtgtaaacatacctgccttggcaaaggtttgtatgcccccacctctaggtcacactttttcactgtacgcttggcatttagaatatcaatggatacgggtattttcaagaatgtaatgtgtcagttcctacctccacatagtccttggcatggccccaatctcgtttggcatccagatttcccaaactgaaacattccagttgtccaaggtaaatcttagctactgaccggctaatttttcgagtaacgaaattagctcctaaaaagaggcaaaagatgtagtatcagtcaagtgcacttgacacatttaacagtttggtgaaccaaacccgatttcggcctctgggcatttctttcattctacactcccagccaccctgttaaaacaataaaagaaaagaaaaagagaaaagatcattaactgtcatttagacaagttaagaagccctaattccatgtgtcacatcagctctactttcagaacaaacgtttttctttgggggacatcttaacattcctaatttgttgcttcaatatgcaacccaggcattaggccaaagaaaagctgttggaatgccagtttttaaacagaaaattcaaaagggttgtataaagggaaatgccagaatggacgacagacatctaagaccaccctgattttttttaagaacacaaacatcatatattcctattaataaagctactttgggactcatggggagagaaagaaacatagcttagttcacagggtaactagttaaaggaaacaagaaaggaatttatttaggctgcctttctcttaacaaaataagtggtgatggctcttatttagaaacctgcacagccatccaaatgatatgatatggcccctgggcaaaagtttctctgtactatacttaaggcaatgccactttccaaattcatttcagtgttatttacagaaagggctcctaaattttgtgtaatattttgaaatgattggttgaaaggggccatatcttgatgaaagcactgaaattgttttaatgttctctggtctttaatgaaaactctatctgctttttcaaagatcacaaagttaaaaggcacttctgagacagttttaccttgttatctaggtaaggttatgagaaaacaccatttaataccaaattctcaaggtaataatactcatattagctagttaataatggattcatacagtttagatatgtgaatatcatgatttatcacataccaatgactttaactatgttcttttgcagatgaagcagggaggcaaatattatgatcaaagtgtttggcttctggagagctggcacagggataaggggaatatttctaaataggttttccaaattttggcaagaacgtggcttagcgcaagttcaaacatacaccagattcacttactccacaaacttgatacgtacatttatacctacaccattatcattaagaaatacaatgggactaccgtggaaatccaaattttcaattccccttgtcaattcagatggtatgttaagaaatacaaagtttcaactttccacagaggtttatatagcacatagaggtccttcaaaaaaaagtgcctttcgaaatgaaaaactacttattagccagtaagtaattagtggctaattagtaattttaaaaatttttctattgacttgtaagaattaaatttaggttttttgatgtttatcattatttcaatgtcaggactatactattttctcaaagtatactaagaaaccaatgatggcaaactattaaatgaagattccaacataaaacatttcagattaacctgtttaccagtaaagtaatgtttgggagtccaatggaagtatttgaccctattcatacaatttattgattcttttacccagtgttgactacgcacccaccaatcactaagcactgagctaggcactggggatctgggagagaagcagcagcccctgctctcaggtatcacagagagggtcaggtgggccaataaaccagtgctgaacctagtaaaatgccaggtctgcaaggggggaaagcctttggggttgtagcatggctgccaggcgcaacgcacgtgagaaatgcctaccagaaatggagcttgaatggagtctaccagtgaggtcatgaagggactcatcaagctgtgagacagggtggtactccaggcaggaggaacggcacttgcaaagatgaggaagggcctttctcttccaactcttaccacaaccttatgatggttatggcacctccaatgagggctatcgctgatagcactgtgctgagctctttagatggggtaactcatttaattttccgagcaacccatgtgctaatattacccccattttgtacatgaagaagctgagattcagggaagctatataaattaactattctaaaacagcattcaaatcgagagctatatgactaccaagttcttatattaccagaactttcatgtcgtgctagaaaggtggatcttttcttatctggttcctaaagttatcttggataactagccaaaattaactataatttctaattcttttttttttttttttttgagatggagtctcactctgtcacccaggctggagtgcagtggcgcgatctcggctcactgcaagctccgcctcccgggttcacgccattctcctgcctcagcctcccgaaaagctgggactacaggtgcccgtcaccacgcccagctaattttttgtattttttagtagagacggggtttcaccgtgttagtcaggatggtctcgatctcctgacctcgtgatccacctgccttggcctccgaaagcactgggattacaggcatgagccaccgcgcccgctcaaaatgtaattttaactattatttagaacagctattttgagatataattcacatagcatacaattcattcatttaaagcatatgcttcaatggcttttcttatattcatagaaatgtacaaccatcatcacaatcaatttcagaacactttcatcatcccaaaaagaaaccctgtatcatttagcagtcactcaccagttttctcctagtaccctagccctggcatacagataatctaccttttatctctagatttgcctattctggacacttcctataaatggaattatattaatgtctggtctttgtttctggtttcttttagttagcataacattttcaaggttcatccatactgtagcttgaatcagtacattgttccttttttatggccaaataatattctattatatgtatataccaaattttatttaaccgtccacgagatgactatctgtggtgcctccatcctttgccttttgtgaataatgctaccatgagcgttcatgcctttttgtgaacgtatgctttaatttcttttaggtatatacctaggggtggaattgctgggtcatatgagaactctgttttaccaattgaggaactgtagacttttccaatgtggctgcaccactttacattcccaccagcagggtaacagggctctgatttcttcccattctccccagtacttgttatggtctgttaaactgtagtcatgctagttggcaccgagtggtatcttattgtggttccgatgtgtccttctcaataactaatcatatgaagcaactaccttttcatgtgcctactggccacttgtatatcaattttggagacatgtctattcagatcctttgtccatttttaaatcggattacttatctttttattatagagttgtaagaattctttatacattctggatccaagtcccttatcagctatataatttgcaaagattttctctcattctgtaggctgacttttcactttcttggttgtgctctctgaagcataaaagcttttttatcttttaattttgatgaagtccaatttgtctacattcgcttgtgtggcagatgcttttggtgtcatattcgagaaggcttcgttaatccaaggtcatgaagatttattcctatatatttttatgagttttatagtttttcttcttacatttgaatttttgatcaatttttagtaaatttttatatatggtgtgatgaaagggtctaacttcattcatttgcatgttgacatccagctgtctcagtattatttgttagaaaggttatttttcccattcaatagcattttcctcaaaaatcaattaattaatgaaaaatgtgggagacaatttctgactttcaattcgatttcattgatgtacttactctatgtctatccttatgacagtaccacacagtcctggttactgtagctctgtggcaagtttaaaaattaggaagtatgagttctccaactttgttcttttttaaggttattttagctattctctgtcccttgaatttccatatgaactttaggatcagcttgttgatttctgcaaaaacaccaacagggattctgaaagggatcatgttgaatctgtagatcaaaatggaggctatgcccatgctaacattattgtgccttccgatacatgaatataggatgtctttctcctttattttggtcttttaaaatttctttcaacaatgtttaatagttttcagagaataatttttacacttctgctaaatttgttcctaaacactttattcttttttattttattataaatacaattgttttcttgatttcaagaaaaagttttggattaattttaaacatttttgtaaccacatgttttactacttaattctcaagaaaggcttaaaatgattttttttttaaatttgctctcctcatttttactccatgttacagaagaatgctcttttaaggaagaaactatataaaagcatagaacatgagggctgagactatcccaagtgagaggtgaagaaagagaaacgcacagaggctgcacacctgtcctgagtcaggacaagtagccgagccggacccaggcctgtctcactggctttctagccttgtgctgttttgctaagccacagtgcaatgcaggaggaatctcttctgcgatgagatgacctaagtgtttgtgaattattatagcacatgtggataatggaacccctataattaacttaaatacatacttgatttataaagccttaaactataagattctcgttagaaagaggactaagaaaagttagctcaatgaatggagggaaagccagctctgttagtaaccagctgtgatatcttacacaaaccatttaaccactctgaagtcatagtctcctctgtgtactacttgcatattaacatttgccatgccaaatcactgggtacactaatgtaggttaaatggcatttcttacagaaatgtaagaacatcactatgtccttgtttgtaaaataaggatagtaatagtacctaaaagctttgatgtttaaaggagaaaatctaggttttctggttatcagtaagtactcagtaactgttagacattattataatgattacattacaatgttaatggtatctacaattaagtctcaatggaaagttaagatttcttagttcttttattaatagatgactacatctcttaattctctgattttgaaagtctgagattgaggaaaaatcaaaataaacagccaggcatgtgggcctacacaggaagcaataataaacatttcttgaatgactttggctttcaatattaactcattaacctaggaaagagagtatgcaagtaaaagtatatccataagaccgagaacaactaataaggtttttagcctaaacactcgttggattgagataatgagttttgccagcattgatagaatgagaacagaacttctgttcacgcaatgcagtagacaacaaaaactgccacattaaaaaccagtatatgctgggtaaaatattactattcctattttgttaaatacaaagctgagcctcaaagaaatgaaagaaaatccccaggtgaagggggatctccagagcacagatcatgggtgggcactgaggagtctgggctggaagtgaaaatggaaggccatctcatgccctggaaacaggttcagctttaatatctatctgtgacaaaggacaaaattttcagggtagattactagaaccgtgtctaacacactatgttagttatgcataattctgcttgctacttttgtcagtgctattatcttaagcaagtgttttaatttctcagttctcttaccaataaaatgggatcacaatccacactaagaataaaatatcatgctacaggaagcagtgaagcaaggctcaatgtgagcagtggcaagagggccagcaggcctgcatggaccctaaggcagtcgctgaaatggtgcattgagacttgaaggctaagactacttaagagtaaagctcactccttccatgaacctagggaaagtgaagcctgtgaattttaccagcagcagacaccaggcacagccagaagtgggactaatcccacctcctctgtggccacaaggcaagggaataatagctcagaccagcaagtcatcagctgagaccaggaggcattcagaatgtaccacaaacacctgaagacaccacctgccccttttccaacactaggtcaaataagccacatctacgtcccatatagcaccacacgccacaccacaacgtttaggtcaagcatggaccgcttatatgacaatggtcccgtaagattacaatagaggccaggcacagtggctcacgcctgtaatcccaacactttgggaggctgaggtgggcagatcaactgaggtcaggagtttgagaccagcctggccaacgtggtaaaacctcatctctactaaaaatacaaaaattagccaggtgtggtggtgcgagcatataatcctagctactcaggaggctgaggcacgaaaatcatttgaacctgggaggtggaggttgcagtgagctgagatcaccccactgcaatccagcctgaatgacagagtgagactctgtctcaaaaaaaaaaaaaaaaaaattacaatagagctgcccaatacaggcatatcttttgtcctttatatggtatttttactttaccttttctatgtttagatacaccaatacacattgtgttgcaactgcctacagtgttcagtaatctgctgtcccagtttgtagcctagcagcgataggtgtgcaggaagatataccatccaggcttgtggaacactctacgtctacaaccgtcacacaatgacactgcctaatgatgcatttctcagaacaaatccctgtggttccgtgacgcatgactgtaggtagatgccatcctgaacagaaacaagaaaagaaagcacgcctagaaaaaagcttcaacattctgttacattaatagcagacactgaactttcttttaaattttaatttgctgtttttgaaaaacaagtataaattaactgttaaggactatattagttcctagggctgccataacaaactcccacacactgggtggcttcgaacaaccaaaatttcctgtctcacagctctggaggcttgaaggttaatatccaacagggccatgctccttcgagaatatctacaggagaaccctgatgctgtctcagcatgtgatggcattccttggcttgtggtccaatctctgcccccatattcacaccatatgaatagtgctttctccaatgtgtgtctatgtctctggctcttctttttattatgtggacacttgtcattagatttagggcccaccttggtaatccaggatgatcccttcatctcaagatccttaactaattataactgcaaagacctcatttccaaataaggtcacatcaacaggttcagatattaggatgtggacatatctttctgggggctaccacccaacccactataagaacgaaggtttagaatatttgaggctaggtgcggtggctcatgcctataatcccagcacattgggaggtgggaggatcacttcagacgaggagtttgagatcagcctgggcaacatagcaagaccccttctctactaatttaaaagaaaaaaaaagggggatacttgaaatacatgataaaacatgagaggggcattgtttcctcacttaaacatcattttaagggtaactacattcctttcgtgagcataatagccaaatagggtctccatttgtagaagattaatttagaggtgataaagtaagtttcccctctgtttcagctctgcaagttttcctcagttaatttaaatagctccctgggtctccttcttcaggggaatatacatcttcttataatttcagactgaaaattctgtgtgaattcctgtgtctaccaatttcctttgtcatcattctttcttgcatctttcttgtggcataaattcccttcttaaaatgcatttttagaagttcccttaatgtggaaaaattaactagctcgtatttgaaagaagttttgctaagtgcacagttcaaggttgaaaattatcttctcttccatgctgacagtattttcccactgtcttctggtttgcagtttctgctaggaagaagtgtgtttccggtctaattgtcattcctttgtaggtaatgtaatgtctttttttctcctgttaatgtaaagatattcctgttttctttggtattctggggtttcactccaatgtgtctacgcatggctttctgcttggggtccatggtgcttcctgcatctgtgactctttaatcaagtctagaaatttctcagcaactatctctttagatattgcctcttttcactctattttcttctgggaaaggatattagactactacttttactttctactctcttaatttcttttttttggtaattttcatctctttgctcttatctgtaatagtctgggttaatttccgtatagccatctaattgtccttcagcaatctaatctaagtcggccatttaacccttccttcttcccttccttcctcccttctttcctcccctcccctcccctcccctcccctcctctctcctctcctctcctcttctcttctctctctctctctttcttttttggcacatccaaagttctctttggttctttttcaaacctgcctgggcatttttacattctgttcttgcttgcttattttttctgatttgacatctttatttacacatgtttttgtaattttatattctgaattagataattccagtatctgaagttttggggggacttatttattacttgttatttatgctgactttgactgatggtggtttctttccttgtgcatttagtgagagttcatgtttagtaaccttaatttgctggagaccagaggacatcaacgcaaatgacggcttcctcctgagacagtcactgtttgtttctcctgggggccaggagatactaacacctgggatgctcatccccttccagaatgcacaggttaacaaggttctgctcttccccttgactgctatctactgattaaagaggctgggtgttccctaaagacccaaggatatacatatacacacatgcatatatatatacacacacatatatatacacatatatacatatatatacatatatatacctatatacatatatatacacacacacacacacatatacacatacacacacacagagtccatgttaaagtttctattatattataaagcataccaacataacatctctatcttctataacaaacattaaaggaaaaaaactgacaaaatttggaaaacacactttaaattgccagcattaaactgaaaacaatggaattgcctttaagacatgaataatagccaatttattaaagaatttgattgcatattaggtcacaatcttttccacaatgtattacttcaatagagatttatttttaaaaacaaaatgcaaccttgggcgccctctgatgatgccgtagacgtaaggaagaaaccctatgggaggttcactaagtcctactagggacagttctacttaccacactacacaaaattacttctttttgacaccctctgatgatgccgtagacgtaaggaagaaaccctacaggaggttcactaagtcctactagggacaattctacttatcacactatacaaaattacttctttttcaaatgtatatttcctatggccctgtggcaatttttattgtttgtgtgtctacagatacacgattgtatatgtgcatgcatgcatgcatacatacatatctaaacattatccatccatatccaaatggtacttgaagtaaccaaaatttgtctaataaaaattctattccattgctcaatacttcatccaaaagcttttgatttaaagatttttttggagttagataaagtacaatgacagtttggacaatattcattggaaaacagaaatcattccaatttatcctgaaccccacatgaacctccgccttggggccctgcatttttcccctgtggtaatctctggccaccccactgtgaactgcctgggccatggctcagtggagacagggtgtggaaagaagagacactgagaaggtcatggctgactgagcagatgactgagatcagagagatcatacctcatttgctcactaagtcctgccaagagcaacactatttaactgcaggtactcaaaatccaataggcacgtttaaaggaatctcaggcttaaaagaggacaattcacaatgtgcatttgtctgagatagctaccaccttttggcaactatttaaaatatgtgtataaagagaaatgttcaaactactttgctatttgtatcaaatgttcaatgcattttccactgacagtgagataattcaaatttgtaagtcttcctttcaggttttctccagtttggtactattgacatttaaggaggaataagtcctttttattgctggttgtgctgtgctttgcagtgtttaggagcgtcactggcctttacccagtagatgccaggagcaccccctcaattatgttcacaggtgttgccaacttccccctggggggacaaaactgccctggttgagaaccatggccttagtcaaataaaacaaccccacaaagacaaaatccccaaaataaaaaaaaaaatgtatagcttttaagtacctctattcattcgatacactaacaaaactatcggggaactaataaacatgaaatatttaaatcaggatgagacaagggtgagtcttcatttaacactgcagtgaatctataagcctggccttccaacgagggtctaggctgagggcacacatttgggaactatttatgtatggatgatatttcaagtcctgaggccagctgagaccaccaagaaaggaatgttagcaacaaaacataaatggtcagagaaccaaatacactgatgctataatgtttacaggccagatgaggaggaagcagtgaggggaagcaaggacacgggagtatcctaacagtctggatagtctgtatccaggagggagtgatcaccatgactgcaggtcagaaggacaaagacagaaacgtgaccttgatgggagagcttctgaaagaggtggacaaaagtccaaggaaggagagggctcaagaaagaatgggggtgagatttcgtagacaaggagcacaaacagcttctgaaaacttctgctgtcagtgagagaaaggggtgagactgggaggactgcacttcaagatgggcatgaaagcagcctctttgcatgctgagggaaagatcctagtgatgacggagaaactgatccaggagagaggtgagaattgctgatgccaagtcttcaaggaggtggtagcagacaggagctccagacagacagctcctccagggcacaggagagcaggtagggagaacacaaacgcaggaaggcagagttcagatgttctgaggacttttcttcctgctcaaatcttaaacacacaccccatcctgactacacgactcaaccccgcctcgctcacctctcccactgtctctgctcctacgccgtgaactgagtcggagggagaaccttcgcacacctatgctgactgcgctctccagcgagagctaagctcgtgctgcctggtcatgatgacctgcaacttcctggtcggatcttcctcctgttcacctcaggagacattaccattaactctagttcgcttctccttttaccccaagctaacacaactttctggatggccctgcatggtgaatggtctcaccctgcacccagtagcccgggagtcctctttgattcctttctcactcttccattagtcaactgctcatcaagtccttctgagtctgtttcttcagcagtcctaaataattccccatcccagcctctagtaggccacaaatgaggtggctgctcaatgcagattccccaaagcatgctttggtgctctttcctacttcacatggttctaatgggagtagcctaaccctgccatcctgactgcactgatttattcaaggtaagatcctggcccaagctggcccaaagcaccactcactggctactgggactggttgagggagtggaaacctgaccaaggccctaccccaggccattccagatggagttgaaagagaaaacagttttcctccaagtggcaagactgaaaggggcagtgatcctagttctagtttcatagaaaaaactggactgaaaagatgaggccaagacagaaagaaaaatggagacagaagataaaaagggagaatcctgaagatatctgagttactggttccagctgtccctgaaatcggacgttcctgccattcccatacttgggtaacacccatacagcgctatcttcaattatttcacttaagcttagcgtgaggttcgctttttgccatttctaaagccagagtcctgatagacgcacaagcacaaactcagcgaataattccatctggcccaggcccttatcattttctttactggattgctgtcactgctaccaggtactctctttgccctgactctcttcctgctctgcacctgtcctgaaaactcatgacttccaaatgcaaatgcaaccacaagcctctttcttcaatggctataaactgcctatgggccggaagctcctgtgtgccctgtcaccggccccgtccccagcatctcctcctgccctgtccccctcacagctctctccagtgacatcctactgtgtgcagaccccccagcatgcacaggtgtcttctccttctctggacggccccttctctgagaaacatctgtatccacagctagttcccaactgcctggcactccaagtgtcatctcagtggaagggtttcctgactcctcccctggtgggggctgtccctcttctgtgctcctccatcacccttgcacaagctacctgctctcattacactccactgcaatcttcagtttactcacctcaactgtgagcttcttaaagacaagcattctattctgtctctctagtgtctcgccagtgtctaacacagtatataacacatgataggtgttcaatcaacattttctgcagggagagggaggggagcagggctattccacagtttaaacaggaaggtatctttacatttacacatgtaggacataatgaacctgattctcttattgcttctgccataattccagagtctcaggaatgattaaatgcttccactgatacatttatttttcaaggacttgcatactaataagaataaaggtaataccacagatgccagttcagaacaaagaaattatctggtcacactaggcagcttgtctctcttctgacacgtattagggttcttctctgccttcatgtttgtagggacctctgtatacacttttacctctataatcagagctgtagcaaatagaggagggatgtgagaaggataaaaactttctgttgtgacagagagagtatcaaattcaatatattcagtctatgtaagaatgaaaaacactggaacaatatagagatatgtatatcatcttctgaaatcaactcctttttgcagaaatgacttatttgcattaaaaatgacttatcccacatcgttccacatcatgtttgggctttacttcagaattgatagagctatttcacagaaggataatgttcatacttctgtttgaggacactcatactgaaacctcttggattacaatttctctttagctcccatctcgactcggaagtgtagtgacatttaagaagtaaggcagagccacttcctaaaatttcacactcagctgggcgttggggctcatgcctgtaatcccagcaccttgggaggccgaggcggacggatcacgagatcaggagttcgagaccatcctggctaacacagtgaaaccccgtctctactaaaaatacaaaaattagacaggcgtggtggcgggcgcctgtagtcccagctgctcgggaggctgaggcaggagaatggcgtgaatctgggaggcagagcttgcagtgagccgagatggcgccactgcacgctagcctgggcgacagagccagattgcgtctaaaaaaatatatatatattagccaggcgtggtggcgggcgcctgtagtcccagctactcgggaggctgaggcaggagaatggcgtgaacccaggaagcggagcttgcagtgagccgagatcgtgccactgcactccagcctgggtgacagagcgagactccgtctcaaaaaaaaaaaaaaaaaaaaaaaaatttcacgttcgaagtaacttaacaaaaatagtattggcttatagccacccagcataaagactgcaaagtaacgaaatcttcaaaagacctttgattcaaattcttgatctgatagaaaattgggacaagataaatgtccataaaatgatgcaatcatgtctccttccacaagaatcttagttggctctaatgacagtttctgttattctcttctgtcacagaaaagtaaatataggcaataccctgaaaacaaatacatacaaaagatacttattcacccaaggaaaataagtaacattgcctcctctgtaataactattgctaattattgatttggacttcaagcagtttttcaagaagggtcagactccaagaacaagcacaattagaaataaaggatgacttctaagaattgtgtgccagtcagaaaacactgtcttagttgtcgacatacaatataaagtaatactaaggaatgaaaaatgcaaggaagagaaattatggctttcttactagtgacttagcctctctgcttgaatcatatctataactttttgaggttctttataactgtggggttctcagccacaagcctaatgagatgaatgggcatgcaggaggcaatagcgtgcctctcaagctcaccagagcagcagcagagactgagcctgtgtggcaacaggagtgtggcccaaggtacactttctggaaattaggtaatgagcaaaaaaagcatttggtcagtactagatgagatgtttttaacacatactgacaacagaccataatacgcaaggagataaagtttcacacttttttttcttgtggttggttatagtcgggttggcttgaaatttagagtatgcacatacggttacagaggcccttgatagatttgcatgacagtaatgtctgtgaacccaatattcttcacgcctggggtcatggcctgcacccgtagatccagccactcgggaggctgaggcaggaagattgcttaagcctaggagttagatttcagcttgggaaacatcgtgaaaccctgttttctaaacaacaaacaccaccaacaaaaatccccaacattcttcaaatcactcaggaacaaatactgtgaagagaatcacagaaaagcggacttaacaaccatgtaaaacatgtaaactacaaataattctaaaaccgaaggtatctgtcattcagcagtatccctgacatggtattcccaggatagtgtctataaactaaacaccatgaaacagttttttttaaagttaatagactgagttacaagacagcttaacagtttagtcccagtttctatgtcacccatgtggcaaaatttcaggtgaaagatttgcttccatattttacttcatcacttccttttctcactaattaaatttagaatttagcaaacctaaaatgaaaaataaggaaaggaaagaagcaacaaaaagtcaaacaggaagaatggtcttgaggaaaaactagagggccaggaaaggcagctaatgtaactggaaaaatactcactggggcaatgaaatgtgatggaaggggcaggccaccaaaggagccgcacaaggtaatggacagtcacacagttccagggtcaaaccacatgagtccaaatcctatatccttcactactatgggaaagtaatttcacttctctaaactcctgtcaccttacctgtaaaatggatataactacaactacttcatcgttttattatggggattaaaagagatgagtgacagagcatctggcacatggtcagaactaaataagtgttacctgctatgctatcattatcattactaacatcactaacagtcccgtaagttgaaacttttcaaaattctaatatattagctcaagagcactttacacttctcaataagaatttgtgtttaaaaattccagtatcagatgcacttagaattcagccaaagaaagggggatatgctgaaaacatcaagcaggtacggaaggctttccaggaagtgatcacagggcatgctcagcccttggctgcagaaaaggaggagcgtgtgtcaggtacagcccctgcaccaagactcaaagtgaatgggcacaatagctaccagtgggcatgtgctggcagccctcctttgggcaggagtgccaagaagctctctaggcatgtttcacaaggagcactcaactattgcaatccccatcccccaaatctggctcagaaaagcgatttcattttaataaccatcaatcttaattaatatagcagaattcaatggtgtctagcgagttctgcacattttttggaaagaagtagatagatcatttttcgcatatggtatattagctcattttagtgctgggagtagaagagtagatgaacttcttttcctatattttcagttccctgtcttaatatttgcttcctatagggaaatatttccctgtgcttgcagatttatgaaacattcctcaatgtccagcactcccaattaaatgttctctgtgaacttgggaccacacagtcgtctgccagccagaatggggatatgctggtactaaggttctcaccaacctattttgtcttcctcaaaaaacatttatcagtgttcctctgagaaacaccttcatcctccttaaaacaaggtttatttcttatgtacaaattaactgttagggtcataagaggcactggggccagggttgagctctttcctgggtacctctaccaagccttctttacactgtgtgggcattagggcctcccttattcctctgatacaattgtgctgaaaacccacctttcttgctgccaggagggtttctctgtgaccgcactgatgttcacttccttacttgcataccctcatgggctggttatcctcacgtacatcctgctttagcagcctttcaggaatcttaaacttaccaacagaaatagaaggcagacgcaaaccttctgaaacataaaatctggcttaatctgggaattttttactctaggaatcattagagtttgtccacaccagaaacatctaataacaatatctgggaattagcccataaacaacagaagcaaagaccattattcttctagcatttaatattcaatatcccacaagttactttaccagatcttacctactttacttatcacttactaagctctgaaaccttaacttttttaacttgttcagagaaaacaaagtcatatgttcctttatgcattttcccctttattccttctgtttattaattttaagttgcgaggtggcacaaactgagcttacttctctaggtgggacattagcagcagtgatggtaataataatgacgtgctaataacttcacttccacgatttcctttaatgcttataacaaccttaagtgaacactatgattaccccattttagagatgagaaaactgagactcagagagattgagaaactggccagagttgttctagtatgtagtagaacctagactgagtccaagtagttgaacacttctatatccttacgtgaaccacttaaaaaggggaacaatattccataacaaatagtggaaaagaaagttttgactcaaactaaatttcaaaaacttaagaatgttattttgaagaaaaatttccacttacaattaacaaaatttaaattacaactgcatctatgtaatttttgttagtctagtcacaaagtaaagtaaggttttcttcttgtaattgacacaaccatatacatttcatgtaagatttttacaggaccattaaaaaaatacatgtatcacttaaaaaaatacttgaaaaaattagcctggtgtggtagtgtacacctgtcgacccagctgctcaggaggcaatggcaggaggatctctcgagcccaggagtccgaggctgcagtgaactatgatcaccgctgtactccagcctgagcactgtacaacacagtgaggctgtgtctctattaaaaaaaaaatacttgacagtttcactaattttcttaagaatctttcacacgtccttgatatttatccataagcctttcattcatcatcgtcttttcttgactttcctaattcaaatgttaactggtttacctgccaaaatctcgttttgaatggcttttcctgtgattccagcaattcttcaatactacttacattttatttttttgcaattcacgggtgtctcgccgaactactctgttttatctgtcaacaccactgaaagattcttggcttttggttcaggaccatcttctgttggctggcactgcagcgttcacatttctcactgtcctcttatgccagtagccacagcaatcccactaacagagctgcctccaacagggtctttcactttggaagggaaggagtaaaaaaactaattctctagctttcagcattgaaaatacaggaacagggaagaaaagagaaaggaaatatgaaataaatcttcaaaatctactatgcactgtattaatcttttccctgtaagttttccccatcaccttcacagtgagctgaaatgacagagctgcactttgctccatcaggtgggcgttattaacctctccatgtgcagatgcagaaactgagatctgagtaagtgacgtgcccaaatgcacacagctgatgatgagtggccaaattctctgtgtatatatactgcgtggctatattgcagggaactgtgctacatgtcatcagacagttatcagtttggtttcaaacataaatgtcacagacattacaaaacactgaaaaacaaccccttgaattcaatttaacaattccagaaatctcacctcaggagatgggagggatttcattttgtttggtggtaatcagcacctgcattagaccaagtattgcttcaaaagtcttttatgtttaagcaattacacctcatctctccacaaagaataacatgggccagacagctttgtgatcgccaagtgtacatgtcatctatgaagtatcatagtctacaaatgcaatggtaaaccagatgatgtcactttgtgccccaaccagaaaggctacccagaacctggtgggtccaagagtagcggccaacaatctaaccatttatggacagacaaatggtattgtgtaaaacctataatgctctactgaactccaacaggagattacttcatcccctgatttcacaatgggctgctaaaattttttgcaataaattaagtctctgatgctcatctacaaaagccacaaagcaccttttatagctagaaatacaaacaaaatattaaggtatttgctattggtttgcctgtttgatacttctacagtgcatgatttgaatttgccaaactggccaatattcagtaattttttaaagattattttatttagacatgttatatgtagtatttacacagagagaaagtgttttctgcctattgtgattaactgaaaacaagtcccagttacctaatttctatcatgcattatattattccctaaagcactaaaacatctatgaattctaatagttttaaaggaaaattctcatatgcagtgaacccttcacactaatattagtataatcctatgcattgaaagataatcttgaatcagttctaactgttgttttatatcaaagccagatcatggactctacaacttattctcaaatgaaaaatgtgttattcttataactaataacaaaaagtaaacatgttcattgattttggaggcttgggagggtcccaaacccatcttgacttggctcgtgaatcagtgggtcactgaggtgagggttcagcctccaatgattagaagagtcctgggtttgagttgggtctgacctgcagcagaccataatacttaaggccctggagctatttgaatccgaatgttttctttggtgttcacgtaaatgtttgctaaagttctatgaagaatttactgtaaagtgaaagtgatacctaaagaaaaatgagaccctactgttgttctatgaagaatttactgtaaagtaaaactgaagtgtaacgaaaaatgagatggcattcatctcatctgttacaggtggcattcacacagattctgcaagcacatttggaaggatgacatcctagggcagagtttcttatcctcaccaccatgaaccatctggacaggacaggcgtttgttatagagccatcccgtgcacaccactatgaaccatctggacaggacaggcgtttgttatagagccatcccgtgcactgtaggatgttcagcagcatccctggcctctacctaccagacaccaatagtagccccctcctccgttgggacaagaaaaatatctccagacactgccagacgtcctctggaggaaagagccactctctccccattccccacccctagttgagaaccactattctagagcattaatcttatctttacagcaacaaataaagacaatctttaaaaaacaaatcaaaaggaaaattaccccaaattttacttaaattttgacaagtaatttttacatgaattattttaaaaattctgaagattaatttataaagataaatacagtcagacattttataaagcaaagtacttggcagctaaaaaaatgctcaagacgaaaactcaaaaccacaagttcatgaaccttaaaaatgccagattctttcagtcaggtgaatactgtgtttagactgatgtatatgatttcttatgaagcccatatttaaaggaatgtcctatctcatctagaaatggctcagtatctaaacagtgctagtacaccatccatttgtggcaatctcacacggttaattatgggtatatttaaagtactttatagcttcccattgccacatgatttttaatgttttattttttattttgtggtagggatgaggtttcactatattgctcaggctggtctacaactcctggcctcaagttatcctcctgtcttagcctcccaaagtgctggaattacaagcatgaccaccatgcccggcctgatttttaatgtcttttatattagttcttcctattaccaacttcttgataacaggcaagagaagttatttatttcatatcacatttatattctaatattataaaactatgtttattgtaattatttctgtcaaacatcttaaaggaatattgcctttaagcaaactaatggtcttttacaaagataagagcagctgagacattccgtttccaacttgtccacttgcttcactgccaagctgaggtggcccactcagtgtcacaggggtttctttgctcaagttcaactctaaaattcgtatatatgttatttccacaaatatgtacaatatttacatgacttctcctaggattatttctggtctccgtgttagcatttattggcttcacgaccttggacaactcaatctcatgctgcttctgtttcctcattgctgaaaaaagggagatgaaagaagctttaaattcctatttcacaaattctgagggtattttgggagaatacctacaggtggatgttaactggctgctccctagaagctctttcaaggaaaaaatagtatctaatggcttaatacacatttttaaaattaaaaaatagagaaaaatagaagtacacatgaatttcatttccacatacagataaaaaatttgtaagttaaacaagttagtcaaaatgtctctgaaagtacctgtggagtattaaatcactatgtcaaacgcaacacgaagagctaatgagcgtgcatttttcacagtaaggatgatgatgatgatgatagccaaacccctctgattcctcagctgggagatgattaaaaaaagttcttcgtgactcagaatgaaatacaaaataaaccagctttctggaagtatttactaggatctcatgaaattctgaacagacagtttagcaacggaagcgctcctgggggaagaaggtagtgatggatctgttgcaaggccccatggtcagagacagaggagcaaagttacatatggcaagtagaagagaggctcagttaggcgttaggcaaatatggaaaggaagagaaaagaagatccacagggagagagaatgctttacccagactgagtaaatgtcccattcttaaacactgagagaagaaagagtgggaggagaatggaagaaatacgctgtcaacagggaacgtgatttcttactcaggctaaaggtatccagggatgaagccaatccctatgagtgactcacggctggtaaccaacggcccacgaggtaggctcatgtaaccaaacatcacctcctcagtcagtcctggaagtagaggttactacattgcccaaactttcctaatgatcgaaagactaaaatgagtcaacataagaaaaatatcctcatcgaaagacggaaatcttcaactgatctcctgcggaaagcaaagggctgctgggtatgagaggcaggcctgccaacagccggcagcacagaacaactttctccgtcacacccctgggtcagggctttctcctccaggacgtggaccctaggaagtctcacagaaaccgaggctgctgttcttagtgtaggaaatcaaagcggctaattctacactcatactgaaaactgaaaaatcacatttaaaaaaaaagaatgctgaatattatgtgtgtttcaccctttattcacaatagctactgtcatcaaaattaggaaatcagggataatctaatcattaaattttttaaccttccaaaagtagaaggtagaatgtattttttgttccctcttaattatcatgcaaaatgttttttcttaatttagaatacactcatattagtgttatttatagttttgtaaaggtcaccatatttgtatttatggcatgccaaagtactctgccaatgttaagaattaagacataattagccccaactggttacattacatatgtgatgaacagtagttattcttcttatttacctcctaatgtaataaacagtcaaaactagaaatattgttagctttactaaataggcttgcttcccatgttccaatttatagcataatctttaagagtagattttattactggtaaataacatatttgaaaagaaactaatatacttatttatgaactatttttaaataattaaaaaaacctctcaatattttccccatagttcacaacttatataataattaatatctttatgacaagtctgattgtttagtttttcaaagaaatgtaataaggcaagaaaatttttgtacatgtctatttcctcatagatattaaacagtttgagataataaacaaaacctttttccctagagagtctattctctattacagataatgtgaagctgtatttccagtagaaagctatcattatatccacatttgtggcaaaaagaatactgtatgtatgtaaatataaaaataaagatatgtaatggaacagccagggagatacacaatttcaggtttgaagaaacaatacaaaaggaaaaagcagtttattaagtgtgtaataatagtatgtttttaaaagccctgtacaaccttaactaaaaattactttatcactgaaaaccgttaatgaccatctgtgccttttgctggtagagggcttgcctcagtgtcgatggctgctaactgatcaggatggtggttgctaaaggctggagcggctgtggccatttcttacaataagacaacaatgaagtctgctgcaatcactgactcttcctttcaggaaagatttctctgtagcatccagtgctgtgtaacagcatttacccgcagtagaatttgtttcagaattggagtcaatctctcaaaccctgctgctgctttaacaactaaacctatgtagtattataaacccttcttttgttattttgacaacattcacagcatcttcaccaggaatagattccatcttaagaaaatacattctttgttgatccataagaagcagctcctcatcagtgaaaactttattatgagattgcacacgataaaagcagtcacatcttcagattctacttttaattctagctctcttgctatttcccccacatctgcaactacttcctccacttggaggccaatggagggctattaagtggcctaatttcaatattgttgtgtctcagggaacggggcggcggtggcagggggtggtaatggccagttggtggagcagccagaacacacacaatatttacggattaaattcactgtcttttatgggtgcagttcatggtgcctgaaaacaatcacaacagcaaaaccaaagatcactgatcacagatcaccgtaacagatataataataatcagaagtttgaaatattaggagaattctcaaaatgcgacacagagacaggaggtgaacacctgaaaaaatagtacctacagatttgcttaatgcagggttgccacacaccttcagtatgaaaagaagaaaaaagcaatatctacgaagcaataaaataacatatgcctaaactcgtgtatttaagtgtacccaaacagaaaaagtacagtaaaaatgtgactttttaattataatacagtatgataatcttatgggaccactgcagtccatcatttaccaaaatttgttatgcaggttatgattgcctacttttttattttaaaaaactgagtacatatgaaagaaagcacctggttaatgtctgtgaatatcagtatataatacatagtaatagttattcataaaacatatactactatatacattttcatgacttatagacatttaattctaaaattctgttattcttattaatttgtagtaaatattactaaagtgctcccatttcataagaagcaagtctatagcacaagtgccatccaccctcttgctttcaccaacggagtgactggaaggctgactgagggatgcaaagtcgcagattattggctctattccctaaatcagtgatttccaactgttgatctgatgctagcataggtgattcttacatctctagatgtattacacggttctcaaaacaaatatatttagaaagaaaacctaaataaataaatgaagtcttcaaaaaaaaaaaagaaaaagaaagaaaaccaaaaatggttgggatggagaaaagacacagaaggcagtcaaaaccgtaatgagcacgtgtccaagctcaggagttgtggttgttggacaaactatgctacatgtatatcatcagttactagcttatttggtttcatacatcactgacaactagctttcctttagagcacttggtcatagtgcttgatcctttggagcacttggttacctgcatacagcagtgaagtacaacagaaccccaacctgccaaagcacttcagaattctgcttaaggactggctcactatgctctttaacatttataggaaatctttctaaaagactaccttgctaccataggagaaacccacaatcaacccaagtgaaagttttctcgaatgttgaggatctgtctacagctggggccagcaaatgttttcttagaggcccagacaacaaatattttaggctctgcacactacaagactccatagatgaaagcagccatagatgatatataaacaagtgcatctgcctgtgttacaataaaactttattttcaaaactatgctggtaggccagatttggcccatgagtcctagattgtcaacttctggtttagcctattgttagattaaaaaatacttttccccacttttgaaagtcagaaattctcatgaaatgttattcatgcagtgagagggcacctttgacaattacactttgttagagaaaaagtatatggcccccaaaaactgcatcaacttgggctctacaaattcagcatgggtgactggatacctaggactagattgaggtttaccaaggtttttctacaccatgtagaaaaaaaagggtttgttccctgtaataacagggaacaagaagactgatgagtaaatgttcaaccaacttaagaaaataaactcacttaaagtaccacaggaaattctaggtttacaaagattattaacaaaaaacaaattttatctgtttattaatgtatatcagattgaatctttacttcaaaatcatttattagcttttttttttttgagatggagtctcgcactgtcgcctgggctggcacaatctcggctcattgcaacctctgcctcctgggttcacaccattctcctgcctcagcctcccgagtagctgggattacaggcacccaccaccacactcagctaattttttgtatttttagtagagacggggtttcaccatgttggccaggctggtctcaaactcctgaccttaagtgattcacctgcctcggcctcccaaagtgctggaattacaggcatgagccatcgcgcccggcccatttattagctttaattactatatgagtaaaatcaacaatatgtatatatttataaatatcgatataatttctacttttctgtaattcagaccacctagctttcaagtcagtaagctgttcctgaaacatgagatattaacttattcattcatttaaaaatatttactgaatgcttattagcaattaggcattgcctggaagctggagatgtatgaatacaacacagtcctgccattatggaattttcagtctgggaaagaaatctccttggaaaacaacattactgtcagattaatttaatctgaaaattaatgatcaagttttaagaaatgctgtaaatagtaggcattacatatcaaagtattaatatcattttcacgtacatctctttttctcattatttgatcatatagttaaaaatgtggtaccactgatttccaggcatataataaaacaaaacaaaatggtgtatgctacagttgaggtcaagttcctaaagagatttaatagaagcctgacgctgcagaacaatatgtagagcagaaccctctttgtatgtttaaagagagaacttttctgaaggaatgttaacagtgggtctgaggatagggctggcagttatcacgagggtgggaacttttactttaaaattttattttaaatgaagacgtgttacttttagaacattttttattactttaaaacaatttttttagagacaggggtctcactatgttgcccaggctagagtgcagtggcacaattataacccactgcagcctcgaactcctgggctcaaagaatcttcccaactcagcttcccgagtagctaggacttcaggcacccatgaccacacctggctgattcgttttttatttttttgagagacaggatcttactatgttgcccaggctggtcccaaactcctgggctcaagtgatcccccgaacttagcttcccagagttctgggattacagatgtggggcactgtgcctggccttaaaatatgtttttttttttttttttttagttagtggttaacatctacaaagacaaaaaataagttctcattaggaggtacacaaagagagaattagggggagttatattcaaatttatctttttttactttgcaacccaggaatgtttttccctatcctgacctgattcacaacaattaacttttattttttttttgcaggtggaaaagttgagggaggaagaacacagaaacccaaacaatgtgtatgaacatgtttgtgagaaagaggcagggattaccacgactgagcagactctgtgggcgccctcataccacatgctgcaggcaaccacagctaggatcttccttttcctttctcccttaccgctggcacccaggaccacaaaattcattaaagaaatgtttctcactgcttgtgaatttgttttcctttcaggcaatgtgatgacaggctaggttcttatgctttaacagcccatcatgggaatttttaacttaagcaattataaaataaaaatgtactgacgctaaagattcatttataaacctgtcgctttaatctttcttcatgacttgttggtgtaattaggcagctatatagtcacataaaatttcacggaaaaattatatgcttactagttgttggtcatgaaacaacttataacattggacttcacgtttattctcagactaaaaatctaaatgatagcgaaatttaataaaacttcttggaaggcttacagataatttttactttgtaaagcatgtgcatgctttgtaaagctttctcatgcttcagtaaatcagaagtaatgatgggggtacacattttcttacttaaaacttaatactgggaacaagagaactagcacgttgctacagtctcatcaacaactctgaaaaggcaacaagccaatacaaacaaatacagttttccaaaaatacctgataatacttctaaattaagagctgacttcaagggagtggggaataaggggagatttcttaaagaatataaaattatagctagacagacacattaaattctagtgttctgtggagtgctctatagtttatcatattaagtatttctcaattagctagaaaagaggtttttaaatgttcctaacacaaacatacaataaatgtctgaggtgacagatatgctaattactctgatttgatcactacacattgtttcaaaacattactatgtactccataaaaatgtgtcaattttttaaaatcttgttaaaaaactgatttcaactttattttaaaataatttagaagcatagtaatttctggacgtctatttaatgaaatgtaaagaaagaataccaaatatctaaccattcaaagtcaaaaaataacatagatcctacagattgagtctatttgaataggagtaatttctaaaaacaatcattagtttactacttattcctttgcattcatatagtagcttcctaatactcaggttgaaaacaagcttgataagatctactaattaaaatggtaaaactggaacactgtccagtttttaatgttaaaatttaaaatcccacaaactcaaaataaaattacaaaaaactaaggctgggtatacatttcttcatttgctgctctgacattcatcataattagatacagataggaaatttttcagtctctgtagtacatacaccaaatagacatgcaacttgttgttgttgttcaagtctgaaattctcttttcagttaatatatttactgacctcttctgggactctcatgattgaagagaatgccgttcactgcaaagagattatacgcctcacggaagttcaccacaatccaataggcatagagttttgctgcccctgttggaataattttttttaagcaatgaagtttgttgtaaaagacagtgattctcaccatcttcaacagtaacatcttggccgaaataataacttgtaatgcatccaaatacaaaaaagtatcaaaacccaaagacgaaataaaggttattacacctgtcaatcatgttcaccaggaaatattttaagaatttcttacttttgtaatgccaacagtgcattatttgacaatcgaattgattgaatctttcttagatctttttctctctcattctctctctctaacttttgaggaattagaatggaaaaaaatgaggatcttaacattccaactgctttgaaattttatcactgaagtctttcattaatattctccttacaaacatattagacacaatagtctttttttttgaaggttttgagctcaaggaaatttcatggaaaataaaaaaaaacatgaaaccttatcacttcagtataatctcataacagtttagaaaaagaatcacattgggtctgattttccatttcaagtgatctgtatggaagggctgaatgaacatgggttggtgaagtgaggtggtaatttcaccccgaaggcaatggcagcaaatacttgtagttagcaacgtataaaggtatgcttctcaacaagttcagtcactttagtctaccttaatgttaacctcacacccaaatgacttcagctgtgagacatgaacagaatgaaaggaaaaacacacaccccccacacccacagataacgccacacatgtgctccggtgtgcacgcatgttctcaccatagggtgaccggggatagaaaggggtggtctccttctggggtatttcctgcactttcccataaagttcacttgttgaggcttggtagaacttcacagagttgataaggccacaagtcttaactgcatctagaagtcgtagagtgccaactccgtcaacgtccgcagtgtactcagcgaggtcaaaggaaatctggaaaaagcaggcggagacagggctgcattaatagcttcatagcacaaaggtgctgtcagcaggaacaaagactacaatttcacacactgtgaaatgttggtgagaaaatattattttctaacagcacaataagaacgtggatgtcatctacatacagtatcaaattgctaaaaatatcttaattcctattaattacctatggtaatgtgaagaacactttaaccgcccttctactactcgtaattctaggctggagttcctagggcatgggttattatagggcaaaccctattcctcagaattatctgggatcttccttaaaaattcagtctgaaccaatctctttggggggtagggacctaggaaatttacatttttaatgagccccagttgatttttatgtacagagaagttttggaacatgtgctttagaacacagctgaatttaaaaagggttgttttattttctattctaaaggtacaataataaatttgtaatctattacacgaatgcataatctttttttaatttgagacacagagcatacagcaagatgctaatgtatatatgaaccaatttctaagcgaatgctgaggaataattcgatattttgcagttctttagagcactttttaaaaacaagtgtgactgatatgctttctgaaattattctatttatgcataatgaacaaaataatctaatattaagtcccctaaaataataaggctcaaaatctttgtcactggtttattcgtaggctaatatagctgggcacagtgcaaacaggcttcccctgctgcctcgtgaatcctcaactggaaaaacccctttgaggggtaaggtcactggtcttcgtcactgctgggtcctgcatgtgtgccctggagcagaagctgtcccctggcacatgcaaatggtattcaggcaactgctcaccagggaccctatttagaccactaaactcatgtcatttaggcctgtgagtaaaggtcatgtggctgccgggaaatcaaaagaaaaaaagtatgtttcatccacagtctttcaaaggtaagaaagcaaatttggaagtctgttatttttattcttttctaataacagttcattaagatataattcacacccataaaattcacccttttaacagtttacagttcagtggtttctagtacattcacagcagtagatgccatcatcaccatctaagcccagaacattttcatcaccccaaaaagaaactccgtacctagtactcagtacctcagaacctagtatcagcagccactctctggtccccaactctcactctgaccccaacagccctgtcactatatatttgcctactgtggatgtttcatacaaatggaatcatacaataggtggtttttagtgactggcttccttcgcttaccatgttttcactttggttgagtatatacctaggaatgtagttgctgggtcatacagtaacactatatttaacattttgaagaactaccagaccattttccaaaatgcctgcgtcatttcaccttctcaccatcaatgaacaagagttccaatttctccacatcctacatagacttgctgtggtcttttttgttatatccatcctagtggtgtgaagtgctatcttgttgtggtttttctttttcctaataaataatgttcagcatcttttcatatgcttatcagccatttgtatcttgtttttgtagaaatgtgtatttgaatccgttagccatttttaaattgggtcatttgttgagctgtaaaagtttatatatatatacatatgcatatacatacatatatatatattctgaatacaagtcccttatcaaatatatgacttgcaatctttcctcccattatcagggttgtctttttcttttcttttttttctttcttttttttttttttaagatggagtcttgctctgtcacccaggctggagtgcaatggcgcgatctggactcactgcaacctctgcctcccgggttcaagtgattttcctgcctcagcctcctgagtagctgggattacaggcatgcaccaccacgcccagctaatttttgtattcttagtagagacgtggtttcaccatgttgactagggtggtctcaaactcctgatctcatgatccacccacctcagcctcccaaagtgctggaattacagacatgagccaccacgcccagcctacttccttttttttttttaaagacagggtctcactatgttgcccaggctggagtgcagtggctattcacaggcataatcatagcaaactatagcctcaaaacctgctcaagtgattctcctacctcagcctcttgctgaatagctgggaatacaggcatgtggtacagtgctgggctaatgtcttttcacttcttacaggtgtcttatgaagcacagaagtcccatttatctactttttcttttgttgtgtgtgctttcaatgttatatctaagaatactttacttaacccaagatcaggaagatttactcctaatgttttattccaagagttttatagttttgtttcatgtacttaattctatgatccattttgagttaaattttgtgtatggttaggggtccaacttcattttttgcagatggatatctagttgtcccagcaccatttgttgaaaaggccagtttttccctgttgaatggtttttgcactgggtctttttgttatcaggaaaagccatggccttattttgaggaaacagtgcattgagaaggccttgggagagcgggtgtcagggctctgggaccactggtagtggccactgagcagatcactcaaccacttcccctggccgtagtttcctcaccacagcagggccacaactgtaatttatttgacactttacaattcaaaagtgcttttgttcaagctttgtaacaatcctaggagaaacagaaactaggtactgaggttcagaaagatggaggtgctaaaagccacactgcctaggagcagcagaaccaggactccaagtgagtccctggatgaggctcaccacaaaagcaggattcagccactccctccgtgagggtctcataaaagccagatgctctgaggagaaacacatacgcacacacagacacaaacaattgcctacgctttccagagatttgtggattgcagattaagaaaccttaaactagatctttctgaagatcttctctgacatcaagtgtctgtactcaaaatatttttaggtataagttcttatcccatggtatttgcagtctttttcaagggaccagtcaattttgaacaacaatgagaatgttgtgagttttttctctttccttgactagtttttcatttatagacatgccgcctaaacagctccaagaaggaatagctagtatttgttaagtactcagtaccagacacatgcatatcatcctaggcattttgcgagtatatattatttaatcctaagaacaggtaagtatttccactgacacagagaagctacagcaagtggtggcactaaatgttatattcgtggtgaacgttctatatacattgaatagattatatgtggatatgttacattcaccgtgaaccacacatccttgcataagcaccttaaccattagaacatagaataaggaagctgtacaacatgaaagttttcacttatgctagggaatccaatttagatcactaataggtcattattaatttttttattatactttaagttttggggtacatgtgcacagtgcgcaggttacatatgtatacatgtgccatgttggtgtgctgcacccagtaactcgtcatttagcattaggtatatctcctaaagctatccctccccctaccccacaacaggccccggtgtgtgatgttccccttcctgtgtccatgtgttctcattgttcaattgccacctatgaatgagaacatgtggtgtttggttttttgtccttgtaatagtttgctgagaatgatggtttccagcttcatccatgtccctacaaaggacatgaactcatcattttttatggctgcatagtattccatggtgtatatgtgccacattttcttaatccagtctatcgttgttccaggtctttgggttagttccaggtctttgctattgtgaatagtgctgcaataaacatatgtgtgcatgtgtctttatagcagcatgatttataatcctttgggtatatacccagtaatgggatggctgggtcaaatggtatttctagttctagatccctgaggaatcgcctagagcacataactcatggaaaagaattaagcactgttagactaaagatagtaaataagataggggagcatgggggaaaggatggttgtgtgtttgcagatttttaggtaactgcagagaaaattaagcatatgtgtttgatattcaacatgctacaggataagattagctgataaaatctaattggttacaaagtgttttacaatataaagtaacaaattaagtggtttccttaaaaaaagaaaatctgaacagtacattgtggctgatcaattcctaaagcttagaagtgttggccaggcacagtggctcacacctgtggtcccgacactttgggaggctgaggccagaggatcagttgagccccagagagcaagaccagcctgggaaacacagcaaggtcctatgtctacaaaaaaaattaaaagtaaaaaaaattagccggctgtggtggcacataccagtggtcccagctactcaagaggctgaagcagaaggattactcgaacccaggaggttgaggctccagtgagccatgatcatgacactgcactccagcctgggcaacagagcaagactgtctcaaaatgaaacgtaggttaaaaaaagaaagagagagagagagattatttttaagtaaaactaaaggttagaagtgtgattctgaaacacacgaaaacatggaaggtccagagagctacagcccacaggccaaatccgacctaccatctgcttttgtaattaagttttataggtcatagccctataaacattcatttgtttacaggtcttctatgcttgtttccacactatgacagcaggcttgaatagctgcaacagagttatttcccatgaagcagaaaatatttacgatctggacctttacagaagaagcttccaaacccccaaaactaaaccatagttataactgggagccaaaatgagtagggttttggttgtggttggtttctatcattatctttttctctatcttctcaatactatgggatgattatgaagtatgcatccaatcacaaagagagttgcattttcagaggcatgcagaccaagttaacagtaaaaatcttatttcacctaataaggagaacaaaaaatcagactgatgaaaaaaaaaaaaaaccaagcctacaaaatactgcccaaactcgctttcttgaaagattttcttcagtgggctcccacatcgcatattcttccaattttctttccactcgattggcatcaagtctccaggctctttcttgtgccagtgcctgcaggtctaccaggtcccctgcaccccgactctagccctgggctcagtgctgagggttttctccccgacccaccctccagctgtgtcatcactcagtccgaggtctcaattcaccatctgtccaaatgggcccaaaggcccacctccagggcacctcttggagcaacagcctctcatatgttcacatgtcacactgagatggccccaaacagggttcctgaagctgtctccaaagctcttctttcccatggcccctccctgtctgtaaatagcacccattccaagcaaaacctagaaatcttccctaacacttccttccctgcacagttcactgaaatttaaccagttcccaccacttagcccacaccttaatttagtctggcatcacctttcatgggaaccactgcaggaacctctaactagttcaatttgagtcctcccccacctggcaccctggcacttgacctcataacctaccacacttatcccccactacgacgatgcagcctctccggccaccctgctgtcctagtctggcgtcagctggtcctgcctggagccttcacgctgctgacccctctgtatgctgtgcccctcaccactgccctgcctccctcgctaaaaacatcccgtccttgccattctatccttatccacccgtctttatcctgcttcatttcacgttaactttaaacttttatctgtttacttatttatgatctatctccccaattaaaaggtaagctccatgagagctgggtttcatcttgttctccgcagtgtctcccatgccggaagcacgccttggcacagtatttgctgagtgaatgaagacagtgagtaaactaatgagaaatctaaatgtcaaatatacaaacatcaacacaaaaacacaaaaaccagtaggaaagaaaatgagctatgagaatgataaaacaagtttgataatttaatattactgaaataaaaggtaaaatttcaaagggcaagacagataaaactctctataaattccaaagctctagcataacaataacaatagttttcacagttacgctatataaagagtcagaactcagagtgcagaagaagaatcttagacatactcgaagtgcaggcaggaggagatagttaggaaaatgcgcaaagacactgcgatgggatatcattcttaaggcgcagtcagggcagcctcaggggcgagtagcaaagccagagaaatgagagaaagatttaaagtcataggaagcaggaaatttaagttcaaacataaagttaatttatcaacattcaaagatacaaacagatacccaaagaattgtccacatttatttgtgagtggtaaatcatagcctttcttaaaggaaacagaaaattagaattagtcctttaaatgggctgaaagggaccagatatagatgctgaaagttcacgtgtcaattctgtagtctacaaaatggaatgtaaatcccatgtgcttttaaagctgcatcagggaaggcctgagttcactgtgctagacctcacagcaaataaaacaaatgacaacaatcattccaggatcactgaagcccttttacccctccaaactcattataactaaatgttaattttataactatgtgaaactgaacagagatgaaagagggcatgctaaccaagtaggataagataaatgccactattcacatataatatattgactagtcataataatgacaaactatcacttatattagatgattacaagagaaaatacagtgtgtctgattagtggagtggttgtcatgtgttggtaactacagtgctcacaattttacatatttaaaatgaccaccaaaactgaatccttgaggtcagaaatgtcacacattgtgactctttttccaagaagcacagcaagtaacattccagctcctgaagccaggatctttgatgatcctgagacactgctgatcaggcactattctggaactctctgcaaggcccactcccctcttgcggggtttacagtgttccaattcctcgccttggtcctgagtctctcataatggactagctctcttcctcaaatggtagtctgggaggggtaaatttcaggttcagggagagaggcggctatagtcatcaggagtctagtgtgagtggtctgccaacactgacccactgcatctccctcatatttcctccccacatactgtactcttacttcaaaatattaatacaattaaagagcacacatttttaaaattctgaaatctactgaacgcaaaagctggggtaaatgaaaaagatcacaaacagcccctaccccactagactgtaaactctacagcagcagggcccttgactctgttcaccattaaatccccaagaatcatacagaggtaaaaatatatctgtaattttaaaacagaaagccacgtgaagagaaagttcatttatttataagaaattggcctggtgcggtggctcacacctgtaatcccagcactttgggaggccgaggcgggcggatcacgaggtcaggagatcaagaccatcctggctaacacggtgaaaccccatctctactaaaaatacaaaaaaattagctgggcatggtggcaggtgcctgtagtcccagctgcttgggaggctgaggcaggagaatggtgtgaacccgggaggcggcgcttgcagtgagctgagattgtgccactgcactccagcctgggtgacagagtgaggctccatctcaaaaaaaaaaaaaaaaaaaaaaaaaaaaagagaaagaaagaaaaaaagaaattagatgaaatatatatttatatatttaattatcctgtaaatgttaatagaactattatcttctaaagtgtaaatgaattaagggaaggtatttgaataacaattttagtaaggaaaaacatttcaaacacagcagaagagaagtccataacacattaatgagtaaggctgaacacattacaggcttttcagctgaaacaagaagaagaatatatgtaggaatgtgaagacaggcaaaattgcttgtaacatacgttgtttgcctcttcagtcccgtatggttcagtggggcggcctctaagttccaagtgatttgtcctttccagtttgacttcctcccatctcagagtctgggtgttgccctttccctctactcagaacattttccccagggttcactcctcccttccttcccccaagaggccttcctggacctggccatctctaccttcacctcatcctcccctggcgtgcttcacctcggagttctcagtccattggactctaagtacagagaaagcatcttcactggtttagtgagcttgtaagctccatgaggttaagggctctgtttgttttttctcattgctcccaccacttaaagaatacctgccacatggagagtactcaggaatattacttgaataaataagacaacattcagtctgaagtttaggcatataattccccaatgatttcagtacacaattaagaatggaacaaactttatatatggagcaaattccatttaaaaaatctcaatgaatgagccaaagtttcctgactacaaatgtggtgtcggaaaaagagatctgtctgcaaaagaactacatgtggtaaaagataaccagagaacaggaaatcttttcctctaacatttgatttcacagacacaagaggaggctcatgataccagtgagctggaaatgcctaagaccacacaagcagctgcactgtttactgcttctctgtaagtgaaagttattaatcaaggacagcaacaataaaaccttacgttccatcatgaaccagtttttcccagttagcagctcagcagagctgacattgacttagcagctggggccagatgcagatctttcccccgcccccgccccgctccagagctggataggagtcaggcaggtgcagacctagaagcactgcggctcagtgggcagggaaggaatggagagaaggcgctacccgaccaggagcaggccgcaggctgtgattccaggaaatccaaaggcgacagagacagggccttgccttgccctcctgtagcctgtagcctgccttatgggtgtcgagtagacagaggtttgaagaggctacaaaagggaggccacagggattaagaaaggcatcctgagatggttacaaagtgtggggtgggaggatagagatccaaaggagggacagatgacatggacagatcaaagtagggtccgcaggcacagggaggggaacaacacacactgggacctgtcagggaggtggaaggagggagagcatcaggataaatagctaatccatgcagggcttaatacctaggtgatgggatgataggtgcagccaaccagcatggcacgtgtttacctgtgtaacatacctgcatgtcctacacacgtatcccagacttaaagagaaaaagtagggtccatgggggtgggcaggggtgggggatagggactgggggagtgggggtttggaaaggtgaggatgagacattctaaagggggcagtgatcatcagcatgagcaaaaggagagataaatgcaccggcaatgtttggggaataaagtgctatatttatgtaatgtaagtagaagctattctggagcaaattatatatgccagtctatagtttgttcagtgggcactggggagccagcagtggctctggagcagaggacagcatcactttatctgggccctttcaccagtgctatactcccagcctcttctatttgcctccagcccagcccaaggcccagctctatagttcagaaactattcttcctcacactcataaccccaattttgtatgatttttccttattctgttgcaattatatttttcttcaaaaatgtttataattacaatttggaacatcatacagtcacagggttgttactccagagtgacaaatgctaaccagactaaacaaatgtgacatctttgtttgcctttgtatgctcaaggcatattaaggtatagttccactagagttttgaaatgctcaaagtagactaagggctctcacagggaatcagaacactgattacacatgacaaggtaacaatccccaaacgcaccctgctcccagtgactctgatgagaggcaaggctgcacacactgcttctgtctgtccgtccactctccacactgtgggggccatggctttccatctctcacccctactgcttagcacacaggagggctggaaaatatttgttgaaataatggtattgatttttgtcatgtgtttacattttagccacagaggcgaattggagctctcacaagtcagagtagaaagcatatgcagggctctgttctcacagcaccctccagctcttgctttttttctaaggactcagccactgctctggaagactgaccgtgctttaacaacctcaccaagtctgccagctcttctgacttactccaaaacgaagaacagctgccccagcaacattccttgagtttgagaatcttcatttctaaaatgttgagttctgcaccccgcaccctgacttcagttataactccgtggtcacaattctttgccacttccacaacctctgagaacctctggtgccattcctgaaagcctttcattctttttcaattaaaaaatatataattttaaaataaattctaatttgttctaattagttaaaattatttaaaacaaatattaaactaagtctcctgggtttttgttttttttttttttttagaaaatcttaatttaaaaatactttgtgaccccaattatcagaaattagccatattagatgccttttctctgtcattttacagtttatcagctgctgataaatacagaaaaatctgtcatgatttctgtataagaaaatggcaccagaagtaactatccgggtcttttctagagaaaaactcactgagattctttacagataaacagaaataacaaatcaacttacttaatggaatttattatagcaggaatacttaaccaaggattcacagggtccatggataaaactcaggagagcacacagatttggattaaaaaattttaaaatgcatgtctttattttcactaaattctatctgaaatttagagttcccttctattttgaatgtaagccacaatcctcagtagtaatagtacttgtgacctttccatcaatagggacaacagccatttcaacacgactatacagtcgccgcagatgcctggaggcatcacttctgcccatcactgcttaagttccaatgtttaccaggcccactgccaggtcttgtgctataatcacaaacctggtttttaagtatattaacagattaagagtcagtttccttggcaattctacacatttggttttatacctctaaaaacattattctgagaatatccatacacttcaccagattgctgaaggagtccatggcgtaagaaaggttaaaacgtcccctgtaaatcaagtggtagtgacaaaatttcagtattttagaatgtgcttaaagaaaaaaagtcactaaatctctcttaccacctatatccagccagataaataagctctcatcagccattttgaaatctgcacgtgtgtgacctaaaagcatcattgctacataaccaattgctcaatggtttgggtcattcaataggttcctgacctcaatgacaaagctccaaaagtacataaatacactaaggcattaacatgacactagagatgtacacacaatcaaaaattaaacaattacattagcttttgaatgcattttgtaatgtttataactttaatctgagttattttgatcatatatctaccaagatgagttaacatccccaagctctgttggcagagagtgatagcacaggagtgaataaagggactgattatatgaggggtatttagccaatggcctgtacccctggggattaaaaatcaggggattaaaaatatttgttggaagataatcaagagataaatagaagatttaatgtttgctgccagttaccacccagattatagtaatttggggacaaataatgaaaagtcacttcagctgcatataaagagactgaaacacagtaaacaacatacagtcttcattattataatattattataaagttttactttccttttatgaatactataattacatttaaaatggtcactactataacattaaagtaggaagagagcaataaccttggcatctaaatagctaataattctttagttaatagataaaatgacagaacaacaacaaaaaaaagagaacttactgaaatgcttcaatgactgagacgccacaacatggcctgtggttacaacaatgtaagtctcaactatccatatgggagagttcatttaagacaagaagtagagctaaggcttctaggcaggacaaataactcagtgttgggagccttcaatcccactggcaagtggtatatccaagtctttgtaagtcacaaaacaagagaggccaaagcaacatcatattatgtggataataagctgttttccctccttcctcacctcgatttctcttgacctctctcctccaaaaatagcagatagtaaattaattttagaaggaatattaaaaaaaaaaaacctaagctgtgagagaaatgtaaaagagcctttttaaaataagtaagccctcatgagatacctacatgtttcactagaaacattttattgaaagacttggaaaggagggccagaagctcaaaaccaacaagaactgtgtgatacactggcaagcaaaaggaaaatgggaaaaggtgcctttaacaaaatggagtaaaattaaaataatgctcaagaaagaacagagtggggttcaagcacagaaatgcaaaataaataagaacagcaaccagatacagagagaaggctgctagagaagtaggcacaggagggatgcagaggtccgggaaaggaacagccacacgttttctctctatttgctgtggaagacacaaggcaggttccaagtctcaaactgatgtttgagacaggcaggtaggaacactggtaaatatcaaggagcctcttgatctaacagacaaactaaaatgtcgacaaattgctaagaatgactggcattcaagaagtcaggagtgatactgtagaactacatgcactatgatgaaaatgccaacagattactaatgcccataaaaaggtaaccaatgggctgggcacggtggctcatgcctgcaatcccagcactttgggaggccgaggcgggcagatcacctgaggtcaggagttcaagaccagcctggccaacatggtgaaatcccgtctctattaaaaaaaaaagaaaaaaaaattagccaggcacgatggtgggcgcctgtaatcctagctacttgggaggctgaggcaggagaattgcttgaacccaggaggcagaggttgcagtgagctgagattatgccactgcactccagcctgggcaacagagtgagactctgtctcaaaaaaaaaacaaaacaaaacagggtaaccaatggtcacactgcagatgaactcaaactgccaggatattgttagatatcattttcatagtgaaaaatctagcaacgtctatggcagcacaccacataaaggaataaagataatcccatggcagaaagtaaagtggctttgtgagaatcaataccgcctcacgatttttacaaaattctttaagggataaataagcatatgggcaaggaagaatgagggggaaacccatggacataattcacctagactgtcataggccttgacaaatactgtaacaaagtgcatttcagaaagcagtaacactgactctgggactgggagaatgttccagctcccagtcaccaacagcagactctgctgcatctccagcacctcccaccccactataatcaggaaacttcggacagaaaactaaaagtaggagtaaaacatacaagctgaaaaagcaaaatatacaaagtagatcctgtcaatggccagtttagagattattcttacttaatgttttaaaaacaatctaggaaagggaatacactatgaaaatctcctaaggctctaatgtttttccagaaaagtagaaagtcacattaggaataggaaactgcaagatctcttggggctacctaaaggacttgaaaaatgggaagaacattcaaattggaccatttgaagacaatgcatttcaaacaggaggggaacaaagaaaactgtacccatagtctcagagtactgaatatcctcagtttcctaaagacaccaggctttggtttgacactaacaagccaagaaaatgtagtctcaacaaagaataagcagagtagaaagcagagtccctctgcagaagcctgaggttcctgcacccctaggaggctgtgaagtcctggtaaccacactttgagatggtcacctggaactcgaaaaatatctacacaactcaagaaaaatgttccaggaaatacagtggctagtatatgaagaatgtcaccaaaaaaattagacttctttggcttgtgaactctaggtcaggaagtagtacaatgatttaggctttgtaaaataataaagaatatggatagagatcatagatcagcccattatgagtccagaagacctgaatgagggtatactctttgtttaagtctgattaaattaatagaaaagaaggttgtcttcaactgaccaatatttgaagaacaatgtgcttattctgctccatttggaggaggccaatctcttgagaagcaaatcatacatacataaaaccatgaattttagaggcaaatttaataacaggaactacctctgtcttgttcaccagtatgtgcctaacccagtgcctggcacataacgggaacacagcaatgtttcttgagggaatgaatgaataggagcagggtgttccaatatcatccaatatggcaaagatcctcagagaagacagtatttccaaaaggcttcttcctctgtagatgcctttttctaaattccatgtttaagcttctaatggagaataatttcaataataacaatgatgtaacaaacctgatataagcatatgattaggaaattcagcaacagatactataagaggaaaaaattaatgataatagtatactggtattaatacttctggtattaatgtttagtagtattaaacattactttaaaactagcatctttctaatagaaacaaaaggtattcaccacatagtttccaaaatggaaaaacatgaatgctgtgttttcaactttttcatatttaaattgctgtgcaatacagtatttagattttatgggaaaacacaccctacactgaacaggagatatatcttattttcttttgaatattgctcatgattattctactacaacgcaggtcaatgtctgtttccttgggatctgcgggctgatgagaaacaagcaaagcacctgaagacaagaggctggaagagaatgatgcctgtacctatggtactgtaggaaagcagaggaattgagaaatagaaattagttcaaagtaaaggggaaaaaaatcactatccaagttggagttcagcaaaagaatcacaaagcagaggaagaaaaatactaatttgctatgaaaagtaattccattgggtaagtgaaaagatgcttgtgtatgtatgaatgatgaatgagaaacaagaagaaattgacatagaaagttacttatgacaattaactaaaaatccatattttgccaataaccaacaggcaaataaatgagcctctctaagcctcagcttctttctcctaaataccataccctgactcttctatggaattcaggatgccacacaagtatctagcaaacataaatttgaagttcagaagaagcaaggaaaaccaacattcaatgttcaattcaaaatagccagtgagggagaggcaccaattagaagcagctgcagtccatggcactcatggagaggagtgaaaggggtgagtgaatacagcacccttagctgaaatacctaggttatcgcattggaacggactaggaaaacaactcaacccatggagaatgaagaaaagcagggtggggcaatggcccacctaggggcatcatggaggcaagggaacccccacccccagccaagggaagtgatgagtgattgtgtgacactgggaaagcatgcttctcccacagatctttgcaacccacggatcaggagatcccctcgtgagcccatgctaccagggccttgagtctgacacacagagctgtgtggagtcttggcagaacagctgctcaggcacagacacagacccagaagctttacatactccagccccaggatatccagcaaatatgtctacagctcaggcaaggcaagaggtctgcacataccctaggaaaggggctgaatccagggaaccaggcagcatcattctgcgggccccacttccactgcacttcacaagataagacctactgtcttggaattccagctggccaccagcaacagagtggagactgcctgagaccagacggagcccacggagagaggggcaggctgccacctggattgctggataactcagctgttccaacctgcgggctttggagagtccaaagggtcccaacgaggaagggtccccccagcagtgaaccaaagcagctttgtcagttaaaggccagactgctactttaggcaggacatcaatccattcctcctcactggacgggacctacctggtgggcccaccagccatgcccaagcgcatgtattagggacagagctctgatgtctccctgggatggagtgcctggaagaggaaagggccaccacctgggttggttggataactcagccattccagcctgccagctttggagagtcctagccgactgaggcaaagggggttccccaccatgaaggctgttttgtagaggtgtggccagactgcttctttaagcaggactccgttatactcctccttgtggggcgggtcctcccagctggggcctccagccaccccctcccaccccatgttctttggggcctaaagagctctaatttcaccctggggcagagcgcctgagtggtggggcaggtcatcaccttgcctgtttgggctgcctgtgggccatggagagcccaaaccaatcaggggctgaagggatccccaacacagcatagctgctctaccaaaaagcagccagattgtttttttaagtgggtctctgatcttgttcctcctgagtgggtgtgacttccaaccagggtctccagccacctcctccaggtgcgttcaggccagcaataggtcagtacccttgtgggatgaagcttccagaggaaggggcaagctgccatctttgctatatcacagccttcactggtgataggtactggaaaaactgaggcaactagggtctggagtggccagactattaaaaacaaacaaacatacaaacacaaaacaacaaaaacaaaaccacaagaactccatccaaaggtcagcaactcatttgtaaataagcccacaaagatgagaaaaaaaatcaacacaaaaactctgaaaactcaataatctggagtgccccttttcctccaaatgactgcagtaactccagcaagggctcagaactgggttgaggatgagatggctgaaataacagaaggagacttcagaatgtgggtaataatgaactttgctgagctaagggagcatgttgtaacccaaagcgaagaagctaaaacaatacatatgggagctgacagccaaaatagccagtctagaggaacagaaccaacctgatagagctaagctaaaaaacatgctacaagaactttacaatgcaatcacaaatattaacagcagaatagaccaagtggagaaaagaatcttagagcttgaagactgtctttctgaaataagacaggcaaaaaagaatagagaaaaaagaatgaaaagaaataaacaaaacctctgagaaatatgggattatgtaaagagaatgaatctacaactgactgggatacttgaacaatatggggagaatggaaccaagttggaaaatatacttcaggttatcatctaggagaacttcctcagcctagcaagataggccaacattcaaattcaggaaatgcagagaatccctgtgaaatacttcataagaagatgatccccaagacacataatcatcagattctccaaggtcgaaataaaagaaaaaatgttgagggcagccagagagaaaggccagatcacctacaaagggaagcacgtcagactaacagcagacctctcagtggaaaccctaccagctggaagagattggtggccaatattcaacattcttaaagaaaagaatttcctatctagaatttcatatctgtccaaactaagcttcataagtgaaggagatttaagatccttttcagacaaacaaatgctgagaaaattggtcaccaccagacctgtcttgcaagagctcctgaaggaagcactaaatatgaaaaggaaaacctgttaccagtcactacaaagacatactgaagtacacagaccagtgacactatgaagtaaccacataaacaagtctgcacaataaccagctagtatcatgacaggatttaatccacacataacaatactaaccttaaatgtaaatgggctaaatgctccaattaaaagacacagaatggcaagctggataaaaaaacaagacccattggtatgctgtgttcaagagactcatctcacatgcaaggacacacataggctcaaaataaagaaatgaaagaaaagttaccaagcaaatggaaaacagaaaaaagcaggggttgcaatcctagtttctgacaaaacagactttaaaccaacaaagattaaaaaaaaaaaagacaaagaagggcatacataatggtaaagggctcaattcaacaagaagagctaactgtcttacatatacaaacactcaataaaaaagcactgccaagttcataaagcaagttcttagagaccttcaaaaaaagacttagactcccaacaataatagtgggagactttaacactccactgataatattagacagatcatcaaaacagaaaattaaccaagatattttggacctgaactcagctctggatcaagaggatctgatagatatttacagaactgtccacccagaaacattcttctcatagccacgtgagacttactctaaaattaatcacataatcagaggaaaaacactcctcaggaaatgtaaaagaactgaaatcataacagtttctcagactacagcccaatcaaattagaactcaagactaataaactcactcaaaactacacaactattaatacatggaaattgaacacctgctccttaatgactcttggataaataatgaaatgaagacagaaatcaagaagttctttgaaactaatcagaacaaagagacaacataccacaatctctgggacacggctaaagctgtgttaaaagaaaaattcatagcactaaatgcccacatcaaaaagctagaaagatctcaaattaacaacctaacatcagaattaatagaactagagaaccaagagcaaacaaaccccaaagctagcagaagacaagaaataaccaagatcagagctgaactaaagaagacagagacatgaaaaaacctgcaaaaaaaaaaaattcaggctggtttttggaaaaaaattaataaaatagactgctagctagactaatcaagaagaaaagagagaagattcaaataaacacaatcagaaatgataagggggatatcaccactgttcccacagaaatacaagcaaccatcaaagaatactacaaacacctataagcacataaactagaaaatctacaagaaatggataaattcctggacacatacactctcccaagactgaaccaggaagcaactgaatccctgaatagaccaataatgagtctgaaattgaggaggtcaaaccaaagaaagcccaggaccagatagattcacagttgaattctaccagaggtacaaagaggagctggtaccatttttactgaaactattccaaaaaattgaggatgagggactccttcctaactcattctatgaaaccagcatcatgctgacaccaaaacctagcagaggtacaacaaaaaaaagaaaaacttcaggccaatatccttgatgaacatcagtgcaaaaatcctcaaccaaatactggcaaaccgaatctggcagcacatcagaaagtttatccactacaatcaagttggcttcatgcccaggatgcaaggttggtttaacatacacaaatcaataaatgtgattcatcacataaacagaactaaagacacaaaacacatgattatctcaatagatgagaaaaggccttccataaaattcaacatcccctcatgtaaaaactctcagtaaactaggtattaacagaaaatactttggccaggtgcggtggctcacacctgtaatccaggcactttgggaggctgaggcgggtggatcacctgaggtcaggagtcccaagaccagcctggctgacatggtgaaaccccatctctactaaaaatacaaaaattagccaggcgtggtggtaggtgtctgtaatcctagctacttggtaggctgaggcaggagaatcacttgaatctgggaggcagaggttgcagtgaatatgataaactcacagccattatcatactgaatgagcaaaagctggaagcattccccttgaaaaccagcacaagacaaggatgccctctctcaccactcctattcaacatatattggaagttctggccaggacaatcaggcaagggaaagaaatataaggtattcaaacaggaagagatgaaatcaaactatctttgtttgcagatgacatgatcctgtatctagaaaaccccattgtctcagcccaaaaacttctgaagttgataagcaactttggccaagtctcaggatcactgtgcaaaaactactagcattcctgtacaccaaccacacgcaggctgagagcaaaatcatgaatgaactcccattcacaattgccacaaaaaaaataaaatacccaggaatacagctaacaagggaagtaaaggaccccttcaaggagaactacaaaccactgctcaaagaaatcagagatgacaaaaacaaatggaaaaacatcaaatgctcatggataggaagaatcaatatcatgaaaatggccacattgcccaaagcaatttatatattcaatgctattcccattaaactaccattgacattcttaatggaattagaaaaagactactttaaaattcatatggaaccaaaaaaagattccaaacagccaagacaatgttaagcaaaaagaacaaaactggaggcatcatgctacctgaattcaaactacactacaaggctacagtaatcaaaacagcatggtactggtataagaacagacacatagaccaatgaaacagaatagagaacccaaaaatgagaccgcacacccacaaccaactgatctttgacaaacctgacaaaaacaagcaatggggaaaggattccttagttaataaatggtgatgagagaacttgctagccgtatgcagaaaactgaaactggattccttccttacaccatatacaaacatcaactcaacacggactaaagacttaaatgtaaaacccaaaactaaaaaatccctagaagaaaatctaggcaataccattcaggacataggcacaggtaaagatttcatgaccaaggcaccaaaagcaattgcaacaaaagcaaaagttgagaaattgtatctaattaaacagaagagcttctgtacagcaaaagaaacgatcaacagagtaaacagacaacctacagaatggaaaaaaatttttccaatctatccatctgacaaaggtctaacatccatcatccattaggaacttaaatctacaagaaaaaaataaaccattaaaaagtgggcaaagaacatgaacagacatttctctaaagaagacacacatgtggccaacaagcatttgaaaaaaaagctcaacatcactgatcattagaaaaatgcaaatcaaaaccacaatgagataccatctcatgccagtccaaaaggctatttaaaatgtcaaaaaacaacagatgctggcaaggttgtggagaaaaagaaatggttttacactgttggttggagtgtaaattagttcaaccattgtggaagacagtgtggtaattcctcaaagacccagaggcagaaataccattttatccagcaatcccattactgggtatacattcaaaagaatataaatcattctattatgaagatacatgcatgcgtatgttcagtgcagcactattcatattagtaaaggcatggaatcaacctaaatgctcatcaatgatagactgaattaaaaaatgtggtacatatacaccatgggatactatgcagccatgaaaaggaatgagataatgtcctttgtgggacatggatggagctggaagccattatcttcagcaaactaacagaacagaacagaaaaccaaatactgtgtgttctcacttataagtgggaggtgaatgatgagaacatatggacacactgcagggactaacacacactggggcctgtcagagggtggagaatgagaggagggagagcatcgggaagaatagctaatgaattctgggcttaatacctagatgatgagatgatctctgcagacaaccaccatggcatatgtttacatatgtaacaaacctgcacatcctgcacatgtacctctgaacttaaaataaaagttagaaatccccgcccccgcctccaaaaacaagagaaatagccagtgagtaatctaatgagaggtataattaagaaacagggctggccctgagggtgaaaacaagacatctgggcatcactgaatatccaggccagtacactacagctgctcctagtgaccctaatgtcctttataaatctacccccttaacaccttggatctctcatgactcattggcctataggcaaaattcttcaaacaggtttcctggtctctatctggcatttctacaatccatcctccatgctaccaaaattatctttctaaattgtaaaacctactcaggtcacacccttctaaagtataatggctcccagagctttcgggtgaagttcaacagcttagcttaaataattccagtaggccacaattcccactgctgccactctctgtacagcaatgatgaaattttaaattagaaaattaaaaaggcatgactgggtaggaatggcccaaaacaacacaaagctactgaaaaacaaagcagaaagtaaggctgaagctgcaagtctgttgggagttcaaggcaaaggtgggatttcagcccccatgagtaacagggtaacagctaaaagcacctagtgaagagggaattcagtcaggcttgttgcttaaaatccaatgcagaggcagaattttccagcccatgaaaaaaagatcaaagaagttgtttcttttttatttaacataaagttaagtgtctaaaaaaagaggcacatggcaacagacaaagctttacacaagggtctgctccagatgcctgctggcttttccactgaacagagctgttagatttccaatatcagagctggatgaagctctatgccaccaatatagaactagttctggaccagagcatcctagaggctgaatggtggcagccacacaaccattaaccatacgggataagaatacaagaggggtaggggtcctattcaatacaggcttgcaaaccgatttttttttaaaaagaacattaatgtcaagaaagaaccaataagaactatttaatgtaactgaagagaacatttactacagagaacatgaaaataagatagcattctgaaaatgactttgaaacatctctctttaacaatgacttttaaatatatcttaaaccaagaaaaaaaatcagctaaaaacaagaaagcatttttataagcaggctaaaatgaaacaacagatttgaaaaggaatcaaaattctggaaataaaacattcaaacaacaaaactaaaaatatagaaaggtgcaagcctttggaaaatacacctagaaaactcatagcaagaacagacaccacaagaagacacacaggcagaaaacatcccagttcagtgaaaagagggagcaagagaagggtgattggtgaccacacaaggaagaggcgggctactaaaaccgagatcttcaagaactgaaaggtggcagaagtttactggtcttaaaatctagcttagaggaaaatgggcaagtcagaatttgcccctggcactagtggtatttgggaaatggttcatttccataatacaagaaccactttatttttccacagcttcaagatgcacaaaccttagcttggtacactggcatatttatgaccctttgaaaaatggatgacctagaaaactagtgagggaccataattttaagtttcaacatttcttttactcaaaataacattgctttccttgaagatttattttaataagacaaggtcttgaatcacaggtaatctgtaaacgtgttcttaaaaacaaatgagaaaaggagcttcccaggggagttttctaaagtcaggtgagatgttacctgctttccctacctcaaattactcttgcttctttccaggttaactatccagggaagtaccagtgccgtctggacaagtataatacgaaaacagtgtgcttccctcaatgctggaggctgatacgtggtacaacggcagggaaaaaactgataaggcttctaaacttaccatcaacaaagacccagaacttgcatctgtgaattccctatgaaacctagtctttcactaccttaaagagggcagaaaatatattaagaattaaatacctaagaaagttgtcttaagtttctaagaatgtggtgctacattatcacaaagctgtattaatagctaatcttcagacttctctgtgaaggcagactttacataatcaaacactacagtatgaaaatgaaaggagggctgtaggagtgatctcaggagaccctgagaatcatgatgactccaaacctctgtcacaaagctttaagcatgccattagttttgcttatctctccactcattgctattaatttaatggtctggggagctgtcagggatatttggtaagagcaatttctcttccaggataatctccagcccattattcaaaatttttttagctttaagctacacagaatgagagtaagggggctgggtagggaagggaggtaagaaggatggtaaataagctaagaagcaagagacaacattttttcaaaggagatattgtaaacactattctctttatttcacactgcaaaagcacaataaaccagtagttgagccagaagaggttttgttgtttgaggcaacgttgtaccctctgtgatgagtgacatggtagtgctctgtgagtttgcttacacaagccagagccagctgtgctagaagcttccctactacacagaagttaggggcagaaaagggacttgagaaaccaccagagaacattagtatgaagatgtaaaaagatagcccattcatattttccttatttgtgtcaagggaaaaaagactgagtctaaatgtgggaaaggaatttttaaaaccttttttcaactttttttttcttcctttctatttatatacatacatttaaaacacactcgaagtttaaaatctactgaaaattgctgtgtctctcaattggtatggaattttctctcattttactcttttcagtttttgcttaagacacattgagtatttgcaaaactatcacttgacagtcgtatttttgttcattcaacaaatatttatagcgcaacacctaaggccctggaactgttctaggcaccaggacacaatcgtgaagggaacaagcaaaaatccctgccttttagagcttacattctagtgagaggagaagaaaactgacaatataaagaggtgaaatatatagtaagttcaatagtgataagaactatgggggaaaaaagctggaaagggagaggacgttgggttgtacttttaaatatggtaaagcttttctaagcaaaagaatgaaacataaaaatggaaatgtagtaggcactgaagaagcagttgtagtctacttcatagtaatttaagtttgaaatttgccatgtgccaggcactaggccaagtgctttacatgcactctgccatttaagtattatgacaagtctgtgagtcagggactactattatatttattttacctctcgaaaaaaaactaaagctcagagcaattaaggagcttgcttatggtcacagttagtaagcaacagaactgggattaacaccaaggaaaaaataataacataaggaaaacaaccaaaccaccaacaacacatacacatacatgcatatgcacagcccccatatgcattctttactattttctataacatatactattttctttaactacaagctagatacagaattggtagcctaattttctgtgcaatttaacaccaagatgatgcttcactttttctaaaaacaaggtggttgtgatttagaatcaggttgcctctaagagtatattttcatgatggtttttcataattcagagtatattttctcttagatacaatatagtaaatagtggcttaacttcatataagcctacgtgattcaggctgaagctaaataaatatacaagttaaaaaaaaaaaagaatgtgataatatatcctccctgcaactgtaccccttctccagcccaatcccaccctcatctcctccctttgggatgaaagagctccttcttggcggtgggggcgaggggggctccaaacccagggtgctccagagtgtgctccaatttgggctccctatccagctcaccccaactgcacgttcttcccggtagaataaccctccatgtgaattttggaacatgcatgccatctgtaataatgccatgtcctgtgtatttaacaagaaagaattattttgaactgtagaaacaggcaatcagggcctgataggcttaagtattgtcaatgtttaaaaacaatatttaaaaacagtgtttttaaaaaataacaaaagaaaataaatcaatattttaaaatgagaagtggattttgaaatattttgaatgtttgttagctagctttgagagatgaataggatatagataaatggtttggaaaaaaacacaggtgagaaccaaaaaaaaaaagcttaagaaaaccccaggttgatctgggcaagctgcacttgtcaagagttatgccgggagcagtgagcagtaagagcagaaaggctggccctcttggattacagaggacttccaagagtcagcaaggactcagagctgcagggggcatgagcccatgctcattttttcttacagtaatgatcctgacaatgggaacggagaacgttgacacaagtttattccacatgacagaactggcatagtggaaggtcatgggggtatgggaatttaggaaagtcctacaagttacaatctggtggttaatgcaatactttccaagacatttaaggccaagaaaagaagtagatagggctaagtactttagaatccgagagctaagaaatgggcatactcttggtgtgaggaagagaagcagagagttggtaaaaaggctgttaatggaagagaaggttacatgtgcaaattcctacatcagaacagctaggctggtatgtggtcaaggtcagggaaaaaagagagagagataaagagtttgctctgaggggagagggtaaccctgagatccccaaagaagaaaggctaagaaaggctttgtgttcacatgttcatattttcacccagcgtgacacttcacatttaaattcaagaggcagaaaattcactctgcagatttgtaaggaaaaatccaaaagactttgtttaatctttgaaacgcaaaaaagctctgagtacctagaacactgtgggcactagatgactaactcctcctagggtcccctgccacaacaaaccaagactggtacactcccttccaaacactcctctctgatgctacccctcggcctgaccctcatctggagattcacaatcacactcctggctagctgctctctgtgacccctgtccagcctggccctgccttccctggtctggagcacatccaatgtgaggggctgaagatacgcccttggggccaggcccagctctactttttagcaggagtgcaattttggacatggtactgaaccttttagtactttggtttcttcatatgtagaagatggatacaaatattattcaccctacaaggcaactgtgaagattttccacgtaggtgcttaagaaatgttagccataggctgggcgcaatggctcacgcctgtaatcccagcactttgggaggccaaggcgggtggatcatgaggtcaggagatcgagaccatcttggctaatacagtgaaaccccgtctctactaaaaatataaaaaattagccaggcatggtggcacgtgcctgtagtcccagctacccaggagactgaggcaggagaatcgcttgaacccgggaggcggagtttgcagtgagccgagatggcaccactgcactccagcctgggagacagagcgagactgtctcaaaagaaaaagaaagaaagaaagaaatgttagccagcgccaccaccaccaccatcccatcctaacaagtccctgtccctttggccttccactgtgacctcttaaagccacattctggtgtaaaggaaattctccattgacttcaccttctgctcagatgttgtctccactttctttcagtaatctggctggttctctgttgatcagtcaattaacctgtattcttactaatacatagtggaacataccccctgacaaatgtcaaccccttatcaattgtttctgttttattctttttttgttgagacagggtctcttgtcacctaggctccagtgcagtgacacaacctcggctcattctaatctccgcctcccaggctaaagcaatcctcccaccttagcctccagagtagctgggactacaggcgcagatcagcacacccagctaattttttttttttttgggggggtagaggcagggtttcaccatgttgctgcccaagttggtctcgaactcctgggttcaagtgatccttccatcttggcctcccaaagtgctgagattacaggcataagcctccgtgcccggccaactgtttgtttttccttctactctaactctctggctgccaaaaaatgggtgttaagtgggcattatcaacttgtggatgttaatattagtaaggatgttgtaatattagtcagtatagtgttcagtcatgtcacatatttttaattagctcccttttgggttctctacccctcctctcaatgttcctaccccttcctattcctcttattctccagcagactatccccttacctcacccagaaaacagacaagtcactggagtgtaagttttctcaaatgctgtacttggataactccaccagtcttcccttctttctgcctcttagtgggagagatgtccctattcctttccaggaccaatcttctcccaggccccgactcccaggctcttccacagctccggcattttcaacttcttcttctggtctcatataagtgctcaagggcccccctaaaaagctccatctcctttcccgcacctggcctactccccacatcgtcacccaccccacttcacttcattgtcaaacaccttagaaagaacagcctgcttggctgcttcccttctttaccaccagtaaccgctggtctcctgtgaccaggctcttaggagggtggccaatgataggcttgactgccaagtccaataccctttctaggactatgtgctcctgactttcctgagtgttgacttctctctctccccaggactttgatcacttcattttgcccaaattctcctctgatccctatggttgttctttctctgttttctttactggcttttctggatccagggcttcgttcatgttgcctagtgtgggattgaacagtgtccccccagaaaagacatgtgtaagtcctaatccctggcaactcagaatgtgatctcatttgtaattagagtacctgccgatgtaatttgataagatgaagtcatacaggggtagggttggcacacagtccaccgtgactggtgtccttgtgaggagagaagacacagacacaaagacacagggagatgtcgtgtgatgatgaggacagatcggagttacgcagctccacggcaaggaaggccaaatcgctgcaaatccctagatgcgaggaagaggcatggaaggagtcccccacctgcttcaaagggagcacagccctgctgacaccttagttttggacattagcctccagaatggtgagacaataaatgccttttgtttaagccacacagtgtgtgggcctttgttagggcagctgtacctgagcatatattctgagtttctgagtattccccaaggggtatttctagcccagtacccccgctgagctccagactcacactacacaacgaattggcccttaactgggcactctgcgagcctctccatctcaccctgtctaaaatctcctcactaacctggtgatctctctggccttcgctgttcatggccaccacctcacctgaagcaaggctggtgatcatccactcctccctccccttcttcaggctaacctcaggtcttctctgctccactgccattttcccaggccaatcctcttgcctattcacccacatcagcgtccaggctgttcctcaacacaccaggcatgttcccgacctaggggctttgcagcacctgttcctactgcctaaaatgtttcccctagaaatctgcatggctaccacccccaactttactcagcttttcactcaaatgttgccttccacatgaggtctctgtgacccatgcccacactgcctccgccctagcactcccaatccttggcctacaggattcatcatcttctaaaagaatatataacttgctggcctgttggcttatttactcagtattactgtcttcagtcatgaatgtactccccaccagggcttaccttgttccccaacaggtcccaaacactgagggccagtgcctggcaaagagaagctgctctttactttcctgctgagtgtgttgatctacaggagatgaacaggcttcctctggtattccaatgaccagctctgtcccaaccaacacatcccctgcacttcccacaaaaagcacagtgacatttcaataggactatatttgaaatagtttatgaatgaaaagaaagaactattaaagggaaaatgatgcagcaccacagatgtgagtagatcgtccagctgcttttcctacagaataaatactagattctctcgggaacgctcacagtgctctgtcacctggatgcagtcccatctcctctcccttgccccagccttgcccagcccacactgcactgtatatccagtccaccaaacttctcttccttctcggagggtatgggtattctcgcttctatgctggctcgtggttttgttagtttcattgctgccttagtcatgtgggggaattcctgaccaattcatccttctttttaatccctcaatcctgaattaggtaacttttcctctatcactttcaacattacattatcagctgcaatagaagaccctacacttctgacttgtggactcctgagagcaaggtctgtgattattccacatgtgtatggacaacacctctgcagagggcctggcagctgctagatgctcaataaacctctgccgaaggcagctgctaaaagaaaaaagaaaatcttactacggaaagtaaaagatgatcctcaggcaagaaacaaaaaagtgcgacggaagctctgtttctatctcttcagggccgtgcttcattattatttcctcattctccaattcctcacaaagctctattttataaatgtttgcagagctttaagttaatcctaacatttactctccagccctcaatctttaatgactccttctctaaaaaaaaaaaaggcagaaaaagtaaagatttatataagttcaaaagaaacttaaaaatccagacaaagacttatcatcagccacgtatggaatgtgagtggattcttgcctaaaaagctagctctagctgcaaatttcctatattctcccagtgccacgggacggtgatgagaggtctcccactccatggggctctgcccacctctgctcacccactccacacctcccaccacacttttctagtgcttgaaggaagtgaagacagtagcctttaacatgttccattacagcaactgctttggtgtagtgacttacaaggaagcctgcaaaggaggcatttaagaactggttttataagttcatagaatagttaagaatctgaataattttcttattccttgtatttgtacttagatgtggctcccaagataaagtcacattgtctcctttattttcttgttctttttatgctaaaaaacatttagaatattttatcaacaaaacacacagacacaaacccctttccaattctctcaaccaaaacaaatatacaatcatgatagaaagttagtatgtgaaagtagaaggctacactcttaggtgatattaacatcactcctgaaactaattcttagtatttcagttttcccatgagggaaatgatatgctatattccataatttgcaagcttttaattttcacaaagcatcaagaaggcaggccataaataacccttcagcaaacatttatgaaccatttactcaggccaggcactgtgctgagtttgggaacagaaagataaatgaggcgcaaactttgtcattgaggaacccatgatatatctgggtctcatagatgcaaagcaataataacattaaaatctgtttactgcacaatcagaagtatgggcatatggtacgcagagaaaaaggactttagcaagtatgtgtatatatgctctgggagcctggggcctccagaaggaggtggcattaagctgagtttcactggataggttgggaggaagggcacacaggggatacatggcctgcaaagacacaacatagtcccacttttaagaagaaaaactgataactcacatttatttctcctacttaaaaaagtcatatggaaatcactaaagcaatataaaattaagaaaaatatcaatagcagctctaggaaacagaaaagggaacacccaacaaaggaaaaactaaagaacttttttgaacactataaagcatgtatgattggatcacacaaaaataatccatgcttagttagcatcaacacaacacagaggcagtaaccttatacgaaggcaccttacaaacccctaaaaacctgcaagccgtaagcagcaacctggctgtacaccacagccagggagaaatggggcagcagaaactgaggggccaccatggcaatgcctggagaacacggctcaccatgtaattgggagggtaggtgttgtgccacagatcgtttacagtggggtacaagggaggaccacagtgacagagagggaatgggaagaccagtcttgcaccacacctccaggtctactcctctgctagctacagctctgactggacacaggctgcctgtgaccccagccctaaccagtgcacgggctctaccaaaaagagtaaggaagaaggagaagatgggaagcaaaccaacacacttagggattctatcaaaaactccaatagagagtggctgtccacagtattccatccctgtgttgtctcagagagaacatcaacaacaacaaaatcaactccatccgcactaacatttccatgggtacctgcgttaggtttactagagatcctgcacttagggagataaacacatgaagcatttaatcttccaccactgcccccagctgcactgtcaaatactctttctcctaagaagaaccttcaaccacatgcaggcagatccaagacattcctggttactttctgacatcaccactctaatgcaagccagtcctatggctcagggcacgtggcttgggaagggccaggctctccactgactgggaagagaagctgaacctggttctgggaacacctccctctttctggtcctgcttaactgcctgaggttacatttccttctttttggtgatctctacttctttgtttaacaatgcccagctgggtcgctaggtggcaaatagacacatgctaactcaagcatgctttgctgaagttggatctgcaaaagcctgggggtggaggggaaggctataccactgcacagttccctgagggagggagaaacatggctttgggatagcctcttcttttcttttctttctttccttcttttcttcttctccttcttccttctccttctccttcctcctccttcctccttcctcttcttcctccttcctcttccttcctccttcctctttctcattcttctataactatggtaccaagggacagcctcttctcacacactccctgcccccaacaactgcttcaagcacagccaacaacaccacagcttacagtgtccagctgctggggtttcctcactgggagtgcatcttctgggtagtgtacctttttaagagacagggggtggctattccactgctgtcctttctctctgccctgccatttctcttcccattctcttcttccctgctttagtagactacctctattagaactaagctcatgtaacagtgatagaaaagctagagaagtttaaataagatgaaggtttatttctctttcacttacataagtctgctggtagacaggaagggctagcgtagtatcctaacaattactagggacgttatttttttctatatatttctccactctctgcatcatatggcttccaactcttggtacaaaatggttggcagaattcctgccatcacatgcaccttcccatcaagaggattatttcccttctactttatggattcttctaggaagctgcacacatcatttctacctaaaagtgatttcttagaagggggtcacatgaccacacctaggtataaggggagctaaaaaatgtagttcttcatgtctgaggacatgtactcagacaaaaattgagaattccactactcagaagagaaaaacagaaattgacagacaaccaacagtgttttccatactacctaaacagatttccaactaaggagtaagaccctagtctttttttttgtttttaaagcaccatcgaattttccaagtaagtcttctgatgcccacctcacttagcttggtgagaggagggaacggccatggtatttcctagtgggctgatgattctcagccccctccttctactcaatgtgctctgacagccaggcagaggaagggatggggtaaagagggaaggtgctggcagatagcaaagttggttctgataactgcttcttaagacctgaggaaggaataggtctcagttattgatggttttcttgagaaagtgaagactggctgggcacggtggctcatgcctgtaatcacagcactttgggaggccaaggtgggcaaatcacgaggtcaggagacggaaaccatcctggccaacatggtgaaacaccatctctactaaaaatacaaaaattagccaggcgtggtggcacacgcctgtagtcccagctactcaggaggctgaggcaggagatttgtttgaacctgggaggcggaggctgtagtgagctgagatcgcgccactgcactccagcctgggagacagagtgagactctgtctcaaaaaaaaaaaaaaaaaaaagatgtgaggacttcacatcacatctctaagacctctgctttggacagaaatcatcagtgtgcagaaaactcctcctcaacccctgtggtggcttcctaaagggatcatgattcttgtctgttcccaggaaatacacctggaagggaaggccaacttttggcctgtggaccctagtgaggttcatctccactggccaatttggtgagcagagacccctgggagacagcaaacagagacttccacaagtgcatcgaggggcacctgccaactacccacattgatcagtttatacctctctataaaaacaagcaggctatgaagggtcaatgaacactggaagaagaccaaaaatgggataggagccaagctgagtaggcaggggaaacggcctttcctctgtatcttctgggaaatgcaaagatactgcctctcagaggcagtacaagaagcctatgaagaaggaagagcaaatgagtaccaagaaagagctccaggaaatgaaaaaccagttacttagggaagctactcactggagaccttaggcaaacaaataaacatcggggaagatcaaatcttgatttagaaaatgatctgaaagtgaccttccagaatgtaaaggaaaaataatgaaagaacaaatgagaaacataaatgtcatatccaggagttatcatagctgtgaaaacaattgaatgaaagagaaagaatcatcaacctaacgaaaaacttccaagaggataaacagcccatgaaataccagataagaatattgacagatcatctacgcacaaactcctggtagagtttctaaataaaataataaaaagaaagtcactatgagctccctagtaagaaataaggaaaggaaggaaaaggagggaagaaaagaagaggaagaaagggacagggaaggcaattctaaatgctaaaaagtatagagcaataattacacaaatctgaggaaaaggattataaccccagaatggaaacaaaatattaacagtcagcccttcgtatccataggttcagcagctgcagattcaatcaaccacaattcaaaatattcagaaaaaaattttaataacatacaagaataaaaagtattactttttaaaactacagtgtaccaattatttacatagcatttataatgtattaggtattataagttatctaagacgatttgaaaaatacagcaggatgtatatatgctgtttgcaaatatcacatcattttacataagcaacttgggcatccatggattttggtatccaagaaggctcctggaagcaatcccccatggatgccaagggacagctgtattaagcataaaaataaaggaaaactgttttttttaaaacaaaaagactcagaaattatacaaccaatgcaagatattacttgggaaatacttcagccaaaaaagtacaaatagataagacatgcaacaagcaataagtaataaagataataattctaattatcccaaaccattttaaataatgcagataataggccaggtgcggtggctcacgcctgtaatcccagcactttgggaggccaaggcggccatatcatgaggtcaggaaatcgagaccagcctggccaacatggtgaaaccccgtctctactaaaaatacaaaaattagcagggcgtggtggtgcatgcctgtaattccagctacttgggaggctgaggcaggagaatcgcttgaaccagggagttggaggctgcagtgagccgagactgcaccactgtactacagcctggtgacagagcgagactctgtctcaaaaaaaaaaaaaaaaaaaactgcagataatgaattaactgcaattgttcagaaagatattaaaagatgtaaaaacaagctgatctagtatttaaaatataagttatttctacaaaacctagaatttcaggtagaagatggcagactagcttaaaagtttgcacaagatttcctttgatccttggcaaggatacagtggcatgaagattttgctacagtcttggaatttacaagttcaaatattctaatgaggaacaaccaacaaaatatagttggactcaactggaggtagaatatagttttaaaaaaattagatccattagagacatcagaaacataaaaaaaaataaaatgagaacataaattttaaaaacaaacaaaaatgaatgacaggaattaggacaagggtaatatgctgtgaaagataaggaaatctcctctcccaattttgctagatgatattactcccctttcttaaaaacatagttaacactgacattcttatctgttgccatagttcacacagctgtttggtcttacttttcaaaaataccagttttattgagacataacgatatatataatatatatattatatacatattatatattattatatataatatataatatgtatattatatatatattatatatatattttatatatatatattatatatatatattttttatatatatatatatctatatctttttttttttttttttgagatggagtctcattctgtcgcccaggctggagtgcagtggcatgatctcagctcactgcaagctccacttcccaggttcacgccattctcctgcctcagcctccccaagtagctgggactacaggcgcccgccaccatgcccggctaattttttgtatttttggtagagatggggtttcaccgtgttagccaggatggtctccatctcctgaccttgtgatccacccgccttggcctcccaaaatgctgggattacaggcgtgagccaccactcccggacagtatttactatattaactggtttctacaactatcaccatagtccatttcagagcattttaatcattccaaaagaaactatgtattcattagcagtcacctccccaacccctgtcccttcaaccctccccaatccctaaaacccactcaactattttatgtctctattacctattttggacatttcatgtaaatgtggtcttttgtaagctacctctttcgattagcataatatttttaaggttcatctatattggagcatgtatcactactttattaccttaaaaagaaactgtcaatctcacttgtgtatgaagtctctttttttgttttagtggttctttgagagacagggtctcgctcttttgctcaggttgaagtgcagtggcacaatcatagcttactgcagcctggaactcatgggctcaagtggttctcccaccttagcctcccaagtaactggaactataggcatacaccaccatgcccagccttcattcctttctaagaaatactattcctttgtatacccaatgtataatacatttgtttatccattaaccagccgatggacattcggattgtttctatattttagctgctatgagtagcactgctataaacattcttgtttaagtttttgtgtggacctatgctttcatttctcttgggtagagtagaattgctagatcatcaagtggtagttctacggttaacaatgtgaagaactacagactgtttgcagaagtggctacactaatttacattttcatcagtagtgtacgagatttccaattctctaatttcttcaccaacacctgttatgatctgacttttgattccactcatcataatagatatggactggtatttcattatggttttgatttgcatttccctaatgactaatgatgtcaagcatcttttcacatgcttattggtcatttgtaaatcttttttggagaaatgtttactcagttcctttgcccactttttaattgggttgtctttttattactgagttgtaagagtttttagatattctaaatctctatcccttatcagatacatgatttgcaaatagtttctctcattctgtgggttgccattctctttcttcatggtatcttttgaaacacaaaggtttctaatttttttcttttaagagttttatgcttttagctcttacattaggtttttgaaactgatgcactgattttaaaaaccatatgaaatagcaaaggatccagaataaccagaaaaagaacaaagttggaggactcacacttcctaaattccaaacttataatacaagcaacagtaataaagaaagtgctgtactggcataagaatagatgcacaaatcaatggactagaaacatgagtccagaaaaaaacccatgtgtctaggatcgactgatttcgacaagagttgctaggaccattcagtgggaaagagtagtcttttcaacaaatggtgcacggacaactggagagctacatgtaaaagaatgaagtttgcccttacttcatagcatatataaaacttaactcaaatggatctaagacctaaatgtagcagtctcagttttatatttaaatacattcactatttgccaccaattccttttactgtggctttactattccaattttattttgcttcatcaatttgctggctgaattatactctcagatggtttccaagtagaagtgcataggtgctgaataatcacaattgtttaatattcgtttttaaaagtttgttttaaaatggtcttgaagggaaaattggatttatataaagttctggaatcacatttcctttgttccaccatcttctaagaccaagaacttattcattcatttattcatttaacaaacattgttgcgtgcctaccgcatgtcagacggtagtggcgaaagacagtgtctctgccctcagggctcctttatcctattggaaggaaataatcaacaaaagttatgtatcaggtggtggcaaacactacagagataaggcaggatgaatgagggatatagttagagactgaattataaatgtaaacatactgtcaaaaaatgtgtcaacttctgtttttcataatcctttcttacctttactgttgaggatcttttaggaactaatgtcaaatattaatctaatgaaaaggaattaatctgaagttgaggagttctttcaatgtcactatttattccttaaactgaaaatatgcttctatgaaatcctaccctgtgctaatttcaagaacttaaatattgaagaaggttctaggccatacagctccatttcataataatttcaaaccacatcagagataagcatgatagacttctgagctgaaaatccatgcatgagacaactttttaaagacactgtaacagaaatcacaaatactacccctagaaataaattcaacatctactgttaaatctctagtaccttcaaagtgttacacctgtaaaaaatcccatacttaatagagtattcttatcttcacaaattagatgtactttaaaatcatgccagaaatatctaccactcttacatgggtgtggaaaagttcttgtggacaggttattttgaaaatttgagcttttataaaccttttttccaactaccaaaagtcagaaaaaaaaatacatttaacatgaagaatccctgtttgaacatatagaacactggctaccacaagatcatcttctataatagagtacctgataataaagtatatgttacctaagctaacatacttgtaaaagagtgtcagagtgaaaatcagattccatatatggaataatttactccttagtcataattaatctagatacagagaaaaccttgacgacaatgttgctaatggatgataacgagcaggaggatgatgataccatatatttatgtggcatcagaatcccactgaggttgggaatgttaccttattaatattctttgtatctctttgaggtaaggagagaccacgtatttcaattttgcaaattaggaaaccataagtaaaataatttacttaaaattccaacaaatcaaagcactgccaagcgaaatgactagtgtaaacaatctgcccattaaaccataaatttagcaagcacttgtcatttatatcccacccactccccaaaagaatctgtgacaaaaattaaagcagaaatgtccaagtggcagcaccagcatcaaattccaaagggattacctagagtaagacttgctacgactgaagagctgcacaggacctaccaatttccttaatcataaagtatttgccttacaatctcaaagcagttaaattggagtacaaaacagttaaatttggagtagcaaattcttgtgttttgaaacaacttgctgtgcaataaggaaggataaaatcgtctcagaaataaactgacacctttcaaaggtcaaggaaacaactgccctgagctagggtcagggccattaagttactactgcaccaaactcctgtttattatgtcccttttccaatgctgtctttgcccaagacagctattttgcactaaatttctggtaaagatccaatgtaggtaattacattctggcattagacatctaccacacattaaattaagattgatatcatgttcacatagcatcctgaactatatgccacagagttaaactcttccatggctatgattcagcttgtgacaaggctcttcttctctttgaaatatacaaaatagtcagagatcaatgaaataagtcatctggacatatatctctacatttaaaattatttattcaagcttttagagtatgttcattgccaaatggctctagggcaagcccttccattagactgacaatttgaaagtacttattggtcatacaacgcctacagcctaaaaggagtgatacagatttaaagcagcatagtctttaaaggactttttctggatatagtgctttgtggagatcatgacctatggaggccatcaagacgccgctatttattatccctcaccatgaaatagctacctattactattaatatttcaaaacaactcaaaatttgagagtaaaatgtagccattttttgaattttacaactcagtaatttactatgatattaactaattttaaaaacattaaaggtatttctcctcttaagtccttccagatgataccagatattataccagggaagtctgacagctcatagttgcttaacacaggggagcttgatacaaagacacatcccctgggcttggctcaatattcttactgacagaagccttctgaactatcactgaacttagcgggtgataccacaacttgagacttctggaaacaggaaagaaatcctgaacacttcatccaatgacatttcccaaaattgtgtgaggagacagcagaagtgatcaaaataaggattgtgggatacaggagcaaggagtacaaagacagaccctaattttaagaaagctttcagtgggtttctgatgtttggatttaataatgctcgttagaaaattatttgagcgaatgtttgacattagcggctgaaatctataaaatacagcaactggaattaaactaataaaatcttacacagtatcaatccacagatttaataaccagataagggtgatttgcaatgagtatatagacagtttataggtaagtcagagcttctcaagtacttaagaagtacttaagggtgcttataaacaaagtcctgttgtaagtagttcaaacattcttgctaaaatcttgtttgcactattagtttgcttagtggaacttttttcagagactgttactgtgagttttaataaggcttgtgtctggaatagctcaagtccttactcaatggggcctggattaataacgttttaaattacctcaaaatacaaggcctcgtgcaatatgttaagtatcactaggattcagggaattcaactgtatggtccaagctagaggtaagaaaatcctagtcgaagccagtgcataatggccatttacccctcaggaaacaattgccgctttatgatttcaactctttcaggggaaagcagagacaaatttatgtgtcttggaatggacagagcctggagttgcatcctaaatcaactggcattttgacatgtaaaatctactttaacagttttcgtttctgctggctcattttccatcagaaatcttggtacagcagaaaaaagtctagaccccatagtctgtcactcgactcactctatcaggaccaatatcttaccttcttgatcttccattaatccagtacaacctacccatttgtcttctccacttctacacccagtgtgttcgacctcaaagagaaaaccacagaggtctgccaactggcacacacctcagatatccaacttccagactcagctagaccctccagaccacctgggacaggtgacaacatttgactcaaggaggctgtgccatgcttcttgaaatatgttcccttcccttggtctttatatatcaccacctcctaattctcctgctacttttctaatcactcctaaccaggctcttttcactcgacacccttgacacttggtgttcccaatgtctgtctctgtcccctacagaactcattttgtcagactgatttcctcacagtcacctaccattttatacactaatgacctccaaatcctcatttctaattcaatcaccttctgagttccagacaagcatgtccagcttcctccacctgaatgccctcacctccattcactcagtggcaccaacagaaacataaaaattggccaggcacggtggttcacgcctgcaatcacagcactttaggaggccgaggtgggaggatcacttgaccccaggagtttgagactggcctgggaaacacagggagaatttgactctgcaaacaattaaaaaaaaaaaaatagccaagagtagtggcccatgtctgtagtcccagcaactcaggaggctgaggtgggaagatcgcttgagcctaggatattgacgttgcagtgagctatgatcatgccactgcacctctgcctgaaccacacagcaagatcctgtctccagaaaaggaaaaagaaagataagacaagtatagacatcatcaaatccactggtttctggcatgaaggaaaaagcgctgggttctaaatctctgctcataattactatgcatttcttaacaactgccacaaaatacaatttttactaatttctaggaaaacctacaaattaatattttatatactatgtgtattgttttatgtttctatattagctgaaaacacacttttcaacatcattttcctgtgtctccctctcaataatttctaccaccttttccattctgtaaccaaaaagctagcaaggcatttagctttcccctaaataaattaatcacacaaaattacttcacaacattctgacctttaaattaatttatatgaatacaaaatatacgaagttttgcaaacacagtgttcaaagcaactgggagaattatttgcaggacacacggcaaataatttgccctcaaatgcagatgtgttttgagcaatacgcttagtaaatgcttatgcagaagaaaaatgcccatctgtcatataatttcttttcttataactttccctaggaatagagaaaaagtgacaaaagattaaagaaagtttcatatacagtactcttataaacacaatagaagataacaaattactctagaaaacacagttttgaacagattttgatgaggtggaataattgtacaaagatctcatccttaggtagcttcaaggcataaaatacagaaaagtacctcagattctgtcaggcatgcaattatcccatgaaaccacaactttaggagctgtgtgtgtgtgtgcatctgtgtaacacaaagtgtgttactgaatgaactaacaggaccaatgcaagtaataccattacagcacaccataagcattcccctaattaaaacatgccattctttcacaattctaagcgtgtacacttccggtaaaacatgccactctttcacaattctaagcatgtacacttctggtaaaacatgccactctttcacaattctaagcgtctacacttccagagaacattatctgtccaggcttttataacgaaaaattctgtaagaaatttagcctttaattagttttctcttgttactttcagttttttcttttttcttttttttttagtttatttaattttatttctttccaacttttattttacgttcaggggatacatgtgcaaccttccagttcttctacattcaagaatattacatagcttgacactgtttcctcactatgttctcaaatttacttggttttctcataaaagagcctgatgttttaatttcctggcttccaaagcttaagggcttttgcactgttgaaaacaatcttatagttcttcaaaactgaatggctgatattataaagtggtatatttcaggggaaaaatgttcaaataatagaaggattctcagcacagcagttgagtcagcagtgctaaagggtatattcttttttcttgagtatttggttccacaagttttttcagggtcaactgtaaactaaatatcaaaacttaagtgcttatcaccatgtattacaaagaaaatatactatgacctcatgttactattttgtgtaatttcagaacattttaaaatttatcttttctactccatttatttccaaaatacttctaaaattgcaatttatagtctatttacattcaaaatactttagaaataaaatataagtaggttaaaaatcatatctttctcatcatttgattaagagtatccatattagttcttcccaagacagcaacattttcttagcactaaatttcagtaggaaagcatttttaacatcgttttaaatgtaaaatttcttgttaggattgtttcttttatttattcttgatgaaaaacaaaatatatggctttgatttatacatatttaaaccaatacttgtcacacttacatatgatgcgtttttcttcactgactgtggagttaatatgttatggctgttatggcatacatgtcaggactggctgatctagtggatggactcagcagtgtgtcccttggctgcctctttcataactactcagctcttctacccctgagctgagcagctgacagttcactatcaagcttgttgatgactgatagaaatgctgatactctatattgctgggcaaaaagagaagcattcttgtagataacagacaattaaggagcttagcttgcatgtacctaaaccatatcaataggccaagactgtagaaaatgactcatttagaaaaatattttatatcttaaatgaatctcagagattaactagtgcttcatacttgtcctgtgagtcctgctggaagttcctttgctcccaaggtggtgtagacatgtgctccacagcactgatcttagtttgttacatgccctagcaggtacgtaacatacctcattttttggttttgtgtttaagtttcagctttctctcttacttactttgccaattactctatgaaaagcaagttgctagattggtaactgagtttataaaaataaaaacaggaagcaagatgttaagtgctgttattactgtcagtattttatattcagcatttcatttaatctttgtaacaatccaatgagctaggtatttttattctaatttaaaggagaaaagtggctaggtttgtatttagtgccacttcttgactgaccagtcacatttgggaacacattttaggctctttgttcccaaactaaactcaagatacgaacattcacacatcctgatgcctctacattctgtatttcctgattgacatttggttaaaccatgaagaagtagtgaccaaccaactctcaacagtgaaacaggctccatttaggtgactttttatacagatagcttcccaaatcccatactacatctatgatatcagacacttgaggaatgggaattcagaacgttatctttaggtacatggccagattcaggaaccaatggtttagtaaactacacctcagagatcttaggtcctgtaattgctgtcaaaagcagactagaatccaagattcccagctgggaacttttcacaatgccacaaagatatgctttttaaaaggcaggagggtctctttcacaaatatgttagatctgagcacagaaaaccattcaatccttggttcgtttaaagcagcacagataagtctaagcaaggaataaatcaagcagcaaagatttaatgtgaacccaaaacatcaggaacaaaggagatgaaaactggtaaagatactaaaaaatggaaagggaaaatgattattattacagaatgtgataaaagctgccaatgtcaatgacaaataggatcttcatctctatcagcagaattctacaaagtatcaaaaaacacgttactgtactctccaaaacagattgcttatatttattttgaacatagcctcaatgaccagttggaaaaagtggtctaacatgctattgaaatacaagaaaaatacttgaagatataatggctgaaaactgtcataaattgataaagactgtaatccttctgatccaagaaacccaacgaaccctgagcaggataaacacaagaaaaacacacagcacatcaggctgggcacggtggctcacacctgtaatcccagcactttgggaggccgaggtgggtggatcacaacatcaggagttcaaggccagcctggccaacatggtgaaaccccgtctccactaaaaatacaaaaattagccaggtgtggtggtggtcacctgtagtcccagctactcgggaggatgaggcaagagaatcgcttgaacccgagaggcagaggttgcagggagccgagatcgtgccattgcactccagcctgggtgacatagcaagactccatctcaaaaaaaaaaaaaagaaagaaagaaaaaaaaaaacacatagcacatcaaaatcaaattaccctaagctagtgatatagcaaaaatgttgcaaacagagtgaaaaagacccatagagaaatgaacacaaggatgatgagattacttgtcaaaatgttaaacagaatctaatctaaaaagagttttaaagtgctaaaagtcactagcattctatatctatgaaaataacactcaataaggtaaaatgaagatgttggctgacacaaacaagagctgaaaaaattcactgagagcaaacagaaactacatgaaatgtaaatcagactaaacaaaaactataccaaataaaaacttccatctatgtaaagaaatgaagaacatcagaagtgataaagatgtgggtaaataagccttttattcatttaaaaattgttttaaaaattgtttaaagtcaaaataataaaaatatattgcagggttaaaaacatggggaaataaaatctatgaaaacaatagaacaaagaccaaatgaggaaatggaagtatattattgtcaacctcttacattatatgggaagtgatataatactgtctacaaatagagagagataagatacaggtgcttattacaaaatctagagaaattattttttaaaaaatcaaacaggtataaacaaataagataaagatttaaaagaatgctttaaaaataccaaattcaacccaaataaggcaagaaaagacgggggaaaggatccaagaacaaatgtgacaaataaaaaccaaaacattaaaagggcttaactcagcaaaggacatgaacagatatttttcaaaagaagacatacaaatggccaaaaagcataagaaaaaatgatcacaacatctctaatcagggaaatgcaaattaaaaccacaatgaagtatcatcttacaacagtccaaatgactattactaaaaagtctaaaaatagaagatgttggtgaggatgcaaagagaaggaaacacatacgctgttggtgggaatgtaaattaatacaacttatatgaaaaacagtatagagatttctcaaagaactgaaaatagaactatcattcgatctagcaatcccactacttggtatctatccagaggaaaagaaacaattatataaaaaagatacctccaattatatgtttatcacggaactattcacaatagtaaagatgtggaaacaacatacatgtccatcattggaagactggattaaaaatgtggcatatataccatggaatactactcagtcataaaaaagaacaaaatcagggccgggtacggtgactcatgcctgtaatcccaacactttgaaaggctgaggtggaaggatttgcctgaggcaaggagttcgtgaccatcctgggcaacataatgacactcagtctctagaaaaaaattaaaaattaaaaattagctaagcgtggtcgcgcattacctatagtcctggctacgtgggaggctgagatgggaaaacccctgagcctagaacttgaggctgcaatcagctatgattatgccattgcattcttgtctacagcaagactctgtcttcaaaaataaaaagtaaaataaaacaagaacaaaatcatgtcttttctagcaatgtgtatgaaacaagaggccattatcttaagtgaaatagctcagaaacagaaagtcaaatactgtatatcctcacttataaatgggagttaaataatgtgtacacatggacatagagagtggaataaaagatatcacagacttggaagggcaggaggggggtgagggatgagaaattacgtggtgggtataatgtactctatttgggtgatgattacactaaaaacccagatttcgccaccacacaatatatccacggatccaaaccgcactcacaccccctaaatttatagaaatacaaatgaaataaaattaaaagactgtaatctaattagatgaataattacattaagtgaaatggtctgaatattctaattaatagagattttcacactagataaaattgttgtaagactcaataatatgttttttatgtgaaatataagtatgaagacagattggttaaaaggacggacagttttatcatgcaaacactaatgaaaagaaagctgggtggtttcagctacaaaatataaagaaattgggtttaccactagtcctcacaacaagaaaaatgctgaggaaatggaaaaccgatgacttttcttaggtccatgtgagaatttaggtcacagggcaaacaaccacattaaaattattcttttttattttttttctggagagacaggtgaatatagagaatggcggttgagattggcttatctgaaggagaaaccgccaggaaaatcaaaatggtaacttcagtgaattcctgcagaatgaatatgcactagcttgggagttaaaaaaagtcccaggagccccaacttagaggagtccccacacttttaagaattttaccttcaagagctccaagacagtctttacggtgaacatcagagaaaaccccctcctgttgcagtaacagttttgaaatacaccaagggtgttctggtctccctaacaaaaacttgccttctcagggaaaatgcttcgacaaagtcttctctgacctaggggaaaagcagacactcaactctggccgcatctatctgtcctgtctcctttgaaagagaaagaaaaaaaactgctaagaaacaattctggccacaggccagaaattcagcctcattttaaaaataggaccttaccaacattcatcaacagggcttccatatagtaagagtggattacaactgagagagcagtaagccacagactctatttaggaaatagttctcaaggtatcctagacaagagagtgaagaaacaacatcacaagtcaactatggaaaactaaaacctgtggcacttacagctatagcaaatactaaacaaaacccagctcattgtcagattaacataaaacctcacactaaaagcttactatctcagttcctattacttgacaagtcaagtccagctttcaacaaaaaaaatgacaaggtcatgacaaaagaaaaacaagaaaaagcaccatctaaaaaaacaaagtgagcattagaaacagattcacatataacagatttttaaattatcagatagggaagttaaaataattatgattaatattttaggaaacttaatggaaaaagtagacaacatacaagaagatatgcgtaatgcaagaaaagaggtgggaaaaagaaccaaaagaaaatgatagaaatgaaaacactgacagaaatgagttcccctggcatgaccacagaaaaagtcagtgagcttgaagatatatcaatagatgcatcgcaaactacaatgcagagaaaagagaataaaagaaatgaaacaatgtccaagaactgtgataccattacaaaaggtgtaaccaacatgtaatgagaatgccagaaaaagagcaaagaaaggaagaaatggctgagaatttcccaaatctagcaacaaataacaaatcaaaagtcaaggaagctcagagaacaccagagaggataaaaaccatatatatatatatatatatatatatatatatatgcatatcataactgcaaaaaaccaaagagaaagagagtattttgaaagaagcttgtcaaaaaacaagcaagccaaaagacaactgtatgaaatatttaaaagtattaaaagaaaaacacccaacaaactaaaattttatatacaacaaaattatcccccccccccaaaaaaataaaaataaaaactttctaaggcaaataaaactgagggaatgtattgccaggagacctgcctggcaagaaatgctgaaagaaattcttcagcgagaaggaaaattatataggtcaaaaactcaggaaacaaaaacaacaaccataaaaaaaaagaaagaaacaagggtaaaatgaaatcgtttttattcttaactgatttaatatataactgttcaaagtgataacagaaacgaaacaacatatgggtgattatagtatatggataagtgaaaagaaggacagcaatgttataagaggtggaagggagatgttcaaaatactctgttataaagtacatgaactatctgttaagcagcataccgttatttaaaagtgaatttaaattagctactaatgtatatcccaaactttagggcaaccactgaaaattttttccaataagttttttggttaagacaggagaaaaaatagaatataaaatgtttaatgaaaatcagagaaggcaagaatagagaggaagatgaagaataaaatataactgcaaaaaatagaaaactgatgcaaatatcacagatattaattctaccatatcaataattatttgcaatgtaaatagtctaaatatactaattagaaaacaaagagtgacacagtggataaaaaataagacctgactatatgttgtctataagaaactcacttttaagtataaagtcacaggtagatcaaaagtaaagggatggataagtgtatatcatgccaacactaatcaaaagaaagttataataggtatattaatctcagagagaacaaagaaaattatcaggaataaggaagacattatgtaatgataaaggggtcatttctccaagaaaacataataatccttaagaagtaagcaccctacaaaagaacaacaaaattcatcagacatgactaataatgcaaggggaaataaagccattattagagatggagactatacacctccctctatcagtaattcacagatccaactggcagaaaatcagcaaggacatagctgaagtgaaaaacgccatcaatctgctaaaaagacttaattgatatttactgattacttcagagtacacattctcttcactgtcacataaaacatttactaagatagaccatggatgggaccataaaacacacagtaacaaaattcaaaaaacagaaattaaactgtgcccccagatcacaacaaaattaaatttagaaaatacttggagattaaatagcatactttcaaataaaaaatagatcagagaagtatcaagataaatgtttaaatatttttaactaataaaagtaaaactacaatttatcaaaatgtgtggggtgcaggaaaagcagtgcttagaggaaaatgtatagtattgaatgcaacattaggaaagaggaaagttctcaaatcaataatcttaggaaactagagaaagaagggcaatataaacctaaagcaagccaaataaagaaaatagagcagtcccccttatctgtaaggtgtattttccaagatctccactggatgcctgaaactgcagacagtaccaaatccaactactatgaattggaacacacgtttgttcatgtcttctacccacaaatttaatgcctttccatcttaactggacatttatcatgcaatgtggcccaaattttgcagttcagcaaaactagcaaaacagcaaaactagcatgactttttctttcccattttaagaatagaagattcattcttagcaacctcagtttatggtttttttctttccttgttgggagatttcaccttaaaggaaggctagatgtagcagcacaggtctgtaatcccagcactttgggaggccgaggcaggcagattgcttgagcccaggaaatagagaccagcctaggcaacaaaaccctgtttctaaaaaaaaaaaaaataaattaaaaaaaaaaaaaacagaaaaattatctgggcatggtggcacacaactgtagtcccagctacttgggaggctgaggtggaaggactgcttgagcctgggaagttgaggctgcagtgagctgtgattgcgccactgcactctagcctaggcaacagagcaaggctcggtctcaaaaaaaaaaaaaagcagaaagcagacgatgaaaaaacagacaattgtccagaaaacaaacaaacaacagagaatcaaggagtacttccagaaataaaggggaagctatcgcaataaaaaagtggtcaattaataaagaaggcataaccatcctaaatgtacatggacccaataatagagctacaagatatatgactcaaaagctaccacaaccaaaaggagacagaatcaaattcagaactattattggatatttcaacagttttatcagtgattgctgaaactagagaacaggaaatcgagaaataacactatcaactaacttgaactaatggacgattaatgaacactatatctaagagcagatgattatatattctttccaaaatgctcatgtaataagactataaaatggaccaaaaccatgtttccacaaatttaaaaggatcgaaataacaaagaaaatactctcaacaacaatagaatcaaactataaatcaataaaaacgacttctagaaaatatgcaaatatttagaaagagcatatttctaaataacccatgggtcaaagaagtcacaagagaaattagaatatgtattttaattgattgaaaattaaaacatatcaaaaatcagtcagcaaaggcagtgctgggaggctaattatggttttaaacacttatagaaagagcagaaagatctaaaacacataatctaaatttcatcttgagaagctaaaaaaaaagacaaatcgatccccaagtaagcagaagaaaagaaataaacataaaagctgaaagtaatgaactggaaaggaaaaaacaacagagaaaaatcaatgaagccaaaggtaatttgctgaaaagatcaataaaatgaagaaatatttccaggtagcactgaaaggtggtgggggtggcgagggtggaggagaggagcgtggacacaagacacaaaattttcatgccaggaatgaaagacagcaaattatctgcagatcttacaaatattaaaaagaaatgccataaacaaccacagttgattctttttatttttttttttccccctgagacagagtctcactctgtttgccaggcaggagtgcagtggcgctatctccgctcactgcaacctccgcctcctgggttccagcaattctcctgcctcagcctcctgagtaactgggattacaggcgcgtgccactgcacccagctaatttttgtatttttagtagagacagggtttcaccatgttgtccaggctggtctcgtactccctacctcaggtgatctgcctgcttcagtctcccaaagtgctggaattacaggtgtgagctaccgtgtccagcccacaattgacccttttaacaacataggaattaggagtgccaacccccattgcagtcaaaaatccatttataaatttttactgccctgaaacttaattgctaactacttactgttgactgaagtcttaatcatggattaatatatatttcatatgttatatgtattatatactgcattcttaacaacaaagtaagccagagaaaagaaaatgttaagaaaattgtaaagaaggaaaaaacattacatttccaaaaaagtcaaatctaaaattaagccatattgtcaccaggtcaccattctaacactactgaagaaagctgcatacgctgcaggtatacttggtaaagaattaagcttatcttgttttttaaaaatagaaataatttttaaatttaaaatgttcaacttaattcaaaatattctgccatccatagtcttcctcaccctacttgtcatccacaaaaacctttacaatttttgtttcttcattgaaatcttcagctacagttctgtataacttttattttctcagagtattaatttgaaccttctctatctactggcaacaacctgacatataatctgccttaaactttaaggtctataatgattatagaatagaattacgctgatgctatgactcaaatcgtatctaaacatacatagcttcacttagtgaaacaataaggagttatgtcaagttctagacagtggttttgttgagatataattaacataccacgtaattcacccatataaagtgtacagttcaatggttttcagtaatacactgatggttgttgagcaaccatcaacatagtcaacttcagaacatttctaacactctcaaaagaaaccttacaccccttttagcagtcactggccatttgttcccaatccctcaaccctagacaaccactagtcagccttctatgcctatagatttatctattccaaactcttcatattaatggaatcataatacgtggtggtttttactaactggctttttcacttaccataatgttttcaaggttcatccaagttgtagcataagtacttcattgactttaagtggctgaaaatatttcattgtatagataaattacattccatttatccatcaataaatgaacatttgtgttgttttcatcttttggctattatgaataatgctgctgtgaacattcatgtacaggtttttctatgaatatgcattttaatttctttggggtatatatctagggatggaattgctggggtacatggtaacttgacatttaacctttcaaggaactgcccatctattttttaaagtggctacatcactttacattcacaccagcagtgtatgaaagttcccatttttccacaacctcatcaacgcttggtactgtcttttttattatagccaccccagtagatgtgaaatgtcacctcactgtggtcttgatttgcatttccctgatggttaataatgtttttatgtgcttattgaccactgagagtgtatagaaatacaaatgatttttatatattgatctagtatcctgaatctttgctgaattatcagctgaaataatttttagtggattccttaggatcatctatatacaatataagatgatgtcatctccaaatagaaatagtttaacttcttcctttccaatgtggatgtcttttgtttctttttcttgcctaactgctctagctccagcctccatgcaatgttgaatgaagcagagacagcccataatctcctcttgttactcatcttagagggcaagcatcctatctttcactattaagtatgatattacctgtgagttttttctagatcctctttttcaggttgcagaagttctccttttccttttttagtctcactctgttgcccaggctggagtgcaatggcatgatctcagctcacttccaggttcaagtgattctcctgcctcagcctccgaagtagttgggattacaggcacccaccatcatgcccggctaatttttgtatttttagtagagacggagtttcaccatgttggccaggctggtctcgaacccttgacctcaggtgatccacctgcctcggcctcccaaagtcctgagattacaggcatgagccacctcttcctgccagaagttcttttattcctagtttggtggctattatcatgaaagggtgttttattttttcaaatgtcaaatttttcagcatctactaagaccattatgtggtgtttgccctttgttctactgatatgctatattacagtagccaaattttgtatatgaaaccaaccttgcattcctgagataaatcccacttggtcatggtgtataatcctttttatatgttgcttgattcaatctgttaatattttgttttggatttttgcatctattcagaaaagatattagtatattgttttcttgtgatgtctttgactgcttcttgatatttgaaaccatatgtttaacctaaagtcttaaactgtcaaacatccagaaaactgctatgagccttaggagtttatatatgtatgactgatgctgcatatattcatatttgttccaagaaaataatattttaaggctagccttgagaacaataaaagtatgcataaaaattgaaattgtcaacattgaatatgtatgcctaaaggtcataacttaggcatatgttatgcctatataaataaataaaataaattaaataaattaaaaaataaaaacaatgtacatatcagttatgagagatcacatagagaatcctaaacagcaagatttagaaactaagattatataaaaagaatctgaaatgtcttaatattttattggttctactttagcagaggcagaatgcttccaacttctttaaaatttatttttatggaaacggagttttagtttacctttgtaaaagttgtaaaattactacagataatacattttgcatgctttaatacatcatgagaaaacactacaatgcatccagaggcatattttttttaaaaaatcaaaatcagagagccccttaatggcaaaaaaaaatgcttactgaaatagaaatccagtgggggaaattaatatttaatgtaagtgaagacagtgattctgttaatagtcaaaataaacactgaaagaggaaattaggcaaatttaggacaacagaattacctaaaaataatacagctactcataaggaagaatgttgcttaaaccatacatcattagatttattgtttctgcttaaacagcacatgcagggttactttaaaaactttaaaccccagcgctgcatatgtgcttatctactactatactggaaaaataaaacaaatgtgaaaggttttgtaacatcatcttcctctaaatttctgcagcagttctacccccagctgagatggtcttgagcttcctccttctcccagctgcttctcctgcatttggctttaatcaggtgcagagcaggaactccacatcctgttgccttactctgattaggaggagtcaaattctacaaattggcaggtttctgcctgtagtgattctatttgatgaatcatttgcttttaagtatttgaaaagggccattagtgaaggagcagcccagcttgttgctattttctggtctatttataaccagccattctaaggagccaaatgctgatcatctttatctactggaacctagaagttaggaatgaaacaaagaatggatagtcacctgattctgaaataaaaacagcagagatcaacagatgagacactagttgtagtggtctctagacccttaagatagtcgattaacagactaagagatctaggtgcctttttcctaataataaagagacataaagtgagtgtttaaaggcttagtccaaaaacttaagcattcaatcactagaaacaataaatgcataagtaaagatacaaggtggaaaaaaagccaaaaattaatataataagtaaaatatttgtggctctcttagtctccaggtcttgtgttaacctcagttcctaaaactctaatcccagttttgcaagtgggcagcatcttggacaggtaaaacatagcagttatatccactaacgacagcattccaagttcccgtccccacccaactgtggaaatgactctccaccacaccacacaccctgcactcctgggctccaatcgctctgtaaggcgatactaacaatgcatgcaccacccagctggtggggtggcaaggagccaggcttcctcagctggatagtcttgatttagaggttgtgaaatggcagtctcattaagacttggccactgtctctttctcaacatcattaaattgctaacacagcaggcccaacatcaaatggcctttgtgtaatcctaataagccaaaggatgagaaaagctggacttgaggatgagggaatgcttttcattgaagcctgagttttatagcctgacaggctgcctaagcctaacaaggcaacagggtatggaaagacgacacaggcaactcttataagctgtaccaaaagtagaagatgcaaaaccagaaggacagggaacagggtctaaaaaaaccaaagtggagcaaaatctaaagaaaatctcataggagggtaaagaaaaatttaaagcaaatatatcagccagggtaggaagggcaaaccttcaaggtactaattgtaaatgggtggatataggatccacacatagaagcagtagctcttaatccctaactggcataaaatccatgctctgaaagacaagtgacaattttgtggcacttttctggtattttttgcattcgtgagattcatgagattaagaggaccatagtgatgctacaaaatatttaaaataacacgaattcaatgatttttaaaattcaaattttaaaagaaaaggagtggaaaatatcagaaatgagatcacctgttcaatctgctcgcgataatgcacattatgaaataaaaagcaccaccacatttaacagtacaaaactgaacttagctgcacaagatttgttattatctatacccaaggttctagtgcacagaattttagactactaaaatctgtatttttgaatttcattctattgactgcatatttgatgaaacaggaaaagagcattcccaaaagagcagagattttactttatatgtaaaacacagttggaaatcagttaattagaaagcacctcagccaataatagtgaacatttagaacacagacagagaacttccaaaactccaataagccctctgtctgaggaataataaaaactgttcaggcatgtgtcttttaagaattgtgtgttaaatctaaatttatgtaattagagggtttttttaattacttataatttcctctctaatttatttcattaaatacacagatcctggaacttcttggcaaataatgtcagctaatactgacgtaggacctagaatctaggtaaatggtcatcaaactgtgtctccagagatgttctgggcatttttcaaatagctggcttgaatttcattttacactataggaaaactatattcaaattcacatgtaaatgacactgacttttaaaacactagtaattacctagatatgtactgtcaaattaaacttatttatagtttgacttcagaataaagcttcccctgccatctttacatatactcgaacctctttcattaatgatgatggccataagctacaaaaggacaggacttgtgtctcttcctcgtaacaactatgggttggataaactgttctgtgccacaattttcagaattcaaaacataagaaaacttgtttgaaacaggtgaaacctgaggagtcttggcacaagcaaaggtgagacccccttcaggggcccttctgcaggccaagtggacagcattccacggagggcagagatgtgacacacaggagcatgtgcacgccaagaactaaacacagaatacaaaagactctctaaaataactgtatttgaaatgttcaaagaggtacaagaaggaagtaaagccacaggcaagaaaaggtagatttgaagtaagcactaaactgatttttcatatatttagtaaaatggtcacaaaaattatccccaaatgggtaaggtgagtaggagacatcatgctctaaaagacagagatgagaacatcatccaaaatgctgcacaaaaaccaaaaagttaaaaatagatgaaagagaatcttaaagatatggaagagaggctgagatgctccaaaatgtgcctaataaaggttacataggaaagaaatagataatatgtgagtgaagcaaggagacatggttgagaattttcaataatcaaagaaaaccacaaattctcaggttaaaagacaagattaacccacatccagatatactgtaatacaactgagaaacacaatcagggagaattgcttttcactttctaataatcaaaaaaagaaaaaaaattgaggagaaaagaatcttgaaagagtaacaattacaccaatagcaaaaatagatagtaagagataataggatattttcatattgccaagagaaaattactgccagtttagaattttgtaactagccaaaatactattcaaaagtaaaagcaaaatagagatttttttcagacaagacagagagtttataactcacacgccttcacagaaactatcatcaaaggacagactttatcaagaaggaagatgaactcacaatgcagcagcaagatggcagaaataacagtgagtaaagaaactggtgaacatatggatacatctaaagaattaccagccttatttaaaaataacaaaaataacaatgattaattggaaagaaaggcaaacaagagagaatgaaattactggaaagcaataaatcgaaacatgggaagtagcagttcagggttaaagtgttctcagtaggcaatgggaactattaattagatttagacttcatcaagtatgcatgttaaagttaactataaaagcaaaaagaatacaaagagaaagtataaatttgtaaccaacagccatggaaaaggaaatgaagaaaattctatcagactagccaaaagcaagaaagaaaagagaagcaaagaaaaaggacaaaacataaattaacaagatagaactcatctttatatcaataacagcaataagtataagtgcattattacctataaaagggaaagacaactcctaagttaaaaaaaatacctaattatcactcaaatacactgaaagcaaaaaggacaattaattgaaaatattagtagaaaaagaaatctcaggcaactagtcacaaaaagaaagttgatttagcattaatcctttcttcttttaaattctaatactaataagaataaaaaagtataccatatactagtaaaagtatccaccaaaaggatatgataatcatacaacaaggagaaacagataaaactataatggcagtgagagattttgatactttgtaggaatattatagtcttcaatgcaatcatttaggaaaagatactaaaataaatgaacctaacattcaataaaagaaggaacagaagaaaacaactcaaagaaagaagacattaaagttgatttttatttttattttgtaaagacatcaaatttgtttccatttgtattcacatgttgttaatgccattaagatcttatatattattaaatatactggaataattcaaaaatcaaaactattagttctgtaaatctgatggtggggtgtgtgtgtgtgtgtgtgtgtgtgtgtgtgtgtgtgtgtgtgtgtgtgttttggtaaatatttattaagtgcctattaaatggtcaggataaaatgttcatgtcaagaaaataaatatttagaaccaatacacatgcacacacgcacacacatacatgcacagtggaagatttctttctccttgtaattgaaaaaaaaatcaaatcaagcattcacttaacattatacagctattattatccaagtaaattaaactaacatactgcatgagtaataaaaagaaagtatttcctaatacttgtaccttaacctttgggtctataaatgaatgaataaagatgtatataccatgtagccagctgctaagtcagtatgttctccagcaatctgaatacatgcttcaagctcaactcagtatgtacagaatacaaaatggaaacaaagagggcaagttctttcttaatcctaaaaaaccgacataggaaattgcctgaataatcagctctgtaaattagattattctaacagtcacatggcaaattatcatgtctgcctttctctaagatgttacatcttttttgttaaaaaaaagatttttaactgctacatggccacatagtccttagaacttttttacattaccaaataactttttaaattaattttaaggttccttagcacattgtactcaaatactcaagtttcactatatttttaatgtaagaggtttaactctaagaacaattactttagttcaacagatacccaccaaaaacggtgctcaaaaggcaaagggaggtcaaaggccaccacctggtcctaggccagagaccccctgggctttctggccatgtggctcgctctttatctcaaggtgtggaaagcctcccagcttctctcacttcaaactcaaaaagctccatctagtcttagttcccaagcacacaccttcactctccattcatgaggttccatttgttctgctttcccagtcctcacacaagtatcttcagaatgtgtcatggacttaatgacgtggaaaataaggataataataacaccaagtcatgcagaaagatctttgcaatttacacgagacataaagagaagggttaacgcacacatcgtttctcttagcatgatattcaaaaccaccagcagctgaatcgacatttttattttctacgtcactggccatagacagaaacttgttgtgaatctcagttttgtaatttgtacatgttatcagaaaaattgttttaattttagcatgaacatttcctaaagtgctcacagccactctcaaaacttcctgggaattcctcccagtgcctggtttggataatgctgatggatacagagcaaagtgaacttcatagaacccagtgtctgtggatgaggcagccagctgccagagcaatagagaagtgggatgtcagtgcatattaatcaagccgaaattatatactttgtaacttgactattacagcttcattagtttattgaatattgcccacatgaagacctttgtactaattctgagatgttaccaagaaataggaaatgaggtaaatacattttccaaggaacacagatcatataagaaataataatatcaaagaaaatataccaaaaaatcccccagaaattatggaatacattttagcatgtacataatcaaaagcataatggtaaactaagaacaggaaccagagaatatagtttgaaacaagatcattgtgtctaaatggctccatgaagaagaggaccctggctggtactctggaagttgtagcattctgatcttatgaagcgagggagaatgaagtccttggagaaaaacgtggaacaggtggacacagccagaggaaggagcgaacacattttgggcaaggacattctctgtgtgagactggctgcatgggcagaacaagtgaaggtaatgggagaaaaaaggcagccagatatagagagattcacaggtagaaagctctgcaacccagggcttaattaatattttcttttcctttgagtttagcatgctcagaaaggggctaaggtgattttattttaaagcagggaatttgaaagatttttatttgaatatataaaatatgcagagatggagggagaaattcttgcaagtccaggagaaaagtgttagggtttggaataggaagagaaatcatcaacataatgataagcatatttggcaggagtgagaaacaacagcagaacttactgctctatgaacatggcagctaaaggcaaggaagattcttccagaaacaaatgtaaggaaatagcagagtacaagacagttattagaaaacagggtaaatagcatgtaataatacagacacagcaagaagccataaatttacatttcataaagtttatgaaaagtttttattaaaaatatatttttaacggaaagtaaaaacttcacaaaatgatctgcaaaatttgaacatgtacagtagaagaaaatggaggttttgtcatattaatcaaattggctttctatcatgatacaatatataaactcattgccactgcagagtcctgttcttctacacttttggactcttaaaaaaattctagtgtctatagttctttgaacaaaggtttaaaaaaagcttcaaaactttaaagaaaaacagaactcttggcgaaagctactattaaagggcccgccttaaaaaaatctagcttgtaaaacaatatcttacatatttcaatgaattctgatttagatctccattttagcttctttgaacaaacatctttatgtgtaaaatgaatacttttgttcacacaaacagcgcctcattccatttagtttaattcataagactgcttagcatatgacattgatataaactcaccttataagattaaaagaagcacagacaagttcacttaagttaaatatgttttaagtttctctaagtgaagaaaagctaaacacatttttaaaccctaaatcatttagcttctgcaattatctcatctaccagaactctaaaatcaatttgactggactttcatttatgctttataataggaaaaaatgacacatttccaaatttaattaaccaaaacaaaaattcttaggacaccccatgtaattctgagtggactaaacaatacatcttcgtcgctcaggacaaaaggtcatttggaagggatgtacctttaagggtttacaaaggcttgatcttcagtcttgtaacgaaagaggaagcacatctcagcagaggaaggatgcccactttaaataaggaaatgggcttgcaggatgcacacatgctgctttctattaatgataagcacagtctacaaaaagagcctcagaatgctttaactttcatgtagaatacctgcagagaatgtctaacataaacaaaacgacaagtaatgtgtccactcaccgttttatgaaatgatttatgtgttcataatagaggctagtaaatactaacgactatattccagttaacagctgtaattactggtgtgatgattgtatgccaggatccatgccaataatgttttgggagcaaagcatactttaggggtttatgaggatgattatacaagatagatggctctgctgggtgattttttttctttctttcttttttttttaaccagagggaatgagatggcagaaattaagacctttaccataccttttttaaaaaatagataattatatatgtttaagaactggaaagcattttgttaaagtttaatctctttcaagacagaaagtaaatccaatcaaaatcccagcaaatattaatctaaatttaattgtggacatcaccttttggcttcttccatctctgcctgtgtctgtgtgtgtctgtctctcacacacatatatttacacacacaccctaaccagatattttgcaactacattaaaataaatcataacctttatttaattactcagcaggtgactgtccggtttgtcaacctgccctgtctctgactcccctcaaattccttctcaccacctatcagtaatccttggggcattctgctatttcttaacacctcaactaagagatattaaaagcagataaattatctacctggcaaaaatttactgcaaattgtccagggtattggtaatttcccagaattatgtctgcattgacaggacagttttgccaactgcacctgcagtccagcccaacctctcctcccagtataagtggcaaacttaaaaaggctggaaacactttgctcattttacaagacttgtgtcaggcatcacttctattatgaaataatcttgaattgtgttctggagggatctggggccaaccccatgctggatcacataagtcttactaagtgtatgcttggattccatgtgtcaccccaaaagaaaagcttatctttaacaaatttatttaaaattttgacatcaaaatattccaaagaaatattttgaagaaggtactttaatttaaatataaatttaaattttgtgtcattttgaattatatattggggtgtacaggagcagcatgtaatactatcttctgtgctgggggcctcctaaggattttactcggtcctagtcaaacctctacaataaaaacagatagcatgcattacatccaactcgtgaactgcctttctcccagtgatatgaagacagtccagagaagggggcaggttggaggaggagggaagcgggtgcccacacagagatcaacacacagcccatgtggttcccacagcatgctctgcacaaccagacagatccatcactgctggttactgtccatctcctccacaagagtctgtgggtttggtctttgcaagatcatttcgaaattaaaagtggacaaagataatatatgcccacatcttcttaaagtatgtgtgggggtggtgcatgggaacacctgtgtcaaatttgtgatgctggagagccaagaaaaagataagggaggcaaatctgaatctggtggttgtaaagcacctggaggaaattttgctgttctttctccagcatctgcgaatttgtaggacgaggttaagagggagcacacaacttccaatgttgtcccaacttctattttacatggaccttgctccctacataaaatgcatataaaaccctttcttatttaaatttcccaaggatttgcagcagtttgtacaacacatttggccacagtaagtctcagggctctaaatgacctctggggatgaatgacatgtgcacacagaagaatttataagactcactctataacagttcctttggaactattactttctgagggtgaaggtaacagattttttttaagtagtacagttgacaaactatgcattggctccaaacaaggccgtgtgcgctagataaacatagtaaaactgttataaagtggttcgctaaattgtagctatactgtagctcaaaatgtattgcttgggacatagtgatatatagcatatgtttcactaaaatgtgaaaaagcctagaacacaagtattatctttgtgactcaacaccaatacaataacaaggattttctccaattccttttataaacaaaataaattattactgtatcaactctctcacacgtaaagatgatcacattactctctacaccagggtcacaaattcaaatgcaagcatgtagtataaatacataaagcaggccaggtgcagctacggtaaactcaaacaatggttctcacactttaatgtgcatacagaaatcgccctgttaacacgcacatcctgatgcagtagttctggggtggagccatggattttgaatttcaaacaagctcctcagaaaagcaaagaactagagagctcttttccctttcagctgttttgcccaggctgaggcctccacacaggagtgccactgggcttggtgctggtgatttctcaaaagctggaaattcactcattcaatcagtttcccaacctcttctgtgttctaggtatcctagatactaaagatgtagcagtgaaccaaacaactacaaatggatgccctcacagagttacctggataacaggagaggagagacacccaacaagataaataagtaaaatgtatagaccagtgtaagtgcttagagaaaaaaaaaaaaatcaagttgaaaagggtgtgtgtgtcagggtggggatggggatacaatctgagatagggtgaccagagatggtctcactgaaaatgtgatatttgagtccctggaagaaagtgaagaagaaagctatgaggacatctggggaaagaaacagaagcaaaaacagaagtaaaaaacagaggtaggaaatctgggctcagggcattcctggtgtgtgaaactgaactgccccagaggccaggcagctgaggagcagagtgactgtgggcaagcctggcgggtaccttaaagcctaaatgtttcctgtactttcttctgatttctaaatgctaacaactaagttgtaactttagaaaatattttaggcccatggtcaccactttctggcctctatagttttaaaagtttgaaaatacaattaacattttagtgaaatgccttatgaaaacattagccatttttattactgcctaatttctcctaagtcttaaactatattaaaaatttataattgtataatcagaacttattattgaaaatgggcacacacaaagatccataaagaacaagtgtagaagttagaacctctcaatgaccaaagggtggaataaaatcccagcaaaagatagtatccagttgcccatcaacagttgctagttcatcatcgggaagacatatactgtgaactgtttttctggtgctggtgataggtttgaactggagacatacagctattcctcagtctctctgtaatcaatgtcaagcatttgaaaggaaagtagcccaggtcaaggatgccttaagagacaataaatcaaatttgtcttttatcttcttcttatggaatcctatacagctggaaatctcagggccaaatctgcaagccttctcaggaaatctacagaatttcatggatataatttgtatgtgtactaatctcatttttggtaccacaatattaaatttattttctcttggcatattgtatgtatttgcacaatccttaagtctccttaaatccctttcaaaatgagatctggaatccattcatttattaaatatttactgatgcctactacacaacaagtattgttttaggttcttgggtatatatcagaaaacaaaacaaagatgtcggcccttagaaagcttatgaaaatatagagagaggcataaaacaaaaaggtaatttgcttacaaggagtctgatttaaccagtaacctaactggtagcagtagtatctccattcatcattataaaactgctaattcacaggtagctaaaacgtcttccagaaagtcaccatataaaacagaggtagcatttggaatacaacctgtggtgatagatacaatacagttcctcttactgatttgccatgtaacttactaattcctctaaggagaggatgcaaagaaaacttctaacaccaatctggaacttctcaaatttcatttttaaaaattctaaattgaaagcataaaatgcaaataaacatgtaacatgtagttaaattatcttttcaaaggaaaaagtatgttaaatcatgcaaacagttgaatgaattatcatgaaggaaaatgaagtctttgcaattcaagtagtttccaatcccagattattttaaattgatacttccttcatttatagtttgagccaaaccatatgaccaatgaaataataattgcataatcactgaatcaataatgcaatgattcattaaccaatgcataataattgctgaaagacaccacaaacccaatcatgtggttaggagtaaagaaggcagcaagaagtttccaaagtatcatgttatactgctcttaaattaaaaagctagagcaatatttcccttaaacatctatcatattaattgattgggagggttctcaattatttttgaccaagggcctaaggaaatctttccagactttctgaaaaagttgtatactgaaactggtcaggcataggacaaatccttcactttatcactgaaccaaatagtcttctgtcttcttaaaccttttgtaagtaacttcctaaggaaaaaattaacaatgtttgatttataagaataaatttatttcttaaaagaatgctttcagaatataagaaggcttctggaaattagttacttaaggattaaactatcaggtgttcaccgccattgcttttattgccccttttgccctgtgatgagcttagatcctaacagtacagatgagtcgttcctaaactaagttgcacaaagaatcactggaggtactttctaaaatgcagattcttgggtttaacctccagagaacatgtttcagtagctctaagatggaggtgttgaaactgtacttttcacaattgccaaaatgtttctaatatggcctatttgtaaatattctggaatcagatccgaaggagactgtgtaccagtccggaggcatataaaagaacccatggggatactgaaaaaaatattaaaactttcatagtcattgttatgtcatccatttcaattttttagtcacatgatttctaacacacagaatatactggtacaggattaaaggtatttaatgataaatagatatatgtatatgcatatatgtgtgtgtatataagggacacgtacaaaaatattaaatatgtgcacttatcttctataacaggggtcagtaaacttctttagtttacggacagacagtaactattttaaactttccaggccacatatcatctctgttgtataatcatctttgctgtttttcttttacaaacatttaaaaatgtaacaactcctattaaaaaaagattacatactgtattattccatttacatgaaacgtctagaatgagcaaatctacagagacaaagtacatttgtggttgccaggggctggggcggtaggagagaaaaggaatgttggtgccaatgggtatgagctttctgttcggggtgatgacaatgctctaaaattcactgtgatgatagttacgcaactctaggaataaactaaaaactactgaatgttgtactttaaatagttgaatttatggtatgtggattttaatgtcaacaacgctgttattaaaaaacgtaacattcctttttacctctgggttgcaactggctcacaggccaacagtgatctagaacaacagttctcaaagtacggtctggaagtccagagagtgtccaagacacttctggggtgtctgcgaagccaaaactattatcaaaaaatacaaacacatcatttgccttttttgttcttatattctcacacgtatacagtgaagttgtccagagcttacctgatacgtattaaaacacaccaaatgcagaagcagataggagaagccagccaatccgtttctggcctggaaggtaggcatcattcccaaggtcaagcaaccacttttgagaccatgaggaagaaacccagcctgaggatggttggggggaaaaagaagaagctgccacccctgctagccctatggaactgctacaccatctctagtctaccttctctagccttcttaccacataagaaaaaatgatttaagctgttttcaggcctctaacttatagctgaataaaattcttcacacacacaacatcacattgctccacaattcataaacagaaccctccccctgaacactgtctcctctcagatggcctcaagccaggctacaccatgtggagggaaggcttcattatgaaaggtgttaatcattaacaaagatgtcaaattaactgttctcccctcatgtgccaagttttctctcctcggtatgttgaatgctgtgcctgacctgcctagatgcccttctctccatttcccagagctcaaagcttatccattcttcaaggccaacccaactcatgagtcagctcctcatgatatcaggatatgtcttccctgattttccaaggattcaccactatacatctcccacatcttgtgtctcaaatggcacttactttctatttggcatttgacctatttctctgtcttatcattcatttctgtatcccccatcatacataccaagagacttctctcctaaataaaagctcaaatttgtgtcaattatatcaatattattacctatggtcaagttatttaggaagcagaaaataacacagaacaacagagtaaaagagtaacttatttatttatatttatttatttatttattttttgagatggagtctcgctctgtcacccaggctggagtgcaatggtgcaatcttaattcactgcaacctctacctcccaagttcaagtgattctcccacctcagcctcctgagcagctaggattacaggtgtgcaccaccatgcccggctaatttttatatttttagtaaaaacggggtttcaccatgttggccaggctggtcttgaactactgacctcaagtgatccaaccaccttggcctcctaaagtgctgggattacaggtatgagccaccgcgcccagccaaaagagtactttaaaatcctctccacaagtaatctcatgtcgcagggcagcctggcctgggcgactgtctcagccgtcatttattgcacctctaagaattagatgacagtgttctcctttcacctaactttaatttaatgtaagaatttgtgtgcctaatgaaaatcaactcaaccctgaactcccttttcaagtcaatgaaggaaatcgggagacttaattaaatggtgaaataaagcccttttaaggaggatttatgacccttctgtgtaaagtatttaagataacaaggtgttgataaattaggtcttggctggataaagatctaaacacatcagtataacagattatgaagttgtctttcataaacgcagatctcgggaataaactgagttattgattcattaataggtttgctaactggaaaaaaaaaatcactgattttcagagccttactgcttgttggcacctagtaatcaatgcttcttcccaggaaggtctgtcccagggatcacttagtacatcaactgttctaggctttagcaatccatacaaggcatatagaaattcctggcgttacccattatcatacttgtgtgtcccaaataaatggggctccaggcaaaatgccaagacagtgttaaacagtaagaccatatatgctgattaatgataattctcttcctataaatgtcagaaagtaaatataggatatactgagaataagcagttatcctcacgaagcatattctatgggaaaagtaaaccataaacaagataaaacaagctgcacggaaagacttcagagcctatggcatgctgatatgtactgtgaaatctgcatggtaagcagtattctccaaattaacgtggcgtagctcaccttatgctatcctgaaccataaaacacactttcgtaagtaaggttttaaataagtgctcagtagatacatcctaatttctattcctgttgtacctggagttatcttttggaggcgaaaggtaatgaggtaggaacagcctgaacttgtgagataaaaggagggagcccttggtagcatcatgattataaatgacatttctctaataaaggtaactgcacttagggagctgaagaaatggttcagtcaggcaaactgtctgggtatcaacacttcatacacttggagctctcccgtgaactgacaatgccccttcaacttcaccctcaatgagaactgcttcttgtacaagtaaaagaaggtgggaaacagataaaaatcttagtggagagttacaaatggtccaaaaaggaggtaaactagattaagttctcacactgtagaatcagtcaaaaaactacacgacgttgttgtaaccagagcctccaaataaaccattcccactgaagtacgctggttcacactgcagttccctcactagtcagctgtgcatgggggtcctgctcattctggactcccaggacagagaagcagcatctgacacatgtccctcacaatgggggagggagtagcaggaaagaaaactctggtttggtaagtctgagttcaaacagacgagaagtacaatcctatcttgtgcccagaacaagaaaccaaacatcggtgatggcatcaatgtctacgtcatagttcacctcaaattatgtctttgggaggggaaaattctacaaattatgctgtaacataacaaagcgcctggatgctgtgaatagaaagaagtggttgcttgggatttggttctgctgctctctagtgtttacaaccgctcaagccgcactttccttagcactaaggtctcaaaggtgttggcaacctgcacatggtttctaaaggagcctgaaaggaagacataaagacaaggagcaaatgaagacaagagagcaggggaaagagaaaagcggtaaaaataaataaataaatagataaataagtactgtaagtagtactagtataatggttgtttccaaagataaacattttaactattccctgccacaatatctccagtttacctgccttggtacaccatacttttaaagttaaccttgaaccttgaaataaagagggttgggggggaggtggtggtgaaaaaactagctcaccaaagcgcccttataaattaaagcctgaagttgggctcggtcccttttcattgaagatcgcccccctttgccatccccacctcctgacacaaagctggttttgtcccagccttgcatcagctgcacagtacagggtgtacatgctgaaaagcagctgtttgctgacagactgcgaactgggacagctagctagagctaagtgaagtggttaacccacatcccttccccactgataaagtgctttgataagcaaactatactggtaaaagctggaaagactgccagaaaagccgcgctcaagaatgaatgcaggcttgttttgagggagcttatgctttcacactgtcgactttagccttcactcctggtccccacctccactgggcccgcacacttcagtgttccttcagctagcagcaagacccattctttgatatgtcaaatcaatatcctgctcatacagaaaaacaaatatatattttaaaacactgcaaaaaaaaacagctcttcatataacttttctcaaaagtattcttcccaattcagactcctatgagaagcaaagcattaattcctcccgaaatatgctccttggatcagtgactgctgagtaacataagcacataaattttttctccaacttttattaacaaaatgaaatttgaagttaaaaaacatgagggttatttggagtttcaactgctgtgcactctggacatatagttgctcattaatggcagaaggcaggggcaacgtgaaggcacactaaccttaactaatgtttttctttgggaatatgtccctcatttagatttgtggactggagtgcttgaattccgctaacatacagccatgtatcacataacagcggggatacattctgagaaatgtgtcactaggcaatttcatcgtgcaaacatcatggagtgaatttacataaacctggatggtacagcctactatacgcctaggctgtatggtagagcctattgctcctaggctcccaacctgtacagcaggctgctgtactgaatactgtaggcaactgtgacacaatggtaagtatgtgtgtttataaacacgaaaagtacagtaaaagtacagtacaagagatgaaaaatggtacatccgtataaggtacttcccatgaatggagcttgcaggactggaagttgctctgggtgagagtgagtgagtggtgagttgatgtgaaggcctaggacattaatccacactaatatggacttcatgaactttatggactaatatggactttatgagcactgtacacttaggctatattaaagtcacaaaaatataattaaccttagctcaccataaattttttactttataaactttttagtatttttaattttttgattcctttgtaatattacatagctgaaaatgtaaacacactatacagttaaacaaaaaatattttctttctttatatccttattctataaggttttttttctaatttttatgaactttttagattttttgttagaaatgaagacacgagcacacacattaccctaggcttacatagggtcaggaacatcaatatcactgtctgttacctccacgtcttctcctgctggaaggtcttcaggggcagtgatatgcaaggagctgtcgtctcctatgataacaccttcttctgaaatcccttttgaaagacccgcctaaagctgttttatagttaacttttaatataagcagaagcacagtctaaaataatgatgaaaaagtataataagcacataaactagtagtatagtcatttattatcaagtattatgtacagtacataactgtatgcgctagacttctataccactggcagtgcagtaggtttgtttacaccagcgtcacaaacacctgcgtaacatgttgtgctacaatattacaatggcaacatcactaggtgatagaaacttttcagcaccactataatcttatggtgccactgtatatccagtccttcattgaccaaaatgcggttatgcagcacataactgtacttcctctaagcccaatggctcctcattgcccaagtgagagagcacaccagaccacccttgtacctctctacaaagaagggggagtggcaaagggcaggtaggctgctatgtccacagatgcatttaaagtaggggctcaatgcaacactgggccaataagaacattcatcaatgttgatcagcaccaggtggtgggcatatcataaatttggcttaaaccctgtgtaataaaacacaattttatgatcatgctttttagagaaagaatcagtgactgtgggaaattagaggctagttactatccagaacatgggttaggaaacagttatatgatctacatggcttacttgctatcagaaaggatggctctttatagaaagcacattaataacattatctttgtattcattattcatatgttcctttccagcagcaatgtacattaatttttaaagtaaaatatatcagcctgtaagagctgtagaggactttatgaagagaaagtagaggcaataggagatgatgaggtttaggacacattgcccaaaaatatggcacactgacatttgagaaaacagcagaagcaggaaggtcactctcaccttctcctcacccttctcccccgaagcaggtcataaaactctccttccagaggtgtcctcccaatacccagaggaaaagaacacccttatctctgatcaaagagatcaaaccctgttatcctccaatcacacttgtgtagactgtctatttcttcatcaaacacagcacaaaaatacacaggtttccctgtttctttgggtcttcatttctgaagactgccgtgtaacttaaaattgacagcaaataaacgtctacacttttcttttattaatcttttattttaggggccttagcaatgaaccttgtaatagatgagaaaggacattactttttctcccctacagagacaactttacttgcagaattcttgctctgtggttctaaggtagaaagctaactaatactcaaaaggatattacatccatgtacaaatgcatgtaaatatgtatacaaaaatgcacatatgccgacatatatataaacagaatttctaataactgcaaagcctgcagtaaaaggtgaaaaaaagattagataaataaatgcctaaggcagtacttgttataggtatgcccaaaaaatggtaataaatgaaaaaactgaaatgcaagagaatgtgactatttcagtcacctggagagtggtgtgttcactaatggaccacaggtaatgatagtaacacccatgacatttatctcagaccatttaattaaactatatggcatgagacattttttacagagccattctgacaccaaggccattttgactgggcttaaagaaaacaaaccattgaactgtttcgacttttaaaacattatccactaacatgtgctacagacagctgacctaatccctgatcctcaccctcccatcctgggcctgaagaagaggtggggagcaggctgaggtgagggtcaaggggaggtggggtcatggggaggtggaggtcaggagtgcagtagggctcaggggtgtctgctgaacatactgcttgatacattttttaaacatcaattttataccatatgacattgtaaaaacacataaatttggaaactcctagaaaagtttcaggtaaaaatggtagaaagtctattacaaatagcagcatggacagaagtggagataaagtaaacaaatacctttttaaaaagaagatatgtgtccaagagcagaggtgacaatgccacccacaaatgtgaccatttcccacatgcctatgcacatggactgtgtaatattccatcccatccaaggaaatcgctttaatggaaaagatatcacttaaaatttgggtcaaacgccctgatcaataagtgagactttgggtctgaaggagataaccctgagataactgtgggaaatcatgacaaaatgacatataattttagaaaaggcagtaaagaaaaacattttaagtttgcttgcttgaaagctacatgaacttgcatttacgggtgttccactgattgtacttaactttaacaagcattgcctttaacagtgaataccttaaagtattcaacagttaagaaaaaggaaagactattaaaaattatccacaacggctaaggaaatttcctggcctcttttcttctcctaatgcccaatggctgacccatcagcaggtctcctctgttctacttcccagtatctctcaaattcacttcctcccaaccccacctgcactcaaactcgtccccaccccataccctgggcaccctccgtagtgtggccagagtcacctttacaggctatacacctctctccaaagcttacagcgaaagaattacatgggaaaattgttccaaaacacatttacagggctcatctattgacagtccaatttttaaattccaatttaaaaagttgtagcttaaaaaattttttttaagttgtggcttagtaccaaggaacctgaattttcaacatggagtccagacaattttgatgtatgtagtctttagaacctatcttgagaagtgctcttattagattcaaaccctttatcattttcaaaagaaatcaaaaacacatgaaacttaatattttttaaagacccagtaacaactaacaaagcctgctgatgactataattactttccactcggactcgtttccttaaattaagacactaaataaattatggtatgattcacaaacaccctccaaaatgtttaggtaaagtgaagactgactatgacctaaatattcataagcatccatatgacactttctaaagttcccttggttctaataaagtactaataaagacagcactatggctagaaagacatctgtggacgtctctggggtttcatcaagcctcatgagtctaaaagagtgatgtgaagacaaaggggtcctgcagcaagcagaaggttcctgccgtcactcagcacctcagctcgaggaggcagagatggtttgcccacagtgacagctgtcctctgcagctagcttacatggcttcacaagtcagacctctctgttcaaagcaaggttacatcactgttgaaaaatcctcagttttcctgtcccttaacagggctcctgcaaatctttactattcaagcaatcttgtaggaaaagcactcgaatatacctcataagatcctagttgctttcctgatttcatctcagcagtctcaacaccttcataagctggatggagctagagagaagcaaagccagagcactgggagccacagcgggcagagccagcagcacagccctgtctccacagctcccacctgtctgaccacagcagcccctggcacagaaacacttggaagagggccactaccatatggtaagcactcatttggatattttgaattaaataaaacatattattaacactaatttatctgtttaagttttttaaatgtggctattataaaatttgaaagtgcacgtgatactcacactatatttctgtgagacagtgctagcttgcactcttacctgtgagataaaaaataaacttgtttttgagcttctgcacagcaaaataaactatcaacagagtagacagacaaacttacaggatgggagaaagtttttgcaaactatacatctaacaatggtctaatatccaacacatattagtaacttaaatctacaaatttgcagaaaaaaaaacaacaacaaccccattaaaagtgggcaaaggacatgaacagacactttataaaagaagacatacgtgtggccaacaagcatatgagaaaaaagctcaacatcactgatcattagagaaatgcacatcaaaatacagtgagatatcatctcacaccagtcagaatggctattattaaaaagtcaaaataaaacatgctggcaaggttgtggagaaaaaagaatgcttacacactgctggtgggcatataaattgttcaaacactgtgaaaagcagtatggcaattcctcaaagaactaaaaacagaactaacattcaacccagcaatcccattacagggtatatacccaaagaaatgtaaataactctatcataaagacacatgcacgcatatgttcactgcagcactattcgcaatagaagacatgaaatcaacctaaatgtccatcaatagtagactgggtttttaaaaatgtgctatgtatacaccgtggaatactatgcagccgtaaaaaagaacaagatcatattcttggtggggacatggatggagctgaaggccattatccttagcaaactactggaggaacaggaaaaccaaatactgcatgttctcacttgaaagtgcaagctaaatgatgagaacacatggacatacagaggaaaacaacagacactggggcttcccagagggtggagggtgagaggagggagaagatcaggaaaaataactcatgggtactaggcttaatacctggatgatgaaataatccgaacaacaaaccccgtggcgtgagttcacccatataacaaacctgcacgtgtacccctgaacttttaaaagttaaaaaaaatgtttttaagtacagcatagtttcaaagtgaatacaggaaatgccattattaattggaacacttcaagtgtttcacagctaaatatgtctgttaatggttccaggtagaattttattaatgcctggcacttgttcaatctataattttttcttttctgtgtgtgtgtgtgtgtgtttttttcaggcctttgataactttacaattcgattaggaactatctcacctttttcaaagcactccgaaaattaaatggcacaaaaatcatccattcactaaaggcttataaaatgatgaagaaaaagagcctttcagaactttgttttcacaattgttactaatgttttgtaactgttatttctgtggtcactagcctatttagattttcttgaattaattttaataatttatattttcctataaaattcatttcattatttttcccatatcttttatcatgttaaaaagtcttaaatttaaggaaaaatctcctctctaaaagatatttcatctctcatttcttacatttttaggcgtgtctttcttctctcctttattcttgattagcactggcaatcaataaccatattttaaattcattaattatattgtttatatattactgcttaatgttcttatatttattaattccttcctctattttttcaggttcttttttttttcctgagaaagaattgaataattagctgtttttttctttcttgcttaaggacaaaatttcaacatgatttataattgtaatactattgctaaggtcaaaataatccattctcaaagtttcagtttatttttttaatacaaaaagttaaaaggcatcatgttgttgtgttttatatttcaccataattggttttgggggttttgtttgtatgtttgcttgtttctacaagaggtagggttgcatggtgacagtggtggtaagggtgcagggaggagattatcaacctttcctggagtaatcctaaatgtcatgacaatggagttcttaaactagcactgaaataaaaaagagctagccccagtcaaaaaaaaaatcaaattaaatatattttactatgagcttaatttcaacaatcccatttgtaagtaataactataacaccactagacatggatgaaggctacgggtcactaaaaacaatatgcatatatgagacagcttagtttttaaaatcataagctcagctgggtgcagtggcttacacctgtaatcccagaattttgggaggccaaggcaggaggatcacttgagctcaggaattcaagaccagcctaggcaatatagcaagacctgtctctacaaaaatgtaaaaacaagccaggagtggtcacacacacacacctgtagtcccagctactcaggaggctgaggtgggaggatcgcttgagcccagggagcagagtctacagtgagccaagatcatgccactgcactccagcctgggcaacagagcaagagcctgtctcaaaaaagtaaaataaaatcatagactaaagaaaattagacaaaccaatgtgttttgtaaaactttataggattcaaaagctgacagatttctgaaagcacattgtttagtgaaatctcttttttggtcctcatatgaaataactagattatcataggaaatacccattaatcaaacctaaaaagtaacacatttacaaatcacagtattaattacacaggcaaaaccttccttctatgatgtttccttttgttttttcttttttggacacagggtctcactctgtcacctaggttggagggcagttatgcgatctttgctcactgcaaccttcacgtctcaggctcaagtgatcctcccacctcagcctccagagtagctgggactacaagcaggtgccactacccccggttaattttttgtatttttttgtggagatgaggttttgtcacgttgcccagactgatctcaaactgctgagctcatgcaatccacctgcctggcctcccagtgtgctgggattacaagctacaatgtttcttgaatttgcacatcatccatgttccctggctaaaccaatgtccaggtttcctatatttatatattacttgaataaagtaacattaatttgctcattttctgacacatttttcaaactgttgggggcagcgataaagaaatatgggcagtgattggaagactaaaagtatcccccaactccatcataatccttacatgaaatggtgaattcaggaattagttttctttttctactcatgtatactcatgaatttgtgcagcacagaagcagattcatacacacaaagcaattactagaaattctgactatattgagtacaaattttactttttagttttgtttggaaaaattccagacactaaaaaatcagaagcagcttgactatatactaaagtcaatacccaattcacattctagattatagttgtattgtagctgacacttgatataatccactggaacacaaatcttttggccattctctttgtactgccctgcatagttcaagttatattaagagttgtgagcacacaactctggcaatatccttgtgaagtggattcaccaatgtaattttaccttaacaacgaacaagggcagtggaaaagaaagtgtgactactggggtcactgaggagtctgtggctgtgcaaagcaaatttagtacggaattcctcctgagaaagtcacatgacttctaaaacctgaattatattcaaataattcacataattttgttttttcttttttttgagacggagtttcgctcttgttgcccaggctgggcagtgcagtggtgtgatctcagctcgctgcaacctccgcctcctgggttccagcgattctcctgcctcagcctcctgagtagctgggattacaggtgtgcaccaccttccccatctaattttcgtcattttagtagagatggggtctcgccatgttagccaggctggtctcaaactcctgacctcaggtgatccaccagcctcagtctcccaaagtgctgggattacaggcatgagccactgcactcagcccgttcacacaatttttaagcataaaattacataaagaataaacatattaaatatttttttaaatgcactgtcaccatttaaaggaaattccacaaggaaattacatgtagtgttagaaaacttggcaaagtttgataactagattttggattccagatacttttagatgaagctatatcaatgtttccataatgctatacccctgggttcatactgagtaacagcactaaaaaatgtatggtgcaatcactctgaaaactagcgttcaagaagtcaacagccattattcatgtgtacacattctcacgtgctaacagtctctgatgaccaagaggaacctcatcattcaaactgcaaagatcaaaaaactggttaagctttttatgtcctgtatgagagatctttccctaccttaaggttatgaaaatattctactctatcatgttttagaaggctaattattttttctttcacattctataatccatgtagaaatgttatagatggtataagaattttttccatatggccagcatcaattattaaaaagataagtccttcccaaggcactacacaaagtccttaatactctgttccactggtctatatgttactctcaggccaatgcctcactgttttaattaatatgacttaaaataaattttactaaccacctgagcagttcttcccccatgctatgttttccttcaagactgtattgacaattcttgtccctttgcatttacatatatattttgtaatcaacttatcaatttacatattcacatatgcatctgctgaactgcttataaatctacagatgaattaggggagctacatattagtgatattgagtcttcccactgatcaccatcatattacctactttctcttaagtcttctataatttcctctcaataatgtttttcttcttgtgatcttgcatattttttactgcttctaattgatattttatgctatcataaacagcatattttcaaatttttcttttctgtttgttgttattctatagaaatacaactgattttatccactgtattgactttgcatccagcaatatttctattaaggactgaatgtttgtttcccctcccaaaataccaatatggggatggagatgggcctttgggaggtaagcagggttagatgaggcatgagggtgggggactccacatgggattcgtgcccttatgagaagacacaccagagagcttactccctctctctccctgccacatggggacacgacaaggaaggaagcgagccctcaacaagaactgaatttgccttgatcttgtgacttcccggcctccagaactgcaaaagtaaaaacttctgttgttgaagacacccagtgtgcagtattttgttatggcaacctgagctaagattaatgccaaaaattatgtattattccagtaatttatctatagattcattaggaatttcctttgtttacaatcatatttatctgcaaatatgagagatttcttcctgagatcatattttgtttacttatatgcctaaatgtattgggtatgtcctccattccaatgtcaaatacatatggtgttagagggcaacgctgtctcatttgctgtatcagaaagatttttataattaagtagaatattctttacacacattcttagcactgcagtactaagcagaataatctcccccaacacaaatgttcatgttctagtcctcagaacctgtgactatgttatacctcaaagcaaaagggactctacatatgtgatcaaggtaaggatcttaagatggtgagcttgccctggattattacccagatgggcccagtggaatcactagggtccttttaaggaaaagagggaggtagtagggccagagtcagggaagatgctgtgatgacagataaaaaggttagagcgatgcctcaaaaccgcacaacaacatggagactgaacaacctgctcctgaatgaccactgggtacataacgaaatgaaggcagaaataaagatgttctttgaaaccaatgagaacaaagacacaatgtaccagaatctctgggacacatgtaaagcagtgtgtagagggaaatttatagcactaaatgcccacaagagaaagcagaaaacatctaaaatcaacaccctaacatcacaattaacagaactagagaagcaagagcaaacaaattcaaaagctagcagaaagcaagaaataactaagatcagagcaaaactgaaagacatagagacacaaaaaaccctttaaaaaatcactaaaaccaggagctggtttttggaaaagatcaaaattgatagactgctagcaaggctaataaagaagaaaagagagaagaatcgaatagacgcaataaaaaaatgatagaggggatatcaccaccgatctcacagaaatacaaactaccatcagagaatactatcaacacctctacacaaataaactggaacatgtagaagaaatagcataaattcctggacacatacaccctcctaagaccaaaccaggaagaagttgaatctctgaatagaccaataacaggctctgaaattgaggcaataattaatagactaccaaccaaaaaaagtccaggaccagatagattcacagccgaattctaccagaggtacaaggaggagctggtaccattccttctgaaactattccaatgattagaaaaagagggaatcctccctaactcattttatgaggccagcatcatcctaataccaaagcatagcagagacacaacgaaaaaagagaattttagaccaatatccctgatgaacatcgatgtgaaaaacctcaataaaatactggcaaaccgaatccagtagcacatcaaaaagtttatccaccacaatcaagtcggcttcatccctgggatgcaaggctggttcaacatacgcaaatcaataaacgtaatccatcacataaacagaaccaacaacaaaaaccacatgattatctcaatagatgcaaaaaaggccttcaacaaaattgaacatcccttcatcctaaaaactatcaataaactaggtattgatggaaaacactgcattttctcactcataggtgggaaatgaatgagaacacttggacacagggcggggaacatcacacaccggagcctgtcagggggtgtggggctgggggagggatagtattaggagaaatatctaatgtaaataatgagttgatgggtgtaacaaaccaacatggcacatgtatacctaggtaacaaacctgtacgttgtacacatgtaccctagaacttaaaatacaatttaaaaaaaacaaaaaaggttagagtgatgcaggggccatgagccgaggaatgtaggcagcctctaaagcttcaataggcaatgaaatacattctcccctggagcctctagaaggacaccgcctgccagtgtcacctatgttggcttcaggtctcctgtaagaaccataagacagtaagtttttgttgttttaagccactaggtttgtagttatttggtagagcagcagtagaaaacatagatatggcagattttttaagttcctttattatcaattttctgcttctggtaaaagcaccatataatttttcatctttatttagataacatggtaaaatacactaattgattttaaaatgttaaaccatctatatattccgggaataaactcaattggctaatattatgttaggcttattatatataactggcttttatttgcaggattttttgtggggttttttggtatgaaggttcataagtgagattggtctgtaatgttcctttctctaactattctcactaagttgtaccactttataaaggaagttgagaagtattccctatttttgtattctttggaagaatatgtttaagtctggtgccatataccctaatctaagcatatattaaaccacatgatttggcccttagctaaagtgataattgtgttgtttaaatcttccttcttttccatctgcttctagcaggtattaagaaaagtgggctggctgggtgcagtggctcacgcctgtaatgccagcactttgggaggcctaggcgggcagatcacgaggtcaggagttcaagaccagcctggccaacacggtgaaaccccatccctactaaaaatacaaaaattagtcgggcgtggtggcaagcacctgtaatcccagctacatgggaggctgaggcaggagaatcgcttgaacctgggaggtggaggttgcagtgagccaagattgcaccactgcactccagcctgggtgacagagcaagactctgtctcaaaaaaaaaaaaaagaaaaaaaaaaaacagaaaagaaaaataggctaaaatctcctgctatgtttgtaatttgtctacttcaccttttagttcagtcaacttctgctttatatggtttgatgctaggttaaatggagacaaatttagaattgttatctcttcctaagaattgaacctttatattacaaagtatctttctttaccggtagtagtacttttagctttaaagtccctgtattttctgatatttaagacttcggaaaagaagttatctctaagctgaaagttaaaggatgggaagaagtctgttgggtaaacagagagaaaaacctccacacagcaaggtgtgcttggtcctgacaaggtcctgaaggcaaagagaatatggctctttcatggaactgaaatatctttgccatctaaaatctgtgagtaagaacaacagtctccaccttacattccttccttggtaacagccagagtcctaattttgttctggtattcactcttccaggtggtcaggaaacacatggtctagaccaagagcatagattattatggttgcaagacaattgtaagaattctcttcccccagccagtggaatagaatacaggagaaacttttaaaagaggttttctcctctaataccatcatggggaaaaaatccagatatctggagctgtagcaaccactttataagaatgaggaaactagccctaggaccaagataatacaataagactgtcaggcccaaacaatagaaagagcctctgtctacactaacactgctgacctagacctgtgtccaactttctgctttataagcttataaacttctcatcgttaggaaacttttagctaagttttttctgctccttgcaactgatgcaagatccttacataccactttttgattgttttttaaaattcccaatgttaaataataagagattgctgaagaatatttcccaaattgtataatctacacaagaaaatatatatttttactgtttccccatccattgatacatgcatattacataattgcccaaaatatttagaaatgtaaattttacattatcaaaaaataggccttatataaaatgtaaatggtaaatatataacgatttgtaaatggtcaaatatataaccattctataatccttaaaaattaatagtcttacagtgattctatttgaaagtacagtttccatgtctggtcttgacaaagggaaagtacaataaattaagaaataagacataaaaatgaatttaactaaatcccagaaaaacaaccacacaaatggcatatacacaatgcagcctagaatgagacatttcaaaattaaagctcttatggcttttctgagatttttaaacaaattagcaagtataaaaagaaattaaatttttacatttttcattattttccacattgaaacctacacttattaactttttatagttgtcctatcaaattttgcatcataatagttcaaatgagaaaattgtagaagagtgagacatacattatctaataaggtacttattcaacatactaaaatttcacagtacataattttgagaaataagggattaaacacactgagaaaaattttttccagttcctatatgatcaagcagaaacctttgattttttaaactataatcaagaaaataaagataaaatatttctaataatggataggcattgctaactaggttaacattatgttaactaagtaaatagttgggcaattctctaggcaaattaagcagagtttacttttcctcctattacatacacaattatataacacaagagttgttagcaggtcaaatgtttcaatatataaaagaaagcattctaattcctataaaaaccacatcaaatgtgctcactgaaaattcagaataaattatattcatgaaagacactaaagttacaaaagaatacattcatttatcagggaaaatgaagcaagagttgtaaacctccactgcagggtgttaggaagcagaaatttcattagttcttcagcccgaaatgtaacctttatagatgtcttcttcacaagaaacatctgcgggtattaaaaaggaagatatccagaagagtcctctccagaagaaattttaaaagacctatttttaaattgcccacatatagtaactataaaccatgaatgacatctaaaaacaaacaaacaacaataacaaaactagctaagggcatctgagatcatcaaaagtgggaagattctggaagggaagtgacacttgcaataaagataaaggaatagctctagtgaatttcctaatttttatgaatttgcaagctccacagataccaaaatctccaatagaaaacccattgtcttactggcttgaagaaccaaaggacagagtttaaggcaaccatagctattggaaatgaggttggcaataacagtgaatcccagcaaagagacagacctagagaagacgatgcataaattctgtgtataaactctgcccaaatctctggctgacatttaaaccagactaagactaaaacaaacgaagtatgatttcagttaccacccatgagtctgagtttgcagtttgagtcaccaaaattaattttttacccagggggggaaaaaaaaaacattgttggaacaaatgtaacagaatccaggaaaacaaaaacaaaacaaaacaaaaaaaaccacatgatccattttcagaagaaaatcaatgaagactgacccctgaccctgagtagacccagatgttgaaattagcagagaaggatcttcaaccagctgctataagtttcatcaaggttatacagaaaaatatgcccatgatgaatgaaaggaatatcatcagaaaaaaatctgttgtaaaaaagaatctaataaaaattctaaaactaaacaacatcatacggatataaaatcgacattgttaagcagcaaatgggtttagcagattggtgatgacagagtcagtaaagactttcctgtaaagatagagcgataaaaactactgaatctgaggaatagagagaaaatgtatcaaacaaaatgaagagatcttaagaacctgtgggacaatattataacattcttgtaattgggctcccagagaagaaaaaaaaagagagagagagagagaatgaggcagaagacatatatttccctaaaaggatataagtcataaatctacagattcataaaggtcagcaaatcccaaacaggataaatacaaagaaagccacacataggcatgtcagtcaaatgaccatcaacaatgaagaaaatcacctaatcgttggctggtccactatttactatatgacattcacagtcttcctacttactatcatgtctggccatgatgcttctggtatttgtacagtccagaatcttgccctaaggatgtcaaattactgtattctctttcttaaccaatttttcccttaacctcataggttagcatttagggctgagtggttaacggagaaaacactaaattggactccccttggtttatattccttgccacattacctaaaaaggactaactaactctgcggattaggcacagaactgtagattaaatatcaggatagtcagtatagcacagtggttattaggctggggtttagagtcaagtgtgtttaaatcttagttttgtgattttcttagctgcctcaaaatcatgccccaaaatacctactatgattcctgttatgaagattaaatgcttagcactgtccctggcacagagaaatgcccaatactcgcttgaaattaatactcatcattgtaatttttcagtttaaagaaaagaccaaagcattccactttatttttaataattaatacatctaattattagcatgtcataaatgaatgtaagacatcatcaatgtaagataagattttattttatgcaccacacagaaagaaagaatgttgccaactgaaccaaaacattctactgcttgtatgtcaccaaataagaaacatatgtctcctgattccagaggtaataacaagtacatcttattaaataagacacatataactccttcaattatcacaaattaagctctacaagatagatactattatccctaattttcaagtgaagaaattgaggtccacaaagttaagtaagtccctaaattacaaaggtggtaaacagtaaggcaggattcaaagacaggcaaactggtttcagagctcttgctattagccactgcacatgtaagtacctctgtttttcttgagttccatctttttattaactttgaatgttcaccaataccataagcctcaaatctgcacaagaataatgtcagactctgacagatgtaaaagagggccattccatgctgtgagatacaaaatgtgacatctattatttattacaaatttcaacacaagagaccatggttttcaaccctggctacccatcagaatcacttcaggtgcttaaaaaaaccgcagatgccaggaaataaccccagacttactaactcaaaatctccaggattagaatatagagatatgcacatactttaatgctccaaaagtcactctgccacatggctggacttgaggaccaatcaatcttaaccaaccaatcttgttttagaataattttttttccattggtatactctctgttactcttactaccattaatctgcaaccaggtaataaaaagttcactttacaccaaccaaaagtattctgatgttaatatgatcttaatttaacctcattatattttttaaaataaaaaaatgtattactggtatatttgagactgctgagaaagggaatttccatttctgtataaatacagcattactgcccatttaatatgaatacactgtgaaatgatcaaaatgtggcagttcctagcctgatgaggaaaatgaaacaaagtgcttttgaataaaacaatgtgtttgtcaaactaccacctcggtgacaaacactgaaagtgcctgcttggtaatgccttcccaggccaccagccttacttcctaaggacatcatccctctctcaaccacagcacatggcaaaatacagtgatgttcttctgtgtttatctcacccactgatactatcatgagaccctcccagggagaggtctcatgataatatcttctacatgtagttcagtgtcagaacagagtagaaactcaacaaataattactaaatgaatgaacaaattcttcctctaattcatacttgacacttacatcactgttttacatatatgtacacacatattttttaatagaacttaatttccccaacttcttctttttccaagtacatctctaggtgaaaacctcacactttaattgcctgtaatgttgaattactcatgtctttgttacccactcttgccaagaaattaacaattccaccaatatctattctcaaaatcatactcttccttcaaaacacaaattaaactgcatctcttccatttaaacttgcctgactccctcaaataaagtgtcactttaatcatctgctatagtaaaattgaagaaataaatgcagggaggtatggagaaataattcatggaattcttatttttcagagtactggggatcaatatcggactatagccacactgtccagcagaactttctgtggtaatagaaatattctgtatcaatgctgtccaatagccacatgtggctaatgagtacttaacatgtagctagtgaagtttaagggctaaatttttcatttcatttggctttaattaattaaaatataaatcaaaatagtgcacatgacaaccaccttgggcagcacgggtctagaggcacttcggggtacaccacagagaaacatctccagcctcaacccactcaatctttatattagcattaatacctcacatcaagtgtttcaatgataaaaagctgaaaaggggctaggcacagtggctcatgcctataatcccagcactttggaaggccaaggcaggcggatcacttgaggtcagggtccgagaccattctggccaacatgatgaaaccctgtctccactaaaaatacaaaaatcagccaggcgtggtggcatgtacctgtaattccagctactgaggagaatcacttgaacctgggaggcagaggttgcagtgagccaagatggcaccactgcactccagcctatgtgacagagtaagactcaaaaaaaaaaaaaaaagctgaaaagagaagttaatgcattagaaggaggaaaaatgtccctaaaaaagatactggtgccaagataccagtacgagcggtatctagcacatttaataaaaatgagtaaaaagagactaaaacaccaaacccccaaaacaagccaaaaccctcatgagagtgtagagctatccgaaggtagaaaagaatatcttgagaggtagagagttccatataacccaagatgttcaagaatctctccaactaccatattcaggattcctgggaagggatgtggagcctgggagcaatgtgtggaatagcaaccatcaaagtctaagcgtggaagtccagcagagatcaacggagtcaagacagaagaatctgcttttctaaatattgtcatgtgagtcagagcgacggctgcgaaggagatccagaccttccgacctccgatccattctgcccactagactaggggcatccatcacacacttcaaagttgtttaaaaggtcctagatttcagctaaaattgctggtagtgacgtccattaaacatgtcatcaggccgggtggcacctgtaatcccaacaatttggggggccaaggtgagcagattgcctgagttcaggagttcaacaccagcctggccaacacggtgaaaccccatctctactaaaaacacaaaaattagctgggtgtggtggcgggtgcctgtaatcccagctacttggaaggctaagccaggagaatctcttgaacctgggaggtggaggttatagtgagccgagatcacgcctctgcactccagcctgggcgacagagtgatcctctgtctcaaaaaaaaaaaaaaaaaaaaaaaaaaaaaagtcatcatgtccagtgtttctttatgaacccaaaagaggtgtatatttgaaaatatgtaatttatttgaactattgtttttttaatttgaggcatattaaaaatctgattagaatattagaaaatatttcacagttttgcctacagagctcattatcatccgcttaagtgatgttttagaaaattattcacttatttagcaagacttaaaaatgcactactggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaaaaatgcactactgttcaactcctaaagaaaaaaaaatgtatttaatccttaaatactttttaaacttaccaaccccaaatatataataaataattctgacagggcgaagctcagagacactggcccccaaaaatttgcatagtaataaatatagtcttctaaatgaaagtaggactgccccattctcaacattggtattagaatctaccttttgaatttctttacatttatgaaataagctttattaacgaaatgacaacaaataatataaccacattttcaaaattaaaaaaaatacataagcaaataataaacctccctcattttttcactaagctacgttttcctttcttcaaaactgttctctgtagtcattaaaccacagaagggacatcagtgacacaaacacccatgtttgataggtgaaaaactgactgggatcacttgtccagcctcccaagcaaggcgaccctggcgtactgttcccgggtccctgcattctctgcccctctgctccacactgctcatcacgactgccttgctgctttgactccagaagaggcctccatgatgctcgtttttcgtttttttgttttcttttttccttaaatacacaacaggaagcacagcttgaatattcatattttattttaaagttcttgaaaacagcaaaacaaaatgaagctagctttgaagtgctgtgattacacagaaaatctccttccattcattcaaatcatgatgactgggcacctacgatgggccaccaccatttgagacaccattctagcttatccattctaggaggtgctacacagataaaaatctctgccttaatggacctcttatactttagtgtgggaagaataaacaacagataagtgaaatatgtagagtacgttagatagtgataaatgctatggagaaatgtaaaagcagagaaaaggatgaggtatgagcagactgcatgtcaaacaaggtgagggaacacgtcactgagaggtgaccaaaaagaaagaagggggccgggcgcggtgactcacacctgtaatcccagcactttgggaggccgaggtgggtggatcacgagatcaagaacatcctggccaacatggtgaaaccctgtctctaccaaaaatacaaaaattagccgggcgtagtggcaggcgcctttaatcccagctacctgggaggctgaggcaggagaatcgcttgaacctgggacatggaggttgcggtgagccaagatcgcgccactccagcctggcaacagagcaagactccatctaaaaaaacaaaaaaaaaaaagaaagggaaagggaaagaaaagaaaagaagcaagttgtgaaggcgtctgggagcagaaggccgtgaggcaggagcacggttgctgtgtcctgggtctgcaagaaggccagtgtggctgacaccctgcacccgaggtcatagaggaaaaggacgggaaacgaaggtggaaccagaccctggaaacccttgcaaacagaccagctgcttgttcaccgcctttaccacccaccatcctcactcacaccctgtctccctgaacctcacacatctgagatgagatgaaatcaagtaagaagtcattatggtattttgaaaaaaagaggaaagcatttttccatgaattggcagtttccccaaatctatcctcaggtgtatgaaaatcagtattaaagatctgaggtgggccaggcatggtggctcatgcccgtaatcccaacactttgggaggttgaggcggtcggatcacttgaggccaggacttggagaccaacttggccaacatggcaaaaccctatctctactaaaaatacaaaaaaactagccgggcatggtggtgcacgcttgtaaccccaactactcaggagacagaggcacaagaaatgcttgaacctcggagacggaggttgcagtgagccgagattgtgtcactgcactccagcctgggtgacagtgcaagactctgtctcaaaaaaaaaaaaaaaaaaaaaaaaatctgaagtggttaccaaccctcattatttgaaactacctcagttggaatgatcattacagatgcttattacagccccaaataaaacaataggagactagagggtagaggaagaaatatgtgtgttgacataaattttatctcattagtcattatttatctttacaatacattaaaaggattcaaatgtttttacagctttgaattttgactttaaaacctgaaatcctaagccacagcaaggtagttggcctggattatatcctagtgctacaagttcggcagctgaataaaattgagaactatatgttaatcattcactcaatattttcttgaccacaattatgcctagatcagcacaagaaaccaaagaaagcctgccagcaatattccctgcagcaggtcctgaggcaattttcccatctgtggtcacaggaggggaagcttcttagtggcccaagagaagcatctacctgaggcgctggatgggcacctgagagtcctgcatggttgcatgcagcagtcgctcttctggggcattgtctcccttcaataaatagatctatctactgcaaaatctcacagaacgctacaagtaggtccaactcaaaaacaaaattcagactgcataagggatcgttctgcattgctgacctgaaacatctgtgccttgtgacaaaaactaggaagagggatcccatacacttaagatcactgggactgacgtggatatttgtgaagatgccaagaagaaccgtgacagatatattgtcactctgcaataaaattagaaaaaaaaatcctcatgccataatgtatatatacataaactgtatccaaaaatatgtggctggtaaaattttaaggccaatcattcttccttcattcattcaaaaaaacaaaagtcaagatacaaaaatagccattttctttgttgatccaaaccaccaagttttaaatgtcaatgccttgattttatcttaaaaagaagttaatagcattagtctaaaacctgtattcagagataaatcataatagaaaggaacaactggcaacaaaaagactggagttttaaaattctcatgactacctgtgatttgggacaaattaattaatgtttctgagcctcagttcatttacctataaaatgaagctagtaacagctctttctcacttgtaagggttggcaatatcatacacaaagcatctagctctcagtgaacagtagctacagcattactgctaccaatctgtgttagaatttgcttttggtgagatcctatagacagggcatttgctatgatgagccagagatacaaattgtggcacacaagcccaggacaaggtttctgtttgtctgcttcattgctacctcccccatgcatggcacagtgcctgaaactttaaaggtatcaaataaagatatttttattgaaaagtaagaaaaaaagataaatcactacccctgtggagtattataataaatctcaaatttgggattggcctatcacttcctgttgtaatagtatactctggtacttctggtactgaagatatctaatcagcaaaagttttaatttcttaaggaattcatttacctgaaacggtaagatctgttgtattttttcaatttgtaagtaaatacatgtcaagacattctgtgtgtgtccaaaaggccaagaaatcacaaagcacaaatattcacagccataaacacagtggctgtattcctcataatgggaaactatgtaaaaacaaaccaaaccaaaccataataaatggtaagtataatattaacaccaaaatgaaactataataaatgttaatatgtaaaatgtttaagaaactgctaacactacagttaaaacctttatgaggctagctctcacaggcatgttccaaactcaataaaagaggtgaatgccacaatggctgtcagaaacatgcaagtcaaaacacaatctagagggaacaaagcattcgtggagcccaaggtctcggcagccctaaataatatcccacctgtcattatgtcaaacaatttggcccacttccataacaagacaaaagtcacttttgttgcatgtcaaatgtggagtgagaacgagccagaaaaagctgtttgaaggttagaagtactatgagcagtttaaaagaacagcaataaataaaacttgttaatgcccctaacactgctagtcaaaaatagtcatgaattaacagatgttactagtataactacatgcccaagtgtcgggcaaattgagttatctaaataggtgatctacaaataaagataggaagaatgaataattaataacagaccatgtggaaaagagatctcacacatttaaaacaccaacaaaaggcacccaataaaacggctttcagaatacaaagagtagatctcatattttcatcacctgaaaagtagaccctgcataagttatgttttcattgatccaagtgatactaaaagtttagagaagtacttcagaatttttaaaaattaaactttgttaataatcacaaattatacatgtaattactatatttttcagtttatcaaatttagtaaaattattttggaaatcagaataagaaataaggccaatagaaggtttacaaaaaaccgaagtgtgggaggaggaagagcagagggagagaaaaagtatattctgaccaatcatgcttacatacttgatgcaaaatccttcttgactgaatactttcccattgtttttgtccctggggcttgctgacagagacattgtgtccatgtgaagggaaaacctgttttttcccccacctaggatcccaaaggacctcctccccgattccctacaatttcttctatattacccatgccccttcatcccactctggccaagtcacccaggctcttgcagccctgttgctgacagttacacttcccgacacaaggcctgatgttgaggtgagggcagcctggtcagttaatgaagctggcatggggagaagaaaggaagcccttttcagaaaacctaggctgatttcgtatgagctgattctttggggatgccacaatagaccacttacagagtgcttttggggagggagatgtcattctaagcatttcacttatattcctataaagttcacaataacccaatagtactgttatggataaggaagctgggaacaaaaaagttaagcagcttgctcaaggtcacaaaaatcagcatgtggcacagaaagggctcaaaaagacagcagtaacctctgcagacttaaatgttactgtctgacagctttgaagagagcagtggttctcccagcatgcagctggagatctgaggacaggcagactgcctcctcaagtggatccctgacccctgacccctgagcagcctaactgggaggcaccccccagcaggggcagactgacacctcacacagcctggtactccaacagacctgcagctgagggtcctgtctgttagagggaaaactaacaaactgaaaggacatccacaccaaaaacccatctgtacatcaccatcatcaaagaccaaaagtagataaaaccacaaagacggggaaaaaacacagcagaaaaactggaaactctaaaaagcagagcgcctctcctcctccaaaggaacacagttcctcaccagcaatggaacaaagctggatggagaatgactttgacgagctgagagaaggcttcagacgatcaaattactccgagttacaagaggacattcaaaccaaaggcaaagaagttgaaaactttgaaaaaaatttagaagaatgtataactagaataaaccaatacagagaagtgcttaaaggagctgatggagctgaaaaccaaggctcgagaactacgtgaagaatgcagaagcctcaggagctgatgcgatcaactggaagaaagggtatcagcaatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtcacggggagaatggaaccaagttggaaaacactctgcaggatattatccagaagaacttccccaatctagcaaggcaggccaacattcaggttcaggaaatacagagaatgccacaaagatactgctcaagaagagcaactccaagacacataattgtcagattcaccaaagttgaaatgaaggaaaaaatgttaaggacagtcagagagaaaggtcaggttaccctcaaagggaagcccatcagactaagcggatctctcggcagaaactctaccagccagaagagagtgggggccaatattcaacattcttaaagaaaagaattttcaacccagaatttcatatccagccaaactaagcttcataagtgaaggagaaataaaatactttacagacaagcaaatgctgagattttgtcaccaccaggcctgccctaaaagagctcctgaagaaagcgctaaacatggaaaggaacaaccggtaccagccactgcaaaatcatgccaaaatgtaaagaccattgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatgaagatctaccaagcaaatggaaaacaaaaaaaggcaggggttgcaatcctagtctctgataaaacagactttaaaccaacaaagatcaaaagagacaaagaatgccattacttaatggtaaagggatcaattcaacaagaagagctaactatcctaaatatatatgcgcccaatacaggagcacccagattcataaagcaagtcctgagtgaactacaaagagacttagactcccacacattaataatgggagactttaacaccccactgtcaacattagacagatcaacgagacagaaagtcaacaaggatacccaggaattgaactcagctctgcaccaagcggacctaatacacatctacagaaccctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaattagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaacataccagaatctctgggacgcatgcaaagcagtatgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctgcttttttgaaaggatcaacaaaattgataaaccgctagcaagactaataaagaaaaaaagagagaagaatcaaatagacacaataaaaaatgataaaggggatatcaccaccgatcccacagaaatacaaactaccatcagagaatactataaacacctctacgcaaataaactagaaaatctagaagaaacagataaattcctcgacacatacactctcccaagactaaaccaggaagaagttgaatctctgaatagaccaataacaggatccgaaattgtggcaataatcaatagcttaccaaccaaaaagtgtccaggaccagatggattcacagccgaattctaccagaggtacgaggaggaactgctaccattccttctgaaactatttcaatcaatagaaaaagagggaatcctccctaactcattttatgaggccagcatcatcctgataccaaagccgggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaactcaacaacgcttcatgctaaaaactcccaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctgaccagggcaattaggcaggagaaggaaataaagggtattcaattaggaaaagaggaagtcaaattggccctgtttgcagatgacatgattgtatacctagaaaaccccattgtctcagcccaaaatctccttaagctgataagcaacttcagcaaagtctcaggatacaaaatcaatgtgcaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggaaaactacaagccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactctcttcacagaaatggaaaaaactgctttaaagttcatatggaaccaaaaaacagcctgcatcgccaagtcaagcctaagtcaaaagaacaaagctggaggcatcacactacctgacttcaaactatactataaggctacagtaaccaaaacagcatggtactggtaccaaaacagagatatagatcaatggaacagaacagagccctcaggaataacgtcgcgtatctaaaactatctgatctttgacaaacctgagaaaaacaagcaatggggaaaggattccctatttaataaatggtgctgggaaaactggctagccctatgtagaaagctgaaactggatcccttccttacaccttatacaaaaatcaattcaagatggattaaagacttaaacgttagatctaaaacgataaaaaccctagaagaaaacctaggctttaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaatcccatcaaaaagtgggcgaaggacatgaacagacacttctcaaaagaagacatttatgcagccaaaaaacacatgaagaaatgctcaccatcactggccatcagagaaatgcaaatcaaaaccacaatgagataccatctcacaccagttagaatggcaatcattaaaaagtcaagaaacaacaggtgctggagaggatgtggagaaataggaacacttttacactgctggtgggactgtaaactagttcaaccattgtggaagtcagtgtggcgatccctcaggtatctagaattagaaataccatttgacccagccatcccattactgggtatatacccaaagaattataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataataaatgatgagttcatgtcctttgtagggacatggatgaaattggaaatcatcattctcagtaaactatcgcaagaacaaaaaacaaaacaccacatattctcactcataggtggcaattgaacaatgagaacacatggacacaagaaggggaacatcacactctggggcctgttgtggggtggggggaggggggagggatagcattgggagatatacctaatgctagatgacgagttagtgggtgcagtgcaccagcatggcacatgtatacatatgtaactaacctgcacattgtgcacatgtaccgtaaaacctaaagtataataataataaaaaaaagaaaaaccattatcaaaatattctgaaaagcaaatttatgatatagtaatacatatcctttaagatctagcaatctgatggatgaggtcacaagagctggggctggaaatgtcataaaatatatgaactgaaaacacttctttatatatgttatatatgtttaaaggcattatcaatactaagaccaccatatagcaaaagtcagatgtctcaaaagatggctctaaatactcctgatccagaagctttcttcagtcccagtgcacttgacctcactgaaactccagggtcccaggacgtcctcacccatggctcctaagaacccacgcttacctgcaactcctacttttccatttctgttccttctgcagttcttccaattcctgaacacagatatgtccaaaggattcccatcagagtgtatatcataaaaccagtatcctgtggaacactgcttagtaaattcctgactggctctcctggtctttatctgccactaccacacaccacatttactcttagtgatatttcctcactcttgtctacccacagaagacatgcccttgctccagaaatgacacccagaaaccctaaacaacagaagagattcccaccaagcagagggaaagtgctctttttccaatggcttgctctgtctcttgtccacatacacatctgttctgaagaacatgagttgccaccaagcattccctactgaacccacatcccagatgttaactggatcaaaaccagaataataaacgtcaaatcctaaattccctgttaaattacctacgaaacccaaatcagaaatttttaagataaagtgcacagggcatttcagctgtctttatttttctttctacataccttttctacttcttatcctgatgaattggtctcaactaagaaatcacaaatgttccttttatcccattagcataaggggtgacaagagtttgtcctgtgtgagacactcctttattcctttccatgagcccatgtgacgtactagataataaatttcttgagaacaaagacaatgctgtacacatttgtatatcccacatggctacctcttaattaacaggagctcaataaatgctacaggtgtacaagaacaacaaagtaaagacactaaaaatgtacccaaaggcagcatctctagcaaagaaaaagcattgcatcttcctcaacatttaacaactgaaaaagctatgaaaaacaatgacatacgggatacttcacatttaaaaaaaaaaaaaaagaacaaaaattctaaaccctcaaaccccaaacctccattcacggacctgtagtgccatagttgaagtgtctaagatagcaaaaaggcaaatgattgcgaagactgaataccaattccaagacggtccaagctcgagctgcttatgccaatgtttcttactttgaatgtgatcttgggaagttcacagcacatacctatacctcactttctttatgtctaaaatggaaacactttgattaaagcaacgaaggggggaaaaaagagtaaaagtgatgaaaaagccttctttgcattcgtagaacaattctttattagcgaagaaacccacatgtgagtaagagggttcttgccaggcaggggcgtgtgtgcatgtgtgtgtgtattgcatgtctgtgtgttgcttgtctgtgtttgtctgtgtaggtgtttggccatggatacaatttacatgcttaacttttcctttacacagtaggaaatgtatgccttagaacaaagccactattaatttacatttaaaaacttttgtttctacaattgagatccagtaaaatgttcaaaattctaaaagaaaggggagcaaatctcctttaccttcaataccataattcatgaaggttccaacagttactcctcgtgaatatttgaagaaaagtaagatatctacaaaggcttaggatgtctgaaggcagcctgcctatccttttcattttaaataaaactgatcaaacatggattattgctccaaaatatgctggaatttccaattctctcaaagctattaggagcatgaactctaagttttagtttcataggagtagggagtggattctgggagttacagttttgtttttgggtgaccaatttctgcaaactgaagttaaggaaagatactggctgtcatccaaaaccaatcttcttacaatttcatcattttaggacaagcagtagatccttcacactgcatggaacaaaatcaatagaagccaagaacaacaggcattgctctttcaagaccatttcatcagcatttagcagaagcaaacacaatgaggtatctataagctgcaagaataacaacattttcactttgttattcactgtgctctaacctgaaccccatcttcttgttccaaatgccatttcaatacttgaaattgctataactggtaaaatcacaaacacatttgtgaatttctatttgcttaaataagctgagtgtgtgacctttctctgtctcaggttcagataatcttcattaatagactattttctttttgcaaatattgttttaacccatctgaggctcaatgtcccttccctagaaataccaactaatggttctgtttccaccatgggatgtttaggttagacagtcagtgcacagggaaaattaacacagcctccacctgatgcagaccatgttaatttctgcccgcaccgctttgtgccgaatgcaccagtgcgccttggcaacagctctgggccccggagaggcaccttttctaaatgtatctggttactcttcatcatcgtggcatcctggaaaggcagagcatcagtctgcagaataaaaagaagccacttaccagatgcataaaaaaggaatatctttagtattcagaaaatgacactctgtttataggctgctttaaaaacaaacaaaaacttttgttgatacatattttacatattttcagagcacatgtgatattttgctacatgtatagaatgtgtaatgatcaagttagggtgtttggggtattcatcaccttgggtatttatcatttctatgtgttgggaacatttcaagtcctctcttctagctgctctgaaatatacaacacattgtcactaactacagtcaccctaccctgctaccaaatattagaacttacatcttctaactgtatgtttgtactcattgaccaaactctctttatctgttcccctccaacccctgccacccacacatccttcccactctctggcatctatcgttctactctttactgccacaagggtaagttttttagctcacacatatcagtgacaacatgtggaatttatctttctgtgcctgggttatataatgacctccagttccatacatgtggctgcaaataatatgatttcattctttcattatgttttacggccaaataatattccatcatgtatatataccacattttctttatacatttgtccaccgatgaacagttaggttgattccataattcactttcctattgtgaatactgctgcaataaacatgcaagtgcaggtatgcctttgaaatactaatttcctttcctttggatagatgcccaatagtagaattgatggacagtatgacagttctatttttagttttctaagaaatatccatactgttttccataagtggttgtattaattcaccttcccacaaccagtgtacaagagttccctttcctctatatccttgccaacatctgctattttttgcctttttaatgataaccattctaactggggtaagatgatatatcatccttgtattgatttacatttccctgacacttagtgatcttgagcatcttttcaaatacctgttggccacttgcatggctttggagaattgtccatttatgggctttgcctacttttcaatgggattttttttattgttgagctatttgagtaccctgcacattttggatatcagtccattgttggatgaatagtttgcaaatatttttttccgctcaataggttgtttcttcattcttttgactgtttcctttgctgtgcagatgctttttagtttaatatagtgccatttgtctatttttgttttagttctctgtgctttgagatcttaaccataaaatctttgtctagaacaacatccttaagtgttttccctatgttttattctagtagttttacagctttgggtcttacgtttaagtcttttaaaaaattaattatttatttttaacaaaggtagggtctcactatgttgccaaggtgggtcttgaactcctggcctcaagaaattctcctgattcagcctctcaaagtgctgggattacaagcatgagccaccatgcctgaccacatttaagtcttcctatactgggagaaagtcaggtccagtttcattcttctgcatgtggatatccaattttccccagaaccatttattgaagagggtgtactttccctaacgtatgctcttggtgtctttgtcaaaaatcagttgttataagtatgtagatttatttctgggttctctattctgttccactgttctatataactttttatagctatatgatgatattttgattactatagtcttgaaatatattttgaggtcagagagtgtgatgcttccagctttattccttttgctcaggatttctttggctgttctctttggttccataacaacattagaattattttttctatttctgtgagaaatgacattgctattttgatagggactgcactgatatagtagatgcctttgagcagtattgtcatgttaatgctataaattttttttttttacaggaaagtggattttttaaattatactttaagttttagggtacatgtgcacaatgtgcaggtttgttacatatgtatacatgtgccatgttggtgtgctgcacccgttaactcgtcatttaacattaggcatacctcctaatgctatccctccccacaacaggccctggtgtgtgatgttcctcttcctgtgtccaagtgttctcattgttcaattcccacctatgagtgagaacacgcgatgtttggtttttgtccttgcgaaagtttgctgagaatgatggtttccatcttcatccatgttcctacaaaggacatgaactcatcattttttatggctacatagttttccatggtgtatatgtgccacattttcttaatccagtctatcattgttggacatttgggttggttccaagtctttgctattgtgaatagtgctgcaataaacatacgtgtgcatgtgtctttatagcagcatgatttataattctttgggtatatacccagtaatgggatggctgggtcaaatggtatttctaattctagatccctgagggatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgtcttttggctgcataaatgtcttcttttgagaagtgtctgttcatatccttcgcccacttgttgatggggttgttttttcttctaaatttgtctgagttctttgtagattctggatattagccctttgtcagatgcgtagattgcaaaaattttctcccattctgtaggttgcctgttcactctgatggtagtttcttttgctgtgcagaagctctttagattaattagatcccatacaaatggaagaactttccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaaccaaaagagagcccacattgccaagccaatcctaagccaaaagaataatgctggaggcatcacgctacctgacttcaaactgtactacaaggctacagtaaccaaaacagcatggtactggtaccaaaacagagatatagaccaatggaacagaacagagccctcagaaataatgccacatatctacaactatctgatctttgacaaacctgacaaaaataagcaatggggaaaggattccctatttaataaatggtgctgggaaaactggctagctgtatgtagaaagctgaaactggatcccttccttacaccttatacaaaaattaattcaagatggattaaagacttaaatgttagacctaaagccataaaaaccctagaagaaaacctaggcaataccattcaggacatacgcatgggcaaggacttcatgtctaaaacaccaaaagcaatggcaacaaaagccaaaattgacaaatgctataaattcttttgattcatgagcatgggatatcttttcatttgtttgtcttctatttcgttcatccatcttttgtagtttgctttgtcgaaatctttacctccttggttaaatttattcctatgtttttttaatagctagtgtaaatagaattgccttcttgatatctttggtggctatttcattatacttgtataggaacactactgatttttacatgttcattttgtattctgcaacttggctgaatttgtttatcagttctaagagttttttgtggtagtcttgtttttttctaataagatcacgtcatctcaaaggtaaacagtctgacttcctttctaccaatttaaatgcattttattttttaatcttgtgtgatttgctaggatttccagtgccatgtagaataggagtggtgaaaatgggcatcctggtattgtttctgttcctaaagcaaagactttcaacttttccccattcagtatgatgttagctgtgagtttgccatatatgtcctttatgattttgaggtatgtttcttctatgccatatttgctgagagttttttatcatgaagggatgctgaattttatcaaatgctttttctacaactattgagatgatcgtatgttttttatcattcattctgcttacgtgatgtatcacatttgttaatttgcatatgttgaaccatccttgtagccctggtataaagcccacttgattgtggtgtattatcttttcaatgtgcagtaggaatcagtttgccagtattctgtcgaggatttttgaatccatattcatcaagaataatgacctgtacttttctttttttgtgtgtccttgtctggttttggtataagggtgatgctgccctcatagaatgagttagggagaattcctttctcttcaattttttggaatagtttcaagaggattagtatcagttcttctttatacatatggtagaattcggccaagaatcaatctgctcctagccctttctttgctgagagactttttattactgatatgactttgttactggttattggtttgttcaggctttctgttttttccagattcaagcttggtagatggtaggtgtccaggaaattatccatttcctctagattttccagtctgttagtgtgtagctgttcatgatagtctctgatgaacctttgtatttctgtggtatcagatgtaatttcttttttatttctgatttatgtgggtcatctctccttttcttggttagtcaagctagtgatttatcaattttgtgtcttttcaaagaatcaacttttcgtttaactgatcctttgaactgttactttagtctctattttgcttatctctgccctgatctacattatttctttctttctcctaatcttggatttgttttgttcttgcttttctagtttcttgaggtgcatcattagattgtttatttaaactctactgttttgatgtgggcatttattgctataaacttcatgttagtactgcttttgctgtatcccacaggttttggtatgttgtgtttccactttcattcgtttcaagaaattttttaacttccttcttaatttcttaattgatctaatcgtcattcaggaacatgttgtttaattccatacatccgtatagtttccaaagatcctcttgatatttctagttttattccattgtgttctgaggacatagttgatatgatcttgcgttttaaaaaattgttgttacctattttgtggcctaacagtctattctggagaatattccatgtgctgatgagaagactttatattctgtagtttttggataaaatgttctgtaaatatctgttgagtccaggtagtctaaaatccagtttaaataaaagtttataaatgtttgttaactttctgtctaaatgatttgtctcatgctgagaatggggttggagttccccactattattgtattgtagtctctctccttaaatctagtaatatttatcctatgaatcttgttgctccagtgttggacacatatatatttagagccataatattctgttgctgaattgattcctttgtcattgcataatgaccttgtcttttttttttttttttttttttttttactgtgtttgacttaaagtctgttttatctgacataagtatagctactcctactcacttttggtttctgttcgtgtggagtaattttttccattcctttatttttagtctacatgtgccattataggtaaagtgtgtttcttgcaggtaatatatagctggatcttaatttttaatccattctgccaggctgtagcttctaagtggaaaattcaatccttccacattcaagattattattaacatgtgaggttttgttcctattatattgttattgttttctggttttatatactcttcattcctttctttttcacttattttttctaattttggtttggtggttttccgtacaggtaccatttaattactttcccttattcctttgtgtgattgctttattagcaggttttacacattcataagttttcatgatggtaaatgtagtcattttgctcccaggattaggactcccttaagcaatttctggggaagactttatttctccttcagttacaaagaatatttttgctagatatagtatcccttggatagcatttttttcattcagtactttgaatgtatcattctttcctggcttgtaaggtttctgctgagaaattcactattagcctgataaggttttctttacaactgactaggcacttttctcttgcctttttcagaattctgtctttgactttagatagtttgactataatgtgccaaggagaagactttcttgcattgtatatgtttgcggatcttggagcctcctgtttctggatatctaaatcatttgatagatttgggaagttttcatctattatttaataacaaaaaaatagatgagttttccaatccttttgttctctgtcttctgggacccaaatgattcaaatatgtggtggctttatagtatcccatatgtctcgaaggcttcaattattcttttttattcttttaacattatttctgtctgattaggttattttgaaagacctgtcttctgtctttgagttgtcagattccttcttctgcttaatctagactattgttgaatctaacattttttatttcattcaatgaattcttcagtttcaggatttctgtatggttcttttttatgataactatctctttggcaaatttttcattcatatcctgcactgtttttctgatttctatgtattatttttcataattccctggtatctcactgagcttcttcacaatcaagaatgtgaattatttgttcaggatttcgtgaatttctttttgatcggaatcattgctgaagaattattgtgttcccctggagatgtcatatttccttgctttttgatgtttcctgcatccttatgttgctacttgggcatctggtgtcagtcactgccttcaattttttgaatttactttaacaggggagggcattgttttgaacatgtatctatggtgttggttgggtagggcactttagctatgattctagatgtatgcagtagtgtagtctctgtaagatttcttcagctgtacacagcaccagttatctgtgatttcctcagtagcttatggtgcagttattagtggaggctgtggtaacgttttgctagggcctggggtggcaggtaagtcagtcttcaggccccatgatagcagcagtgggttgagcatgcatttccttgggccccaaggcagtgtacactggcactggtgttacaggtccaagcaggccaattcttggaaagtataaaaatgcgaagattaattctggtgtcatcagagctgaattacaataccattcctgtcacttcctgggtatttcatctcaggtaagttattaggttgaacaacctaatactgctgatattcaactactgtatttgggtgctacaagatcgcaatttcatatggcccaactgaataattatagtagcctcaattttctgtaaaactgagaaaatatcccccaacttaacaaggccattgtatgggctcatacaatagtctcacaaaaactctttaaatatttttatcaaaggtttgttttaaaatgtgttagtaaacgtaaaatgtcagattcttagtgagaaacccatgttctatattttaaacttttgaaagatgaaaaagatatggtaaaatcagcacttctgtggtggaaaaaaaaacaaaacaaaacaatcaggacagaaaaatatgccctaggaactccggatggttttctctggctacacacaaagagtctgcacactgctaatggctcagtcccagagggctgctctatgccctctctgtgcagctcagtaggatggctcggccttctttccctgaacacccaacagccttatgaaggaccacacaaagtctttcatcaggacttcccctccggattcctccagacaaccttctgcttgtctgtccacatccctctgctctggaatgtccttgtcctagagcccttccatcacctcatcatttgaacttacattacccagttctgcagcttgctcccctgacctaggctgactttgagggggaaaaaaaaagccaatgtttgcattttagcaataagattaaccacaaccctgaaagtcacaggccacaagccacactctatgctaccacagtgtaccgatttgcttttgtaggcctccttacagtatgggtttgatctggagcccttctctctgttttagagaatattcacaatgaaaaattcagcgtaggtgaatgacccatcatttctgttctaatgaggtctttggaattccagaatagatatgtttattgctgagatctcccctctccctctctcaagcaaaaagatatcaacgaaggtggcctctcaattaccacccacttcaaaactgtctgacttccaggagcgtgtaagcaagcagaatgtggtgtaacaaacccaatgcccagctcaatctcaccactgccaaaaagttcaggcgatttagccacaataggaaataccctcattgttcttacatgatggaacactatttctacgttcatcccagctatacaaacaattatatgcatagtaataacattcaagatgaagaaagtaatgagataaaagacacatgatacgtgttccctactttacacacacgtgtgcgcacacacacacaaacacacactcaaacaaaatccatggacttttcaagaacccatcagctgatgacatttaccacagggctcactggtcattccctcgatgcacttcaagtattttcttttagtaatcaggaaagtaaggcagcacaaagaatgaggtactgcgacagggagacagtcaacagaaggagacaaaaagagaagagtgtcactgctgctggccaggccagcggcccagggccccacatatcccacagcagtctatctggcaggtcccctcataaaattgcaggcatgggctcctatcatgtcccctccatgttacaatgaggattacagctcaacattgctaaaaactcaaagtgcatttctttgatcaaaaataacaaaattaaatcctaaatctcacttataaatcctaacactgaaagagctgtctgagagcatctaaaacagtgtttttcaaactgaaagtaatggttatgggtcacaaaatcaatttagttaatgacacttttaaaaaataaagaaatattgcacactgtaagaacatatactggtttgtaaaatttctgttttcaacatgtgtctgtgctataatgttttataaaacatatttcttactgtgggttgcactcatttaaacaaaagccttcaaaatatttatctaattcaatatcctcactggatgacaaaaccgaaccccaaagtgggtaaaggtggttaaagtaagttacacaccttggtactgacaaggattcaaacctattcattcttcatcacaagatgtctttttaagaaaaaccacaatcccatttctacaattcttaaaagtcccactaaacatcatcatttataaaacacagaagcaggtatctgcaaatttttcagagaattgagtataaacaacttaaacaatttctccaagtcacttggcaaatgtaggttctcagggtaaaatcagacagtgggattagaaacacggcactgtggcttttaatcaatacaagattagatacctttaacactttagcacgatgtcgagcacttagtaaacgctagtatcttccttaatcatacttcctgcactttcacatccatacagcttgagcctggatggagcccagaccatccaacaacagcaaatcttccatctaatccagctacccaaccatagtattaccattattaagtaatctgcaactcgtcaagtatctaaggcagccccaagaaaacacaaaaaccataaatacatcctgacttactctaatgggttgtaaaattaaatgaagtggacagaaaaacaagattcaaaacaaccacttaagaaggaaaaatcaaatcattcaaatgaaaatgccacactgaatacagaatacagacacctcttctgatattttggttaattctaactactttgaaagattgacccaaacatcttctagataatcaagagttgaaggttatgcctataccctcagaaagctaattttgccttcattttacaatcaagtctctgatttctcacaaaccttcatgcaatttgagtcttaatataactacagcttattgggtaagtccatcatcaactaatctgcaaattatggtatatttatcatttgctattgatatcctatatcctgacagatatactcaagtggaggtttatttctaacaaaatattccagttaattggggggtattacaatggcccacattaacagaaattattcaacttgaataagaagaaacagctaaagctaaaatatataatatttaagttataataaatcataaatcagtcaaattatatgtctcaaggacagttctgggcagagaaaaccaaattaacaaatacttaatcaaatgccctctatatgcaaaataccgtgctacactttatattttaggtaaatgcaagtaacttactttcctggctaaagtcttgggtcagattataaaaattacaattgattacataaaacttaattaaccttttccttcctcctcatagatactcttcatatcaatttatgtatttccaagtactatacctataatgtagaggcatctgcgtttgagaggtttgagggagaaaagagattttaaaaatcatataaactttaaaaacaaatgaacaagtggccaccccataaacataccctttttcatcaagtggttggactcacatttgacaagctgcttatttgttcaagtagcagatgatgatcaaactttccaatctctaaaatagctcccagattctagattactcaattacccttcatttcacagcaagcagctctaataaaataatctaaataaaactctttttttttcttttttttgagacggagtcttgctctgtcacccaggctggagtgcagtggcgcgatcttgactcactgcaagctccgcctcccgggttcacaccattctcctgcctcagcctcccgtgtagctgggactacaggcgcccgccaccacgcccggctaattttttgtatttttaaatagagatggggtttcaccgtgttagccaggatggtctcgatctcctgaccttgtgatccgcccgcctcagcttcccaaagtgctgggattacaggtgtgagccaccatgcccggcctaaataaaactctttaattcaacttctcaaaagtaaaagagtgggtttacatataatttgagcaaaccagagaggactatccccttcatcagaaactttctgacactattaaagtgaaagaaccagtcttgcaattagttacataaaaccacaaccaaattcagaagtcagtaccaaatttagcaaccctatcatttttcaaggttgtaccagtttttactagacaaagcaaatgaagcctaggaaaatacctgaacatgttcacatttagaaaagtctactcttctacagtcctatttaaccaatgtcatgagatccttaagtttatgaaagtattttctcttccatgaaagaagcaaaaaaaaaaattatttttcttagcttagaaatctttaaggcaaacccaggtccactctcgtgaccttatcttttttattcctttctttctccctaggtatctgtaacatggttattttcattattttctcacttatttttttcttgtgaatcacctgtggctttttagtatagcaaatatgttaggctaaataaaaaaatcgggtttcttttctcactaagtaaataactctgattataatatttcatcttgaattaacattattcttaattgtctgtgcaccttaccttacacatttagcagtcatatgcacttccttccagtttctctgacttttttgcacatcagtctcctcggaagagaaaaatctaactatttttttttaaacagggtctcactctgtcatccaggctggagtgcagtgtcactatctcagctcactgtagcctcaacattttgggctcaagtgatcctctcacttcagcctccaagtaactgggactacaggcgctcaccaccacaccggctaatttttgtattttttgtagaaacagggtctcactatgtttcccaggctggtctcaaactcctgagcttaagcaatccacctgcctcggcttcccaaagtgctggattacaggcgtgagtcaccacacctggccaaccatgaaatgtagacattactaaagtcaggcatacctgaactctctagtcattcattaatccaggctctcctgtcattcattaattctgtggccttaagatataaaaattctctgagcttattttctgaataaaatgagggatacaatacagattacatcaaattattaaataaactaaagtgtggacacaactcttcacagagagtgtggcacaggtgaggaaacaatggtcatgctggggttgctctcactcactggttttgattgtttgctccacatgaaaacacactgtctcaaaaacacacctgattttcttccagacatgacatgtagaacacccccactagccatgactctaaatcaatctctgtggtaccattcacccagcaattgtgcctcctgaggcagtaactatctatgtgcactgacctagaggctggcagtttcaatgaaaccctgcctcccctttcttcttttcatccctctactagaagcaacacttttgtgctaacacacaagtcaaagacattgatcttacacaatagaaaattgtggctcacacacctagaattcccatcattctaatacgatacagagagctactctgttaaaatccagacctttcaaggcacactggccaggcagcatctccacttaaatcagaagggaacagccaaccatgagtaaccagcatgctgctgctcctccccaaagctgccgttctgcagctgactcggggacttcgaaacaacttcagtagtgacaaaggctgctcccagcttttacatacttttcaattcatataatagacatttcacagaaagttgctgatagattttcttctgcctgtgcacatcagttaaatgtgttttatttcccttctgggctacgtgctggcagagaataacacaatgaagaggtgatagtatgcctttccaggccctttatggccaagattatgaaagaagggctttgacgaagaatgttcaggccgactataatagttttccttttagtgtattattgttgccatgtgtttgctgctgtctggagcaataaaaaagctctgaaatatttgtctgtgtcctccatagacccaagagtttccataagagaaatcacttggaaaatcacaatattgctccaaataaaatattaacataaaaaacttgttgaaatgttgagctaaaatactaaagaattatgaccacagctgtaatttatgaggatatgagtgccttcacctcctaagggcctttccactcccaccacaggcacatgtttggtattgttctcacacaacatagatgccaccaaccagaacgaattgctttggggatcctcagaagttctgacaggatagattagatggacaaggaaagctgtcatgattcatttcttgattagatggacacttagtaaaccaatagtcagttcttacaattttatttgaagaaatgatgattacttcttttgtatatgaaaatactttttctttcttcctgtcatcctaaatgtagatttatttacttaagttgaaaaatttggcctcaaaatgtaacaaattaattagtgataataatctatcagaaaggaagtgagcccaacatcagtaacatcaataatctttgagtattcatgaattctctctgaactcaatcttaacagaaatattctcattaagaaaatctctaacagaagagacaatttgcactcaggcccacaatttcatcttcactattcaaatttaaggacagatttctgtgtttattctcagtacccagaaaaagtaggcactcaatgactgctgtggtaagtaaacttcatgttttagcacttagccacacgcaattttagtattgcttgaatgttgttcacttgcttatgaacctgaaaaataagtcttggacgtttagttatcccaagacctaacacagtgtgcctatttgctctcaaatattatcaacatcaaagaagtttttagtttgccagaatgttagattgagtgaagtccctataatcaaggtagattatctgcattgcccaagttttgtgtcctcagatttttatagacattattgcgcatcttctgttgacattttgtttatgccaagtaggatctttgtttttcctaacctaaaagggctgaaagagaagcttttgacttaacaattaattcagcatttacttattttatttgtctacaaagtaatatgctcatatgctggagtggaggaaagaaaggtggctagaaaggttaaaatgagatgtagaaagtaaaaaaaaaaaatgctgtgatatagagtacagattttacaaacaagaatgttatggaagaaaacagtcagtgttttgctgagattacaaagcttaattagtgatagcggagatcagaaaaaaaatgcaatcaagagcagagtgtgggggatatgggaggtattcagctaatgcttccagaaatgatctaagtgattcgtttgcaaaaagaaaggctagctagacattaacttgtctgtaaaatggtaataataggaatctgctttgcctgtatcataggattggtataaagacaaaaagagataatacgtggaaagacctgcaaactataatgaaccaccagtgaatgcaggttcctcctatcaacctcatcttgcctgataactcacacattcttccagtctcgaaattccttaagtctttgggttgtacaaaataaatagtttcctgatctctcttttttattgagatagaaattttctatgcatactttacttaaaatgaatgacattgttactggctctgtaaattagagaacactggttctttctgatcacaatcttgatcctagagatgaaatactccacctggcaagagaggaaaatccaggcctcatgtcatgccctaagcatggtttatgttggcaccactctttccctatatcccaccaccaagagagctgaagctcagataagatgcataactcaatgggtattggggatacactgagaaactgagagcacaaaggacaatccacagtgtgacaacaagcatgtcagagctggtccttgtccctttatccttgatagaggcaacatgtgccaagggaggcaggtgactgaacagttttatctgttctctctttagtcattaattcatccagtgaacatttattgggcagctattatgtgtaaatcactacacgaaaagccaatggtaatactaaaacaaaacaaaaaaaactaatttctcaaacagcgtatagattcatttaaaatactgttatccagtatggaaatgaatgtcatgaataaatggtgctcaatcattcccccagcttccaatactttttagttcttttatctggggccagattacaaggaaatcaaaagtcatgctcaggaattttcacagagaaactactgaaggattgtgagaagagacttaattagcctgaacctgatttactattgaatttaggaagaaaaaataaaattaaagtcaactaaaaggttctaacaatagactatttgtgagatgacaaggaaggacttaaccagagcaacagaaccgagaacaaaataaaataaatgcttcaagaggccacaaagtagaggatgattttcaatgcaaataaaacagctacaaaagttgaagaagggagaatagataataagaaagaaaagagaagcagaaggaaaaagagaagcagcacccaaagtaaaagagaaaaggagatgtaagaggagaggtctcatcagactttttccttgagtgcctggttattttttactatgtgttgttcactgcttttgaaaacttattcttgggtcttatttgtggtaacttcctccagagagaaattctgttggcttgtgtcaggaacctaggacttacacaagttcccaaactcctaaaactaaatcctgagtttaaaatgttctggactacccaagcagtacgtctttggattacagtatgcttgagggtctacttgtggttacaccttcttaggaatccccctccactcctgctctgcgtagcacaaaagtacttttcctgtggaacacgctggggccatgtggagagagggtttaggcataattcaccataaatctaagaatgtgaccctttgatttctgtgcctttgatcacataggactgtcaaaatgaagttccagtttgccaaatgggcaaatgtcctcaagatcaaaacagcctaaatttgtagcttacctcctctactttcccacaagtatcagcctgataatggcttaccatgtagttagttcttcaattattttaaggagattttaaagaattttatattctgcattttagttgttttcaatagaagatttgatccaaataatctagcctaccaaattcctggatgtgaaacaaaacaataaattcaaatctctacacaaaaagtgttgtggtcagccatggaaatacctggtcccaaatccgatggtaaagagtaggaaacatgtataagaaattcctatacttcggaaagaaatcagtatctgaaaaactgaggttaacaagtttatctgacgatagttataaacacatttatacaccactaaaaactgttattaggccatcaaccaacagtacatagaaaatactcacaatgatgtatattctaagtatcaacaaatctcttacattttcaaagcaaaattcaacctgaataaacagaaatagattttttaaactcttaagcttataaaacgacctgtttaaaattgctttctaggattccaatcataagctagaacaacaacgacaaatccttgtttctcaatcttaattacagtggaataaaaaccaaaagtttttggaatggtgctatgttttatactgatactcttactgtgtctatagtggcattaaataatttgaacgactcttctgcaactgaagtggaatatatgctttagagtattgaagaaggatttagctgaagtttcgagtctcatcacttattagttcaaactatcagcataacagaactaaaaagaaaaatgacactatattcattatgtgatttaagcataaaacactgccatgataaatatttggaaattccaagcttttataaaagcacactttatgtactgtatcagcattcatccctttagggtgtacactgtggactgcctcgtggggggagtttatctcatttcattttcattctacattccacttttgagttgccaactaaattgcttcttggtttatagtatggaagacttcataatgtttagttggaattgcttacttttaaagtacgctgatagaaaacccagtgtggtttgaaatatcctcaccagatgtttggatagatgtgaaaccaacacatatcaaaaggagatccaaactaccattagctgtataatacataggctcatacatttaacaacttcaatggatcaaaacacattaaaactcttcaggggaaatgaacttagttcttccattttccattactaggaactcaaattctatccatcctctttggactatcaggatctcaataaatgttaagtgataatgagctacaaggacagtgtaagtaatttaatgtgactggacaatggaacagtttgatacggtcaccaatacagactcatacttttagtctgaaaaacataagtttagtcactagaacaaagaaaatgacagtcttatttctttccaaaccagtcaggccacacctagtataagatgcttaattctgagcattataccttaagaaggataaagacaagtgggatgtgcttggcagataagaatcaggaggctggcacaacagctcacgcctataagggagggcaaggtgggaggataactggagcccaaggaattcacaaccagcctggacatctctgcaaagaaaaaaattttttttttaattagccaggtatagtgatgcacagctgtggtcccagctactcgggagactgaggtgggaggatcctttgagcctgagaagctgagtgagctgttatggcaccactgcactccaacctgggcgacagagcaagaccctatctcagaaaaaggaaaaaaaaaatcaggagagttacagaccatgaatctacataacaaaaagagcaactacaaggatagggctatatgacctggtttgggccaggactcagggaagagtggattcatgggaacaaccctttctaaatattaaaaatagaaatatacaaaaacaatgaattttacatggattcccaaggaaagaaattagaaataatatgtgtaaaataagctatggagagagactttcaactagagttgtttgtggatggaatgaactgctacgaccggttagtagtagtgaactaaactactccttcagggtatacttgttaatccacactaagtatccatgcaccatcacacaatcttgcctaagctgtgctgttccctgaaccagtccccttctgtgactacctggcaaaatataacttcaatcattctactcacacattgccctttctacaattttccctgacatcactctttcccctaaaccttcccatccttagaattaatcatcacctcatcccagcttatgcagcactttttgtgttttctattacagtatatacctacactaaagtataacaaaacatatagactattgtaattatattcttggtaaatgtgttgtgtctggcataattttagcgcatttattgtacgtaacagatttgtttggaaatgtagataatatacaaataatagatgcagagtcaacctagatgactttaagacactgagattctatggtactagaaaatgtagagacacgtttaaggacttttagcagtgaacacagaagattctctaacaccgacatgcctaaaaaagtgctacacatgtacccttaaacagaactagaaagactcagaatccagtacatttcttccaacagtaaaaacaaaaaattcatgcaaaaactccataggtataagttggacattttagatatccaaaaaacaacctttaattgaatagcaatataaatgatattctaaataaaacagaatgatagatacagaaagataataggaggttgtcaagaaatatgaaggagtatgtgtattcagccagtagttaccagattacaaatccataaaacaaaaattattcattatcctctttttctgggctctattttgaacttactcattgacatatgccaaaactataaaagtaagacaaagcaggaaacctatagtctcaccaccaagtcaaatatttccattgtgaccagtctttccacgtccaactacacggactgtgaattaagtccaaacatatttaccttaagccattcttattgagttttgagaaatctctacttttaaagaaaaacaggtctacaagaccatgaaacattatttctcatatttaaaagaagcagcgaaaacacttgaaaaaacacaaataagtacaaataagccaaaaacctttgttttttgcattatgcattctgtttctcgtaaaagatgaatgatgagaaaacaaaaatataaatttgactttaaaagaaacattcagggtgtttcaaatgatcagcaaagattcaacttaatcccctaaaaaactagtaatagttgttaatgactgcaatagtaccaattatagataaccagggagaggatccaaacaaatgagaaaaatgcataagatagcattttaattataatgctcaatataaatatgaggttaaaaatcattattctgcattattcttcaaggtgaaagactcatacaattacacagccaatgaaatgttgcttattgcaaaaagaagatgatcttataaaaattaaattctaaaaaagatacaaattaaatgcatatcatgactgtgtgtatgtcagaaatatctgataacagactagaaagaaaagcagcaaaaaaaaaaagaaaaaaacataggtctggtgttaagattttaggtaactttttttggttttccaaatttgtgctaatattatgtcacttttgtattattaaaatttcatttgaaatttgttaggaagacctggaaaacagtgcttatggtgggagacagatttctcaagaaacaatcctgtgataatttcccaacaatcttgaagcctcaatgaagttcttcatgacatccagttattcatgactggataatgaaatgtgggcctttgtgcggaaacagggagattctcaactggctaaatgaccactcccaagggagctgaagaccaatgtcgataagattctactggacacaagagctctcttcacaagactgtcctgtgcactacatgtgacagtgaggcagacacacactgagaaacatgttgcacacgttagaaagtactagaaatgattacaattagacactgtataacagactaagattttttgtttaatttgtatagactagaaaaatttgagctagatctacaagattgcaacttaacaaagataaatctaaagtcctctactaggtccaaatattaactgtataagtggggcacaaggaaatatagctaagagaccaaatatctgaggaaaacacaggcattttaattgtcactcaacagcatggcatgactgccaataaagcaaatacaattctagactgctgaaaagagaagacggtcgtgccatgtaccgtgttcagtaccacattctataaggacagtcatgacctaagtacttggaaaaaacggagcagatttaagaataacattcacattttaaaggagaacttacctaagaagtgggtaggcatatttggtgcagtttaggggttgaggggagttagaatcaatggtacagagactggaaagaagcagatttgggttcaatataaggaagacttttctcaccagaaagcagcccaaatacagatcaggctcctagcaaaggcagtcatacggaagcacacattaactcttacatgtggtcagggaagctacagaaaagacccctgcactatataaaagataagcatagacacctgcaaaatctcttccagctgctacatttcttgatgtgttaaaccaacggaggcacagtatgggaagcacaactataccaacactgaaaatgaaatgattctctatgaaattttctcactaagaatcaaatgaatggttattttctctagaaactgtggagcagatgccacactcccccaaaacactaaacacgtgcacccaggtttacaatatagcacagaatgccgtacatattctcatattctattatccccaaaatcaggtggtaccttacaatcgcagtcggccaggttgcagtggtgtagttgtccttgcctgatcacgtgcacacctgatcatcactgttaatgccagttacttgagttaaatagtgcatgcttcaggtattacacatcttaagcttaatgacactatagttcagtaataaaaagttaaacatagaaagtaactaaaatactcagtggggcacaaactcgtattaacttaagaacatctgccacttgacggatgtctacaattctgtattttcctgcaaagtaatcaattcattttgctatttgttttagacatatacacaagagtaaaatgatacaaatccatgtctcaataaatctaaataagcttatcaataagtataaaatattaagaatctcagtggtgagaaagagttgagtcatagtttaatcagaagagcttgtgctttcctaatggtacataaaataatgatgcatctgaaaatcggtgttgcagaatcagtgaaatacagagtgtttcttgcaaatgtgatgtagatttcatagacagagcactttatttttaatctctctttaatatacgggaatcttagaattgcagagttggatgaaaccttggaagtcatttgaacataaactcaatctagcatataaaccctttcaatgatatatctaatgtgctggatgacaacttttaaagaagctgaaagacatccaccaattgtggaaagtatgctatccaaaagaagaattctcaagtcccctcaaaaaagggggagagaggtttgacctcaatgaaatttaagatttacgttctgtgaaggacatcacagatagagcaagcatagaagtgacaactggaagaatatatctgcaacatatatacctgataaaaagttaataggaattcctacaaattagcaataaaaactgaatggacaaaggataggaagaggcatttgacagaaagaaacgccagaatttctaaatctataaagtgagttcaaccccattattaattagaggtacagctatgacattatataactctcctccagtttgcagagtaaaagggtagatcttaattttaatgatgtgaaacagaaagtttattaaaaagaggcgtgaaatgaaagaagtaaatatccatgtgatttgttgttatacatccagtgtcttaaagcagggacctgtacagagaaataaactatattttatgatttccaagtaaaaacatatatatttaatttgtttttattactagaatttgtttttgtttcagaaaacaacatatttacaaacttgaacactgtttaagcacaacctagtcagggaaacattcaccgtgtctatttcagaaataagacactttatgttaactaatgtagtggaaaggactacattaatgatttgccattttaaggagcatgacaagctaagtaacagctgtcagtaggtcaaacacaattcaatcggcatagttagttccaaaaaacatttaaataggttctttagctgggaagtccacatattactcagtaattctaggactaatcaaaagcaaatagaaaaaaacaattctcactagcttggggtcagtgaaaacctatttgacctatgccaaaaagggaggttctccattcaaacagatggataaaagctccaagtacagttatctcactaaaattccaaacaagtcacaatgaacacatgactttatattttagttgtgtgtacgtatattacatgtatgtgtacacagacacatctagagactaattaagttagtgactgtaaattttatatataaaaatgcccatatatttaagagtcaaagaatagttgtcttttttatatagtcactaaagacagatatataatatgtatatatactaacagacaatgtgaattcaacaggtatcattttaatgatatcatgctgtacaaaaatataaagaaaatatatttgaaaagaaaaaaaaagtttgcaaattccaggtaataaatgaaaaaatgaattacaagaacacccagaaacccaatggaagctgttacagatcactgaatttttggaatctaaaaactctgtagttttatattttattattgtagataattgtatacacaagcccccacagaataatgccttgtctgttgttcttgagagagagtagaacagatggctctagtcaaagcccctcggcgactgagcattatcacctatctagggaaggagatggtggtgcgggggtggctaaaaggaggatgaaggcttctgggaagagaaagagggtgcagcttaagtagaaaatggacagctaaaacgacgaggggtgaaactgaatgtaaattatgcctggctttaaatataagagttttaatattttattagtaataaatccactgttttccccccttaaactgctgtcacacacatgctagtggcccttgacaaatgcctgaaatctttgccatcattattacacaggaaaggctttgaaagaattccaagcaatccatccatgtcatactttgacaaagcaagggagaggccacgggaagaagagctttagctcccagtgaagagttaagaaagtgagcctttactctaggctccagttccgccctaaaacctagctgtttgactgtagaaaagactaggatcttctcgtagcaaggcaattaccagtctacatggttaggatagtgacaaacaaaagaaacatgtcaaataaataaatggttaccattaaatagaatttatttgcaggtactttctaaatttagtacgactataaaaacaaacaaaacaaaacaactttcaaactaccaaagcatgtgaaaacaaactataaagctgtttcaatgctcccttatgttttaagaaaaaaaaaaaaactaaactgggacaataagaaaattacacataatattattattattatttttttgagacgaaatctctttatcgcccaggctggtgtgcagtggcacgatctcggctcgctcactgcaacctccgtctcccaggttcaggtgattctcctgcctcagcctccctgtagctgggattacaggtgcccaccaccacacccggctaatttttatattttagtagagatggtgtttcgccatgttggccaggcaggtctcaaactcctgacctcagtcgatccacctgcctcagcttcccaaagtgctgggattacaggcgtaagccaccgcgcccagccacataaattatttttataattactcttcaaataaggaaaatttagtaataaagaaagtaatctacttgaaatatttttagctatcatagattaacaaggataaacaccaatctaagaatttgtacgtagtttataactttatttagaaacaaaatcttaaatccttatggtaatttcataaaaggtagaaaaagtctaatttttatacgcttagttgagaaacacttaaagcaaaccctgcactgaactgaaaatttccacaagacatataaataaacttataaaagctcggagtaaacctcttaggaatgtcttgattggggttaaactatggctgataataagcttaaaaaaactaacttaggaacaagtttgccaccttgacagtatgaaatgccactaaattgaaaatggaatctggatggctttaaaataattgaatctatgctagctataaatcctggaatcttttacttgggaatccaaggtttaaatacaatgacagttaagatgaaaagttttattattatataagtatttttctttgacttttagaaactctacaaatcaacagaaatcccttattcaagtaaaaaattaacaaaaaaggacgctttgaaaattaaaacttttaactattttttttctgctataggtggaatttgtgctgtgcttgggatactacaatactgtcgcttataaagacacatttttaaaacatttactttttgttctctaagtcatctacgtttaaccactatttttacattataaactctcatttagcatacatttactacagtggccaataatggtctattattatacaaatcaaatatgtgttttaaacttaactacttctccaaacagctacttccccttccccacaaaaaagcatcaattcgttaaatagaaatttctgcaaagttgtacttgagtgaaagtacagtattaagaagcttagttttcataatcacatcctatacagtcaatatagttacggcatgaaataggtttgtttgtatttttccctggtgagcaattttggggcacaacaggttctactgtaattgtctgtaaattataataaataccaaagctaaatgtggaaaattaacactggcacctaaatttatttacatgcctcagaatcatttcatggaagttcatgtatatttatttacctgtaagaaaacaaatcaacttcttcattcagatttctattttatagaaaatattcacatactaattttctctagataagatatccccatattaacagtatgaccaaaagcttatacagcatttaactttaatttatactttctgacaaaatagaatataatgccttttccatcccagaatttccactattctgcattaagtttttaaaaaggtgcaagataactttatataaagttttaaatatttcttgagaaaaaccattatatgctaatatctgacaattgtttctcccaaaaagtatgatttttaaaagaaactgaacttttcatccttaggttttattaacactgatgttttcattagacaggacatgtaatttatattgataagcacaataccacttcaaaaacaaattggacaatcatgaaattttggggttgtaggagatcttggagaacatacagcataactcttacctgtttcccaaagcctcacatcctattttacagatgggaaaactgaggcccagagagactatgtgtcttcctcacaggtttgttttacatgattataaaaattctgacaagattaattcccttaatttcacatgacaaagaaaaagtaccctgtgctagttagaatttagaaggttttatatttcaatataccaatcaaaaatataaatcaatgaggcttaaatcacagaattacaattaaaattgggttaaagaaatgtaaataaattgccaatatagtgaaatcgtcattccatgtgttaaccctatagttatcttttggatttattacaaattcctatgagataaataacttctaagttttcaaaaggtggccacatctgtgttcttctaatgtcctaaacattacaacaattaatatttttatcattacactgatgtttcaataagatacctctatatgcaaccaactattttattttataaagctgtactagaaaggtctaacgtcacaatacaatgtaaataaactacagattattccgtaaaatattttgtatgtggcaacaaacatatgcctttaagtttgactaatacaaatggaagactattaataaaaactaaatgacagcaacaaaatctatatcactgacgagtcaagatagtatacatagcatcagatcatagagctaatgttaaaaaaactcaaacatgtgataggggcactacacaaaatgtcatgtgctaacatctggaattaagattacttacagtggaaaaaataaaacgtccccgaaaagtgaaggcacgcattaaatcttggcactctttttatagttgttttacatatagaaatgtaattcttacaaagaactaatttcactaaaggttacaattgtactagtattttctgtaagaatgcaagaaaatgagtaagattagtcaaaactctgttaacttctatgttattatgaaagatattgcaatttttgtattaaacatttcatgtgcctatgacctgacattactgagattttttttttaaaaagtgagcatttaagtgtcaaaattttactgaaaagtttttactgaaagtactaatttagtatgtaatttatgttacattataaaaaacagttttttactggctaggaactaaaaatctctgaccagataagggtttaaccgggatgtttctgttgtagttaaaacacatcttttcccaagtgatagaacttgggaaagttcttaggaaattctttcataagtagcatggtaaaaaaacactaaaaaaacaaaaaacaaaaaaaagagagaaaataaaaaatgaaatttcagtaaagcttttcagaagaaaaaacacaagaaaaagggacaaactaatatttcacacattggaaatccagtaactgctttatggattagtctctggatcctgtgccaacaaagttgcaccaccaagaatcatcatcatgtaagatggttcaacctgataagtggaatccccagttagaaactgagagaaagagaaaagaatctcccacgaaatgagagaaagtatatcaaatctatctgaaaccattcctcaagaaagacgaaatatgagcaatacatttatgaacttatgtgtttatctaaaataaagacacaaactgtgggggaaaaaaggcaattaaatttagcgccaaaattgaactttagggcatttatattacacaaatttttccactaaccattaacacttcattgaaaaacaatggccacatgagaaaacatacttcgtgattacatgcaatcatctatcaatttaaataattttcaaagtatctatatatgtttaaatattttacatcagataaaagaaaggacaatttggacataaaggaaaatctaagtatcataagcacaaaactttggtattttaacctcaaacaacagtgtgcgctctagtttattaatcaacaggaatgctacttaattaaccatgtgaaagttaaagtaagtaagaaagacaaacaaggcaagtattacttaagctattattatactacactggaaatttttcaaatatctaagattttgtaagatgtagtcacgtaaacaaatgtaaagccatcataaattaaaattggttataaaatgccaataaaacattgaagtcccctataattcatacaaaatctgtttttagactttaaaaagggcatcaaaaactataaagtgtatcatttttaaaagcccatttaaaaattataagcaaattgaaaaaaatgttattaattatccaacatttaattattcatgcaaaatatttataaaatattgtcaaggaaaataaatgttctagtgctaatatgaagaaaattaatatgctggtttttaaaaaaagttttaaaacaatattcttcagttagtaagcaacacaaatcacttagatttgcctgcttgagacacgattcttttgaaaccaagcaattgaaggaaatggtgttgcaatactgtccgtttaatgaaaaccgtggcagtgaaaaggtcacataaataatctgcacgatgttattgcattaagaaagtcacagtctaaatctaatgcctgccaaagaggggctaaaagtgtaaaagaaaaagtacgcagtcacctgcaaaacatattatattctgattaaaagctgtttttaaacaaccttttaatctaaaacccatttgctatctcaaaaatgacctataaagaaatgtttatgtaattgtgactaattcaattatcttacaccctggttttaagaaatatatgataatgaaagttcaacttataaaattccatttaattaaattaaaaattcacaaaattgcaagattatgtgtttagacatcagaattttctttgtccttgttttcaaaccgcctacactactaaaaatattagggtaacacagataatatctgtgcatacaaactgaagttaacacagtagactgcttaaaacagaaaaactacatacatatcttctttttctactgatatgacagagtataaccaattaatcattaataagtaacaagcaacagccagaatatgtttaatgcttcattaaaacaacattgaggcccattacagtacacagcgtacgatgctggaaaccaccttataccctcgcaaaccgcattcccttctaacctcatttgggggaagcagctagaggatgaatggcaatatgctctcaagtaagcttttattaagtatgagaaataaattatattaagtgttattttttgaactcagaaatgagggaaggggttgttaagatatcaaatttactaagaaaataattatgtcagaaataacgttgctgtcacaagagagacttgccagatactgcttttaagcacgttgttatacacacctttagaataaattttgtgacccagagattagtctgtggtactaaaattcctgagagtagaccagaaaaaaaatagagggtaggagaaatgttttcctaaacaatgttagcattactctagtggcattaagaagcccttatttcgtttataattagtaagatactgaggtgatgggattgttaaggacatgttacaaattgcttttctacaactcacttccgaatctcagtttctactaaatatgattctacttcattagatcctcatgactgtgatctcaccaaatgcaattctaaaacttgaaaattaccttggaaatttgtgagaagccacagaaaggtcctcggaagcacacacatattaaatattaattataatgatgactgtcatcttttatagtgattatgtcattatttaggaatgttaattaagacataaaatgacttgttaatagcaaatgcattcttaagcaatatatttgtgcttgtgcacttaacagcaaacccagtatggggactgaaccataatagactacagttctattttctaaaatgctgacatttgagcaaacgttcccagggaatgtttgcctgattcgtggactgacatttcctctttgtaacttgcttaactaaagaggagacatgcaggccaaactccacagtgcccgcaggcagcaggctattgcttgccgctgcaacttgtgcgtggtttctcttttacttccctctggccctactgcccctcagcccttcactgtctctttattttgacatgcatattatcttagctgatttcaatcatcttacaggagtggatgacataccttaaaagattaagcttccccacctgggatttgtccagaaattcagtgtattacagcttctcagagccttcttcgttctcctatattcttgtgttatcaatagtagctttctttcttattttatgtttaagtatgagacacaggcagctatgctgatggagtcagtttgtactgtcactcatctttcactacaactgcaaggttcacttcctttgtctaattctttgctgccatctatgtgtataaaagagcacaacattcttaaacacaccagaaacttcctcagtttcaaaaacaatcatgtctctaatctagagggatgaagaaggaagctttagggataatttgcttccctacacaaacgtaaagcttattggaaatttccatttctttctctgtgaagcaaatttataaaactgaaaaatgactgaagttacattatttaacataatattattgaacataaccaatagattttttccattattgctgctgataaattttaatttggcaaatttgatgaacttatgcttgaaaaacaaaagttgaaattttaagtcacttaagtaaataattccaataagataaattaatttttgctaaattgcaatctaaatatcttgccaaatgatagagtgaaatgatcactaaacctaaccgggtgcggtggctcacgcctataatcccagcactttgggaggctgaggcgggcagatcacaaagtcaggagatcgagaccatcctggctaacatggtgaaaccccgtctctaccaaaaacacaaaaaattagccaggtgtggtggcaggcacctgtagtcccagcgactcgggaggctgaggctggagaatggcgtgaacccgggaggcggagcttgcagtgagcggagatcacgccactgcactccagcctgggtgacagagcgagactccgtctcaaaaaaaaaaaaaaaaaaaaaaagaaatgatcactaaaccaaaacactttcctaatatttaatataaagcaaatgcaaagcaaacagatgaaaaaattatttacacacattatgtaaacaaccaataactcaaatattgtgacataataatcgactaacttctgtcaaatattcaaacacttcttctctagggaagatggagaaatgtatcagaccacactaaagagcctctcagcctcccctttaggactgaccatactggctctgaattgtcctaagataagttagtgtcaaacaaacaaatagaaaggcactctagtgtgagccatatgggaatgttacaacaaacaaaaaaaccctgtcccctacaccatgtaacaattaatccatgcactcagggtaaagactggttatttaccatcagtactaataatgtgggttgacagtcttgaagaatgtcctaaaaggtttattttgtcaataccactaatttctaaaagactttactgttatatactaaaaaaataaaaacctggcaccaatgaaatatatggaatgggagtagaaaagaaactcaggaacaggtttttttaccctgatataccaaacagcataagaagtgcgaaactgctgcctcttctctatcagctcccatttagaataactgcataattgctatcaacacaatactcctcttctctggcaaacatttcactttaattatcaacactagaaccgtacacaagttgagctaacctttcagggtgcaacattttctaaagaatcagtctcttaacgataaactgttaacggagctgtaacatgccaaaccaaggcttgatgtgcggtttcttataaataaagcaaatctaaattcgctgtggattacactttaaattaacatttccaaactaggaacatactctgccatttttcaaagagtaaaagtgatacctactaatcactcatcttcgatcttagacatttttcaaaaaatagaaatctgatacattcaaaccattttcatatgatttatttcttgctggcactggtaaggtatccaattaatgatttacagtacaaagtagcagaaaaaattcttacgcattacattttttgaactagaaaagatttcattttattttaccgtactaactttaaggatccaactttaacaaggcaaattttataaactccgccatatgtaaggataaagtagaaatcatatttaatatcaagctttactatgtattttaaaagaggtattaagtctaatttttttaaatatacatacaaattttgggggcgggggagatacattatggtattaaacaaagtatcatttatgtcttcaccttaatttatgtaaattacatactgtaatctaatcaagaatcctggctgggcaaggtggctcatacctgtaatcctagcactttgggaggccaaggcaggtggatcacctgaggtcaggagatggagaccggcctggccaacatggtgaaaccctgtctctactaaaaatacaaaaattagctgagcgtggtggtgggcacctgtaatcacagctactcgggaggctgaggcaggagaattgcttcaactcaggagacagagattgcagtgagccaatatggtgccactgcactccagcctgggcgacagagcgagactctgtctcaaaaaaagaaaaaaaaaaggaaaagttttactcacagtgtatttactaacttactctttacccaccatttttataaatagcatctagaaattaatattgtggtaaatatgttcatttagctatttgtattaattttagcttaatatatataaaataatgttgcaatactaaaataatgctactctggattttatttagtaaacaagccactatttataaacacattaagggtgaaaaacccaacaagcatagctttgtgtggtccactaattaattatgagcaaaattccaaacattattagctgttatcaaaattacaataccacctagctctaataaaacataacaatctgtttgaacagggagaggagaactttcatagagtgttctctctcatataaattcttaatggactataaaggactttttaagtggttttagatttgaattcaattgctcaaatctacaacaggcttccaagaagaatctgagccagatgacacacaggcacccaccaacagcatacactcctgcctaccctgatgaatacaaagtcaaacatgctcaacttcttcctaagaaccatgggaataaactagtcatatttacaatcgtggtgtttattcattataaacctaaacatgaaattataaaatgaaaaaggtttcgtattgcaattttgcgctgtaacaaataaaagtggttacaaactgtattaagttatcacgggggctgtgtccacacaggtgaagggacaacaggactgatcagaaagaaatgggagcttgtagaacaaaaacaaacaaaaccgtaacattacttgaccgtagaggtttgttccatccacatcacctattcacagagattaaaagtatccagtctttgctccaagcacctactcactgtacctgtaagagagctaattcttctagacacaaaaggcactatagtatgcagggatattaggtctaaatgcaaacataccttattaatcctcaggctttcaaagtactcactgctctttaacaagtaaagcattctgctcataaggaatctttattatttgaacattcataatttgctaacaaactagagtgatttatgttgctctgagcacatctaaaaattacataagacaagaaaacaatgagttttaaaactcatataacatcataataaactatatcgattcataaatatactaagcaaaataagttatcttcagagacccaatatgaagttacagtttgtgtatactaatatatggacaaaaatgtattttcagtgctaaagcagaaatatttatttttagatcttagaaaataggttaattcacattatacttatataactgacttgacaatttcatttaaaaataattgtatgaataggaacaagctgctcattctaacaacgtcttcattaagaaattgtagcaaatattatttgcctcccatagcttttagggaagctaacttacaaaccaccatggtgtagatattcaaaattttaaattttatattgaattaaattgtactaccctaaccaaaaagatgattatcattcctgatgagttagtaccgtggatttctgttgtctgtatatattatatatattaattttatgttagtatcactgatgtgctaacattgcacctggcattgttgaatttggggatcttctagctattcaaatactctttcatatggtattaattaaaaccagttccctccagcaaggaaagaacaatgttttaaactcaaactcaaatgcaccaaaacttcatttcaccgtagtaaacagtgggaatgacaagaggtccgatataaagtatcagagtcctgcggtatcttcccctcacagttcaacgatactgcccacctcggtattctcagcttagtagtgtgacaggaagactgagtggcatcatatctgggctggagactaggtagcgtgtggctgcttatgaaccgcacgtccaggtgggcacctgtgaaataagtgcttgagctggctctgtgccaaaatctttgccactttagaattctagagcccatttattaaaaaacaaaggatccaaaacatcactttttcctttagaatacatcataacaagttaacattttggtggcaggaaatacagttatttgaatgaggaagacattcttgcaatcatttcgaacagcagctaaggcaaatgacaggcctcagtcccaggcagaaacagcaaagacggatatgttgactatgtaacctgagcccatccatttctctagataatttgcctcaagttagactgaactgtgagcaggcagcacactgggactgaagtgaaggaggacacacagcggccaatgcatatttcctttcccccatgcccactgcattcactgcttgcctccttcatcaggacttggggtggtgagggtccaatcccaggagagatattattggagacaggatggtcagggggcctcacggagaagctgatgcttaagttcgagtgtagttaagggaatgagacaagtagatatctagggaaaaagagttacagtcaagtccacatacataggcccacaggtagaatcacatcttaaggaaacacagcctaaggcaggtgcttgctgcatggatgagaaaaacagaagcataaaaaggctaagtgccctcttagggtcatgtagtgagcatgtgacgtgaccaggattttaagccacagaaaagtccaagacccagggtctggtgtggacctggatatgaagttttagagtgtgtcccaggaaccgtgatatgcacccctgatttgataaccttgcctggaccatagtttcttgtgagaacattcctctcttctgccccatggcagtcgtctgttccagtagtggacataatgtctccccgctgcatcctctgggcacagggcctgtaaagggccgatggctgtattcacacatgttaacttactgaatgctaacatgcaattgtatgggccacaggccaggccctcatccacatttcaggatgttctaacagcttctctttccttctaacagcaatagctacgctccctgcctgctccttactttcctgctctactcacacctccctgtcaggctccccagggtccaaaataaataaatgaatgagcaagaacacagaagaacagtccctctctgctgtttgctctgggtttttaataggctaccccctatccttactgtaattacacggtaaagggccacgctgttgcaattttgttttgttctataattgggttagccaggcactaaccagatgttcaactatagactcccacctttcaccaaccgcccttcccccccataatgcaattctcccaatgtatttgttcacccacccccctccctcaattagaacagccccaagaggttcaggcttcctggggacgaatatgggggtcagctattaaggtacggatttcaactctcagaaccaccaggaaaatgtcactggagatgacagttctttagcttaggtaattcagtttcttgggccctttcccaggggccacagatttaattcctatggctatttttattcccacctccattcctttaactagcttttctgtctcatccctcctagattctaacttcgtgccaggtcactaacgcactggccccttgactcacagtcaactctgcctcctgactggcatcccaagcttgaagtcccacgtggaggagtgttcagactcaaccccctggggcttccacagtcagaatctgctaacttgtcccgcacaactctgtgaggaaatctcagctcctgccacatggtcatgacccagtgtacctcccaggcactcatgcctcctagcagtcctgaaacaaaattaaacaaataacttacacagagacttgaaaaggaaagtaatacagatatttaaagggttagaaaaggagtagaaagtatgggttattcaatctgagtaagagaaagtgaaagaaagacacactcatggtttgtaacgctgagaaagaatttgaaaatccttttcaaaactaaaaaaaagactaagtgactttctgtctccactaaagacacattccacaatggaataactgttgtttctttgagaaaaatcaaggcaattccaacatggcattgtgaggcaaaggaaagaaatactgcactaggttcactgtagaaagatctcaccaacaccactactttgaaaatgacattaagattattaaagaagctccaagacatgggggacgaatcgaaaatccggacagcaattaaagttaaacaattaagcaacactattacttacacagcaaaaaatacacaaaccaaccaaccgcacaaccacaacaaaaaaagcagtttcctaaaacattttctccatcaaatgggcaggactacgcattggataatttgttcctacttggatgatgtcatcatgctaggtttaacttcttttaataactagtacatttcagtcatctctcactttctcccacataagatcaaaccagcctttcaatgacctacttcatgagtcataatttttctgtttatgattcagaaaaatgtcttcagtcagtatttcccagacttctgtgggtttattccaagaaccaatttcatcttcgctggtttcctacaggaaaccagagcaacttcctattattttattttccttacttttagcataccctagcccacatcaagttaactggaagtgagagcggtaggagactttattccatacaaacagaagccaacacaaacaacacccagtctagaagtcacgggtgcaaaattaaatgcaaatgtgtgctaatattaggaccttttttcaaaaggacaccaaaccaaataacaagaaatttaattaatcttatggcaaacattacactgtcagaagtaactttttttgtctaaatatatctatgaatacaataaattctacaaagctgattaatatagagaaattaactataagaaacaaaatatgtattttttcatcctaattccttccctaacaagctactagaaaacaaacaaacaattgcaacccaccatggagagccctggagaggtgagggaacacagcagcatgctgccagcaacctgacagatgagcagtctgtgatcacatggcgccatcatcccaggccccttccccacgcccgctctggccatgacgaagcctgtccacagatcacagcataaacagtggtatggaacagggatttcgaaggacattctaagaggagctgttcatactaagtacttgagaagtatttattatctcagactatgtacaattcagaaaaagaggtttctgaatatcaagaactttgatacaaacatatatcatattcgctttccattcttataactcctgactgcagacgtagttttgggctttaaaagctcattaagtcattaactagtaagtaataggattattttacatcaaactcaaaaacctatatattaaaggcaaaggtctaagaagaaagcatttaaggaacatattctatttggataaaccaagaaacctgaaacactagaacaagggttctcaaagtgcggttcccagaccagggacagcatcatctggacacaccctaaaaatgcaagttcgaagaccccaccctagacctaaagaatcaaggattctgaagagaggcctggcaacccacaaatgatgctacaagctttacccatcatattctctcttgtccctctacataaaaatttctggaaaaaaatgcattcaatttgcatttcccttataacctctcaacttctaaaccccttgcacgctggccaagttcttctgtcacatcactaaaatgtttctttaaaacgtcacaaatcctcgctggcctaactggcaaggccggtgacttttcctggtcctcattctcctagcctcatcccctcttgcttgcaatgacccaatttcttgactgccatggcacaatcccaccctctgcctcctccacttcagtcatcagccctacttgtcctcatcccaccctctcactatcaacctgtttccaagattcaatcttcagtcctctacccgtctttctccagttactacttggcatctttaagacctcaagagctgaatatacagctctgtaccctagatctctctcaaaactcacagcatatttgaagctaccttatagcctgcttcccttgaatgtccttcaagtaacgccagtaaaatgtttccaaaagggaacttatttctccaaccccactccaaaagttcctccttgaatgtcggtttctagtactggttctattgaccttctggtcccctgggcactggagccctgggtttccctcttctctagtgaccacatcagtgcatagagaaatcagccccacctggcatcctgtttcattcctcactcccacccccatttctagtgacaccatcctcatccagcaacttcctagctcttcttaagccctacctctagactcttacctctagaagtcatcactgaatatatcttcccccgttcaaaacatgggtagctgcccaggcacagcccagcttcctacctgaccttacctcacacttctcctcatactggttctgctcagctcatctcgaatgctcatgatgctgcaaacatgtaccaagttttcccacttctctttgcctcatattattacccccgtttcaactattagtttcccgctacgtctgtaactctgtaactgtcctctctatacctcaacaccagagccagtgtcggttccgcctcgcactatccatctacccccagacggaagttctctcttaccctcctctaaagagtcagacacttgtgccaatcacccctcctagagttgaaacccccacagcagaggtgtatctgacacagcttttcgtactgtaccatgcatgacaccttgcatgaggtatgcactcaacaaatatttgttggaagattaaatgaccttacaaaccaaaattctcactgaagagtgccatttccgcccattaactaaccattaagaaaagcagccaaaataccataaaaaaagataaacttcacatgtgtagcaatgtagagggaaccaactcaatagcctatgatttctattacttacagtacaaccacaccagaacgataacaaaacactatcatgatcactacaactaagaaaaccaactataacatatttctgaactataaatatgttttggggaaaggaaagaatcagcccatttaatactaaatgacaaggggaaggtcttctataaataaacctttataaaaattttctgcatctttcattacaattttcagctcctagaggtgataaactatctatgattacaaaggaaacttcttaatctaaaggaaactgaataacagaatgttcattccaaaacattctgttttgtctggaagatactctcatggctggtcaggaaggtcaagaagcagccagatgacttataatgtggaagatagactgactacctcaattagggaaaaataaagtcttcattcctggaatgataaaaagtcaccgcttctctataggaaagaagggatgtaatttctcaagcacacagtatgcataagagactttccaaaatgaaaaaacacatggagaatcatttagaaaaatagctaagctgtaacctaaagaccctgatacctttcacagactttggtgaaagtctggatatagaacagaatcatcacagattaagaaaagaaaaatgtttcttcatagacagcacaggcagatatgaggtatcatcattcatcgatatgtagccatccttcaaggttaacatttgaaagaaatacatataatgaagactggcaatcagttataagattgagtttattgctatgtttctctcaccatgttctccacttggtttcattttatctagttcatgatttcttccttaaacaagcagaggtatatagaataggcatttagcttccattctatgcaaacatggggatacagaaaaatagccaatcacctaagaaaaactttctgaaataagactcctgtacttgttcattaaatagcaaaacaaacaaacaaacaaacaaacaaaaaaaaacctcatacattttctggacttttgaggggcttttataacttaagagttacttgcttttatttctcaggtccactaaccatcctgtctgaacaagtatctaaatagaactcctatcattcatggcttcagatttcacttattcatgtgagcaggaggacacggcaacaaaaacttgaattaagcagaccactagaaccctaaggatgggcctgtgatgtttaccgtgattccttccagaatgcgaatagaggggaaaatccacactggctatatcacactgaggaggagggagactaaaaagctttcttccaatgatttttaccattcacaattaaaaagttaattcagctaattttaacatattattgggactcaaaaatattctctcagccagtaatttagccgctaccaaaaattgatattaacataaaggttttacttagttacatcttccaacattttaacaaaacatttaattcacaatctgttatttgaaatggcagaaaacacatccatgggcctcatggctacagggaacaacccaaaataaacaaatactgctattccaatattagtggtaaggttttattatattgtttaataacagacaagagacttttaaaaaatctatgagtacttcaattaggattaatacttaaactaacactgacaattcaacttgaagactaagaccagtgattatattactacactgagaagcagcagacacaagtaaaatacagaacgccacagaaacacggccagagaaatcccaatgaaaatgcttactttgacgtggctctgggctccaaggttgtagatctctgtgggctttacttcattaatgatcttcacaaggcaggtactgtcagtgagatcgccatagtgcaacttcatgtcttcaggatacaaaaacatcccattagatagagaaaagcaacataagctcaatttttaaaaacatcaaaattgaaatgcatatttggaaagtctgaaaaccagggtcaaaatggaaatgctgtactgatggttctggagtagcagaatataactgtcacctttacctaaataatagaaagatagctacataatgcctatgtctgtaaaagattttggtggtaaactcagaaaaatgttttttaaagcacagtatcacgaacatgttatacaataacatatcttagggctccaggtggttgtaagatgtgttctgcaagaatgagattcagaaaaagaaaaccttgtaataacatgtataccatctaaagcaatccataacactgatgatgatgaagacagctctcttttctttagatacttttatctagtaattttcaagtactttataaacatcaaccttaggccctgactgaatgcccgatgtggtgacataattgattgaaggacaactcctaaatctaaacagatccttacactgacttcattagcataagaatttgatacatgtggatgggtgatgtactaacttgatcttttcatcatttttacataatattgatctatatctacatccagtggcaggactgttctgaactttgcacaaaaacaataatgattttcaaagacaacacacttcatgacttaaagtggaaagccttttactgtggacaactgcatcatcttcctgatgctgtcactacctatacaagtagcccaaaccttcaaatatgcaggggtcaggggtgaatacaaaaccacatatggtttacaagctgactgtatcgtccttgctggctggaaaaactggccacataatgcaggctgaacttggagttaaaatccctgtgtcctggtgacagctctgccttcttcacagtgcgcaacctcagaaaactcataacctctctgtctccatttcctcaactataatgtgctctctgggtctccctatccacctcaggagttaccataagctcaaacaagaaaacagtctgcttgtgctatataaactgtacagctgcatacagacaaattaataaaagcagcaaaacaactgcaaatgctgacaatgatcagtcatttagaacagttttgattgccatttatttgggcctatcttcacaaattatttttaaaaataattaaatgtacaaagattgtttaaattgattaaattggactgaatataaaaagcgggtcggtgcactgccagtgtggaactgctcttacttgaggggataaggacacctgcagagcggtgatcaaaggcatgccctttcttggtctctccaagccatctacttcatagccttctaacagccaaaccatcatgacactacggcctagggcagtgagcagggaaggttttcaaggcatgtaaatcgtattcagtgcagtaattcatgggtaagtaattgtgacttgttgggctttgacaaaaatgacatttgaaaacaccttatctgaacataggaacatctgaaaacaccttatagaaagagattctagaaaaagaaaatgacttacttccttcaatgtgagcctggggattcttatacagatgctcaattcgacccgtattaaatgaactggaccgccgtacaattccatggacctgagtttttacagtgtggaaagataaatgtgcaatgaggactaataaacaacttctttagctaatgtttagctttatgaaaaaaatgatttgtaagcattattttaaattattagaaatagtcccactgcttactttctccccaaccactgtccaccagctacgaacatcctacctctgtctttccccagcgattttactgccaatctcaacaaacgtaatcaggtaattatgtgacttcatgcttagttgtagatactcaaatgtctccttttccaaacacacacacttacagcctaactgctgacaaaaatatcttttccatttgaaactgaagacagaccattcgaggccgtgtcggtaaaacagcctttgtggcctgctcaccacagagcaccaggccatcacagcttctcagtggcctcagagcttgcactttgcatctactgtatgtatttctggagccacagacatcatcagagagcagatgttactatgcagctaagtagaaaagtcggaaagctaaagagcatgggtaagagacagcacttatgtactactcgatttaagacctaaagaaaactcaaacgaagagaggattcttaaaattgttttatcttgacttaaccataggtggggggtggggggacagttgataaaacaggaatgtaatgcatacttgcctgatattgaagaaaagactatttgtgtctgacacacaggagaaattgttccagacctggtcccacttccttctcatgtcagattgctccctttgtgctgccaatgctaacaccagcttgtcaccagctgcccaagttccagttctactggtggcagttttaatccttgacttattttagaagtgttccttcttatgctgaaaagttcatttgcagctgaatatacttctatattttaactcaatcatttctatttcaaaccaaaattaatccttggtatgactcaaatattccaaatacggaggtaaattataagaatataagactttctttcaaacagaaagaaatgtcatcattttaaatggcatacatgagaaattgacttctgcgaaggatacaacacacccacagttaatatttctgttggttagttgctttggaagaaaagcactcatcaacattattttccaaaagaacgaaacccaagaaaagttggtaaacacgaaaatattttaggaaaggaacttcgcaaacttggtttcacattttaggaggcaaacattcaaccctaggaagcattaaattgagatttggctatacatatccacttcttaatttaaacgtggagaaaacactaattttaagcttatctgttctacttcatgatctccaatttttcaggttgctacttaattgtaaagttgaactgctctataaacttaattttaacaaaaagtatatatttcacatatatacttatacatagcaaaacttgtgtttactatcaaagttacttatgaaatagatttctcagatgtaaattctctgttttattaaataaaaaaagtctatatactaaaaagagtaatttaagtttgacaatgaaaagaataacaatagtgttatttcggctatcttctctagattgctggattctggggaagtcacatattccaacagcccaaaatatagagacatgccatttattaatatatattcattacatataaacataaaaagctttgacaaaaatattaaatgattttgatgcattccatctaaaatgcagacaactatacaaagtcaagccaatcataaccaagactttactgtcacattaaaaatcaaaagcattaagcactggttgctttttttttaaatcaagtgttttaatttcctctaactcccaacatttggtatgtgtacacagggaaagaaagacctgccaaatgcttaatccatgacagcaggtattattctaagaactaatgaaagctgggtctgtctgcttctgagacaggtgaaatacaaacttcaagacaagccaaaatgtgtgcaaactgcacaatctagttaagaatttgagattagcggctttctctttacagaagggatgtaggtagagctttttgtttgtttttataaggattttgggagaaaaagatatgaggtgttaggaaccaaactgaaaagataaaagagctgaatttggctttatataaacttaatcaaaatcattacaaagttatagtagttcaaaaacaaaatataattctgaaacactgaggtcttacaataaatgaaaatgagttttttgacaaatttcatgtcccacttaacaaggtgataaaatggaaaatttcaagttctttccatttaaaacaaagttgatttaacttcaaaatccacagtcagatcaggtaacataacagaaatgctttattatttattaattatgatcaagaaaatggaaaattattatcactgaatttcaaattcttagtgtctagatttctcttggaggcaaggacgactcccagggatggttaatgtcactcaccttttgaaaagtatagattatttaagtaatatcaatagctaacacttacacagcaatgatcatgtactggacaccgttctctgtatgtatcaaatcacttaatcatcacaacacccttactataatattactggtcccattccatgaatgaggatgttgcctgagataacacagctagtaagtggcaacgttaaaggacatagacttggtcagccctgccaacactcagtatagtttcaacatgaaatccataaaagcttagccttttttttaatcaaagtataaaggcttctgggataacaacccagaagaaaaccagttcaaggattctcacagattaagaaagaaagtatctccatgttctaacaaaaaatctcccagagataacaatgggactaaccttatatccatttcttttctatgctgatacttcatgtcacaatttacctattctttattttaaattctgatacattgtgttgtagctgttaccaagttatttaatatattttcatatagtcccagattttagcttttaaagggttcaacattgtctttacttctctggttttcctctgtacttagtgcaaaatgggtacaaaagtgtgttggtttatctgctaacagtggtgctggaaacacacttagaactagaatgcgctttcataaaaagcttcatttctgtcaatcctccgttttcccttatgacaggaagaaatgcaaacagctccagcttcctaggcaacagaacatgcctgctactcaggaatactcattaatgaatccaactaaagagcctattaaagatctgtgtccactggcttgtccacattagaccccatgtcactctgccacctccagatcaataagcccatgagtcccacagagctccattgggctaagtattttccatatactgtcttatctaaccttcacaaccaccttgggagataggtgtgcttatcatccccatttacagaaaaggcaactaagtctcagaggggttgagtgacttgcccagggtcacggagcctgaaagtggcagaggaagagtgagacacaggtgtccagtgcccagcctgaggctcctttgccacagcgagctaaccactttgtccacccctctggctctgtactggtcaacagggataaaggagaatgatcctctgcacttcagcaatgtgtagaattaagtgtatagcataatcaaagagcgattgtccataaaacccaagaattcttaggtttcctcattatgagatgacccctgtaggtaataaagaatgaaagagtgttacatccattctcctcatgctctccttaacatttaatcctgagcaaaattcaagaaacaaacaacattaaaaactgtccctttaaacttttaaattgagtcacttctcagtgagaagtaacccttcactttttcatttcaaacggttcattcagagcatgatcagatgtgtggatttcagtggccacatttgatggcaaggccccacggcttcaggagtctaaatgtgcgtgaggtgacacaaagtgattaaccacaactaatcaatctgttagtacacgctattgcttttcaagtcatctgcaaatgcctatttttgctttaaggctagctaagttatttatactttcattttgcttttctgatgggagaaaaagtaaaggagtgcgtctaactgtgctacatgaattccatacacagggtttgtttttgcctacaccacccaccatcactaccccaccaacctggccctgctctcctgcatgctcccctccaggtgactgtggcctctccacactgcccatgcttcccagtttcaaaatgcacagctggccttaccactgctaaccaaccagtgtgcctttcttttctagaaagaacaactcagcctcagcatcaagctcttcttcacagtgtttatctgttcctggtttgtcctctgctatccctaagtaggttgtttccagctgttcctgaccttagtagtatacctcatacaaaggctagattcaaaataatatggcaacccagagaagcaaggcctcacggatttaaaatgtcttagggtaccgtgttcaacttcatcatatgattcaatcaatcacctgatctcatctaaacctttagttgtggtggtttctctatctgtagtacccaggcaagcaatgtcacactgactggggtcgtgttagaaagaacaattcccagatccctgaaccagccttctgtgtcttaacagggcctgagtgattctgatgcacactaaaggctgagagtctgaagtctgtaagcatccaaaattgctgatgttgaccaccaccactgccccccaccccgagttcacacgtaataaaatacgtccctctctcatcctacttcatgcaatctactaatcctattcttttactcatggccttcaataatcagggactgcagctgataatttgggaaattttccaatgcagccaatttgaaaaattactctaacatttactttgacctaagcataaaaacataaggcctgtgccaccatcagattcctcctaatggtttattctcgaattatacgaatctcttaaaattgaggacagcagcctattaaagttgaatacagtaaggataaacacacttacagtcccacaatatgcagagagctcacatttcccctggactaggaagagaactaatttctgattatgctttgtggctgtgtactttcccgctatagtgtcaaccatgtttccttctatcagttcacggatctctctcctaaacctgttttctctctcaaacattgtttcaatgataaattcctcccattaactatgatttgccaagtgggccttctattgtctttttgtgtcataataaaatctgctcttacaatttcaaataccacaaaaacatctgcagcttatctggcagtcctaggttcttgttgcatcgatttgcaaatctctcatccttcttgtcttctgaagtctgctagttccttaacaagggacacctaaatggagatctgcttctctgccttttccagtaacactaacagtaccaggtgcttgagaatggttgccatctacacatccaaactcgccctgtcactgtcactgggtccaccatcactgcagcgcatagccgtgctccctcctcctctggactagacacagatgctgcctgttaacaccaccctcacctccagtctcagcccaccttgtccccctaagagtggatcgcaacacttgcgtggttttgagcatcacttctgacatgcctgacacgccacctcactcttcacaagtgcagcgatttctgctcagctagctcattttctaggttcactcgatacacaacaacatcactaattcctctctagccaccaaacatctctcagctcatcccaaatatctgaaacacagtatgggcatctctctgccaagctattccttttaacagatattaaggcgttaggttaatctagcctgaataaatataggtctttctctaaaaccaacactttgtactatacataacctactctaaaactctctgctccgtagaatatgcatttctttctcgattattacagcagcttatgcatatggacatacgtatacatatgtactttcataattccatttattttcatataattacaaaatgtagcattagctcttggataagggtacagaaggtgctaaacatatctactgttacttcttcaagtctaaaagtcaaggctctcagattatgagttaaaagaaaattaactttttttcttcaaataatgttggcatttagatgccaaattctttcctgttgtgtttccatttgccccaattacacatttttaaaacaacgtaccaacaattagaataaacagataatcctaaagtattaatgtaaacattcataaaacagatcagagcatacgggccactgtaaaggtttttttttttttctgtatagcatgaatttatatacatgtatatatctgaaaaacgttctttaaaaaattaagttgtacatacttagcacatcaaaattaatatataaaactattgtttcttttaaggaaaggagaaatggtgaagacaacgacaaaagcagcaaacctaaaagtttcagctccataaaatatatggttgcctattagaaaggaaaacctccaggtataaatttttcattcaagtttgccaacaatcagcttggtttttattgttctctgtaatttctgaattaagtgacttcatggtgagtaggactttcttatgaaacacattacatcataaattaacccgaatcatgttacagcttcgcttgcacaggctgctgcgttatcggagaatgtgggaagtgtgcaccacagctgaacactgtgagtgcaggggagccaccagtgctcaccagcagataaacagcacaatgggttggcaggctcacaagcccaaagacacattcttccccggattctgatttgttatctgcgtttcagtggaaaacacactcaggaggacggcagcagaggaagcatgtggccgctgcatgcgagcaaccccaccagcctgcgcccgcttcccattgagtcacccacctcatagcctttctccagcaggaactcagccaggtaggaaccatcctggggagaaagaaaaaattgcaaaacgtcagtctcatagtggtatagaaaggtggtctagatgaagagttttgagaaaagcatttaaaaggctacctaacttaaggacaatggcaacctaaaataaaaataacaccaataatgtcaataaataccacatggtgttccactatacacaaagcattttcacaaacagtattcatttgagctccacagaagacagaggatgaaaatgaaatccaggaaagtgatatgcatcaacagacagcatgaagttccagaatcagatggatttgggtttaggttttgccacttaccagttgtgtgaaacatgcagaatatgggggcagaatgccttggtgtcatagcaacataaagcagaaatcttagtaattctggggggtcattaaacaagatcactgggggtcaggcacagttgctcacacctataatcctggtactttgggaggtcaaggcaggaggattacttgcatccaagagttggagaatagcctgagcaacacagtgagaccttagcactgttaaaacaaaacaaaacaaaacaaaacaaaaaattggtggagatggggtctcactatgttgcccaggctggtgtcaaactcctggacacaagtgatcttcccaccgtggcctcccaaactgttgtattacaggtgtgagccaccatgcccagcccaaaacatctttaaaaattagccagtcttggtggctcgtgcctatggtaccagctacttgggaagctgaggtgggaggatcacttgaacctgggagttcgaggctggagtaagccatgattgcaaaactgcactccagcctgggtggcagagggagacattgtctccagagggaaagaaaaaaaaaatcactggggaaggggataagatgggaactaggtgggttggggatatagaagggctagtgtggagaggaaaagactccatggtagaataaagaaggccagggggatgtggaggaaggtgagtacctttggagggctggcctttccaggcaatggccacagctggctgctaaccctaaaggttctggaaaatcactgaaggcttgaaaaggttttaaggtggcagggagcagggatggggatcagatttgtattattatgcacacatacaaatgaacttttaaaaaaagaagatattctctttttttataaaatcgtatttcctttgtattaatcttaaatcatatagctaattcctgccttaaaatgaaggtgtctgacaaaatacagagattctcaactggttcttaataattatttttaaaatttctgggtaggggtcttcatttgacctaaaatatttcatgtgccacttttagagggaaagtatgagagacatataattaaactatttaataggtcaaaagttcaaaaatcaccattctgtaggtgctataaaaagtcaccagcctctctcagaaaataaattggttagacattttgcagtcgatcccataactgctcctctgctttctgcccaactagagggtccccatccatctcattcagacgaaaagataaaaatgggaagctccaaccactggaaattcgtgtcctcagaagtggttggggacgtttgggttttcttcggtttcttcaatttgaacaggctttaaatatcccttagagcttcaaaagctcctaccagatattccagggggaaaaaaaaacaaaaaacctttttcttattacttgaccaaaagctggaattggaaacaccctatgggtcctgaaaatgaaaggactgccaagtgtgtgtttactacattaatgcagaagtcatgcataaattcaggcagaatgacaaggcaaagcatacaagggacacattctgtggttcattaaaacctagagcagattttcttcttcttcttcttttttaagatggagtctcgctctttcacccaggccggagtgcagtgctgttatcgtggctcactgcaacctctgcctccgggttcaagcgattctcgtgcctcagcctcccaaatagctgggattacaggtgcgtgccaccacccctagctaatattcatatttttagtagagacgggttttcaccatgttggccaggctgatctggaactctagacctcacgtgatctgcctgcctgggcctcccaaaggctgagattcaggcgttagccaccatgccagggctaaaatctccagcagattttcttctgacttcttgaggtaaatattctagtttatagattcatgtgcagaagagaaaatgtttggcatattcttttttaatcccattcttacaattcttaccgtttttacatatctaaaatatatgtcagataatgacactgaccattatctaagttagataatgacactgaccaattcagaccatgacaagccaagtcgggctacacaaccactgaaaatgttattataggataatcaatatccctataaatcaatcaatgagaaaacagcttaatagaaaaatatttgcaataagactaataatttggcagtaggttggaaagccctgtaaagtatgaagtttggactttgttttgctattattgttttgaagcaggcaacactatacttctaatcattctcttggaataaaaagtttgaatgctttgtgttctaccatagctacattaaatgtttaaaaaaaaaaaagccagaggtaaacgtgctagagatccctgaggtggcaagagctgtgattatttagagagctgatgtgaaacagacctgaccaggactgaaccctgtcaataaggtcttgttcttctcacccaggctgcttctcagactttccaaccacactggaacattctgaaccagtagtggcaccggcttcctcctcacttccttgccaggcctctcgagtgatagggcctgggccgcacaatgagtgggaaacgagccgagcgagggctcctggtccccagcccagggggcccagctggccgccccctcgtcctttccccaggcccctgggggactccaggagagacgtggtatctgagcaggcagacgtccgccaagccaacaggatggtggtttccgcctcctcttgaagcacagagctgataaagaatgctccaatcagactaatgactgaaatgtcacagcaaatgagaacctacaaccaccattaagttctgacgcttgactcctctgaaacaaggaacaaacagactaaatctgtaactcattcagtatgaacacaattattctggtataaagtcctgcctaggttcaatccttgttacagaaaactctttagttgtaaagataatgtcccaatatgacccttttaagtttaattttacacgtgggctattaagggtatctattttatattaaatgccatactattttgagcaatcaccatggctttaacattttcaagacacagaaatattttcctttttttttttttttgagacagaatttcactcttgttgcccaggctggagtgcgatagtgcaatctcggctcactgcaacctccatctcacaggttccagtgattctcctgcctgagcctcctgagtaactcagattacaggtgcccaccaccacacccagctaattttttgtatttttagtagagacaggtttcaccatgttggccaggctgttctcaaacccctgacctcaggtgatccacctgcctcagcctctcaaagtgctgggattataggtgtgagccacccatcctactctcgcaagaactaagctaggaaggtgggcagatatttggcatctcgggtaactgaggcacaggggggttagccaacttttctaatatcacactagttacagacaaagccaggactagaatcctagccacccactgttttgaagtagaaaataatctccttcctcccactcctctacctggcaccaaaacatgtcaaaacccaacaaaataataagagaccataaaagatacattttcaaaccaagttgatgtagtcattttccattacagggtattttatggatgaaacagtgcttccagttctaatcaagtgacccaaatgcagagaagtcatgtaattttagaacactccagagctcagaggagggagaaaggatacagcacctgagattttcccggtctgggtttttgggggactggcactgcccatgcagttgttcagtgttgtttggaggtggatttagattgctggtggttgtaggtccagctttggggccaaagggcagggcaccagggtcccatggggccaggtttcagtgttcctgacgcctatcctgttcttccgaggggatggaccctcacttttcatgaagtactcagaaatgttccagacagagttatgtaaaaattaaagaccaattccagaaattcacagaatcatgttttgactacagtatgacaactacctaaaattccacaactatgaaaagctgaaagaaacacagaaagtttctgtgtttctcaatgaccacagatggctaaaaaaaagactgatctcacatccacacatcccccacacacaccccatcccaacacctatgtacgagggcaagccatcctcccgcaacacaggaagactagcatttttctcctctcttccaatacagatgaataagtagcccagacagacaaacgaaaagggaactttcttacatgcaatgtgagaacctggcccctctgaactgcatgctaaatcatactgtatgtttctacttaagcaccctgtggcggcttctttgaacaggatacggtcatggtactgggctaaagaaaccacaccactaataaaacgaatctctttgtttagatcatctcaggcatcaggaaatagaataaccccttctgcaagaagagaaagcactcgtttgcactgcctttttatgttctttaactccatgttgtctaattactcctaaggcatcttcccagctaatcggaattacaatatcaaggtaatctgtgcctccaataagcaaaacacaaacacttcaatgattaacaaatgatgctgttttgaatgagaatgaaaacttccaatgatttaaccactgctgtgaagaatacggagacagaatataatagaaaggtgtttatacctaggtcatgtttgtaacacaaatcattggacaaaatctctgtcagactcacaaaattcaaaagaccatggggattaattaatccaaccctctcattttacagatcaggaaatggagattcaaagcaggtaaatgtttattgtacagtcacagttaggaagtagcagaacctgcaaccaaaaaataaaaatgaaaaccaggtctctggactcccagacctcagaattttgcactaaaaaataccggggaaatatctaaaatgaagaggctggactaatgactacaattgagaacccggtaaaacagacaaatggaattaccaaagtgaagaacaaaaatagagccaataattatcaatagagcaataattaactaattagtagaaaggaaatgaggataccatcaatatttaaaacacagaaataactcccatctcctatagtcttcaaaggtgaaaaatatttccccataaaagctgctgtcaccaaagaaccaactttcccttcctttgatttacctcctgatacagagaagcactgcaatccagcaacatgatcaataacctctgaataatgaagaatcgtttatgtccagcagctaagatactctttacatagccaccccttccctcctttcaagggcaatagcctcgcaaacaggtgctcagtggttgcacatacacctcaaacctatcaagaaaagagagccgctctgtggccagacacaataccttctagtattgggtgatgagtgtaaggctaaccaagtatcagcatttcagaaagaggccagaggctttcaatcatccttgatattggtctaccatggcacagaattctctcccccaaaacacactcagtttcagtacattgcaatgttatgttatgtccatgattagtttgataagaaaaaaaagatttacatataaaaaatatcaaacagggaagaaatgccctaaaagattaatttaaaaaaaaatactttccccaatgtgataggtttttaaaaaatggtacagacgtgttttttcattttttgactggtagtaacactacagagtttttggtgtttgtggccttaatttttttttcagggaattatatatacactttacctatttttctagtaggctgtgttttaccaattggtttgttcttggaagtatcaagaacatgtacaaaattgactaattttcacctccaataaaagccactcaaaaactgatattttgaagcaggctagcaaatcttcagtctcttttatattgcaaatgattattgtaaacccttagtataatattagagcaaggaagaacgcaaatacaatgtgaactcaggaattcacatctttgcacaacccaacatgtgtaataatactactttcaacatactaaaataattttctataatttaggcaaactctataagaaaaatgagactaaagggtttaaaacaagcaggtacaaaggaagcaactgttggtaaggtatagaaagattaatttttaattaaatgattaggagaaaaacagcacacacacacacagatactccaataaatacagtcccagaaatgctggagaagcctcaaagggacaaccagtccccaacttacgatggatccacctacaattcttcaactctatgatggtatgaaaacggtacacattcagtacactcctcaacttacaatggagtccaagataaacccataatacattgaagatactgtaaatcaaaaatgtacttttgatattttcaacatacgaaggatttatagggacagacccccactgtaagttaaagaacatctgtaaatccaaaggcatctattaacagcctacgtgtgtgctaggtggtacataatatatagatacagcaagggtgagtccacctgctcatcactacgtgaatacaagcatgcccaaggcatacagtatctcactggttttccttttttttttttttcttaacgtaagctccttttatttgaacctctattttcctctccctccctccatcccattcttgccactcatactgaagttttcatccatcagagaaaaaaaaatcttcatatggcctactatcactacaaatgatgacagcagtactaagaaggatagtgagcacttgtacagcacttggtatatgcccagtatgcactaagtgctctgcattcagtatctttttaactcttcataataaccccatgtcattggtactgttttcatctcgattttacagatgaggaatctgaggtgaattgagaggtaatagctcagggtctaatagttagtaggtagaacaaggatttaaactatgtctacttgtaatacattatttatatggcaatttgcttcactaataggatcgatccctctataatggatcctattagaatggaaaatgatgggcctagagatattttcacataaaatatggcttctatagaatgtattaataatgactatcaaacacccatttggaccataggtgttatgggatggaggaggacaggaaggaaataagaaatttagtccctgccctattgctctgagaagtatctgggaagccaggcatttcctggtctagataggattatgtttcaacattggctaggacctccagatttcacacacatccacccacatgtggacagcatgagaataataaccaggtaacctgtacagctaatcaaaatgttcttgctatcagagaacaccagtagatgcatgagtcatggacagaaggtggcaaggctttgtggatgaaagaaaagctatgaaatactaccacactgacctcttctatactggatggcacagtgccctggaaaaataaatcaccacacgagcatgaaatcaggattgggaaaatacacaggaaatacaagaagaatatccctatcagatccttttaaagatctgcctaaccggacagttcagtgctgatgtgagtaactcctttcaagtttacaatatactagctgaaagtttttagaaccagggttccaaatacattaataaagatttgtacaggtgtgtagggaagttaataataaattaacagtgaacttcacactgaaataataacttctttgcagtaaatagctacacatattaaaaaattaaaactgatgaaaaataaaattagagttcctctctcctccctttctcactatctctcaaagtgacaggccatacaattaaaggctgtttctttgcaaagtccatgctttgcagttctaatcactcgagtgatttatagaggaaatgatgttttgcaggtactctaaaacagagctgcactttgtccagtgtgcaaggccatgcttaatgaaaaactttaaatttggaaggaaaaaaactgcagtaaaaagagaagaattatgaaattttagtatttacttgatttattaatgtttccttgtgcatttctttttataatttgtgtcctggctaaggcaggaaggcaaaacaaatgtccttttgtttatggctttaaaaaggtcataagaataacaaaaggatacataaatactgatgactatatctttccctatttcactgtacattaatttaacagtctgctactgaaatactgctgttggttaagcacagagttaactatttaaaaatattcttgtctttttaacccaatttctttcaaggatataattaatccagttaagaccgttcttaaaatatgtgcaggtcatgatagaaatgtcacttgtcaactctctgatgcatttcagatctgctctgccactatagagttccagacagacaggaaacattgtaaatcactgaagaaacatacaagttaagaactgtgattttgttacttaaaattactgaaaaatagacaaaattcaagcatatatcaggagcgtaaatgtagaaatctgtaagcatttacccagaaaggtgcagatcattaaactaataaagctaactcatattcagtgcccaaggatatatcaaattttgtaaaaacaactttaagtcaccggaggcaaggagagctccaagttagcacaaagaatgttgatttcaccggggtgtggtgactggggataggcacacctggcaaaactccattctgtgggctactaaatctctgtatttgttaggttgtgctatattgtgtatttcggttctgccacccaaagaaggtatccaaaataacttgtggtgggcgtggaggaatcacatattaaaagtcccaaagtctgtgcctccttcatgcttgtgcagctgtcttccagtgtcactgccttgtagactgcacaatcatggtgtgattctagatagctcagctccaccacagaaataaaggggataaaatgaacagttggcgagatactgagactgcagtttgaacctctataggactaatgcttttaggttgttctttattttgttgctttgctttcttttgccaacagcagcgggggcttagctcttattcaaccatatactttttaaaatctctactcagtggtactgatagaaaacattttcaagattccactgaaaaagaccagagctttgtaagggtagtggagttctctaggtggaaaaataacttcctcgcctaatagggattggacaccaccacccacatcttggtctcaatagcaccaaactttaaattgccaatctagccaggcccttatgctaaggccgaagtgagtcttaccttcagtgtagaagctgaaaagcaggtaggtgtctctgattcagtctagcctgaccacatgcactttttggtctaatcttaaaatacttaaatgtctaacaactacttctgtttcccagctattctctcctaatatttatgatatatcttggctatttgacagtagatttgagtcatatagttaagtcatatagttaagtcaactatttgagtcatatagttaagctatcaactttctatagacatagtttgccttatactataacatacattcttcaaccttacactatacagcaaagtatttattattgtttctatcaaaataatatcttacattcctgtaatttcttatagttgctaagtactctttagatgttttttcccatttatatctcacaacatcctggtgaggtagctgatattatcctcatttttccggatcagaaaattgaagaaagcataaatcccttgttcaaggtcatagagctagttagagaacttggcagaatatgaaaccaatttgtttaattctaattacagtgttatgtccacaatacctctccctcaatcaaaataaaaacgtttcaaccaaaataagatgccacagcagttttttaaagaaattaataaatttatataaaaacccatatacagtttagcacaaaataatatttcaaatttaagtatcttcaattatccttgcaataatccactatcaaaagccattgcttaaactaatcccccctttaagtatactaaacaacgtgctactgtgtgtatttgtgtatccgtgagtgagtgtgtgcatgcttgcctgagctcatttaaagggatacctttatcctgaggtttaaaaacagtgaggtctgaattttcattgttaaaagcagatcatggagcaatcaatcagctaataaccatctattaatatctgatgtactatgcaacatgacagagtaaatgaaaataagaataagatgcatttcctacatttgagtttctataatctagcgagaggacaaggaaacaacacatctaccacatcatcatcatcatcatcatcatcatcatcatattagcaatgacattaatgccgacattcattcactacatacttctcacattttaggccagcactggccaacagaaatataatgtgagccacatatgtaatttttaattttccagtagccaaattaaaaaaggtaaaaagaaacagataaagatgaattttatttaacacatatatctagaatgttttatgcacatgttaataaaaaattatccagatattttacatactttttcatattaaagtctccaaaatccaacgcagtcaatgaattacataacaacggggaaacattctgagaaatgtaccattgcatgaacattacagtatacttgcacaaacctaggtagtagagccaactacatacctaggatatatgatatagtcttatggtgcctaggttgcaacctgtacagcatgttactgtactgaatactgtaggcaactgtcgcactattgtaagtatttgtgtatctacacagaaaaggtacagtgaaaatatggtatcttatgggactaccattgtgtatggtcccttgctgacccacatgtcattatgcagcacatgactatattttacacttatggcatatcacaattcaaatgtaaattttcatcagaaatacttgatctgttttagatttcataaaactgatcattgaaaaagtaaattcatgtacccaacctgtaccaaatatacttaaaagttttctcataacgaaattgagtatccaaaaaatcattttcctttaattttcacaagtacattgacaaaactggttcacttttgtttaaaagaactgatttgggccaggcgtggtggctccttcctataattccagcactttgggaagccaaaccaaagccaaagtatggcttgaggccaagagctcaaggcctccctgggcaacatagtgagaccccatctctacaaaagatttttaaaataatatttttttaattagctgggtgtgtcccagctgctcaggaggctgacacaggaagattgcttgtagtccagaaggtcaaggctgcagtgtgccatgatcacaccactgcactcaacctgggtgacagaatgagaccatgtaccaaaaaaaacaaagaaaatgtttgttattttaaagtaaactgggcatggtgaggcaggcctgtagtcctagctacttggaaagctgggacaggagaattgcctgagcccaagagttcaagactgcagtgaactatgaccaggccactacattctagcctgggtgacagagtgagacttcatttcaaacaaaaaaaaaaaaaaaaaagaaagaaaaactgatttgactttgaagtataagcatatcagtttcaaatccatatcggttcaagttaagtaagctaattaactcttgtgtcaagtcagtattaacactggattcaaaggaatatttgcataaattggaaaacaactctaaatttatcagtatcaacaaagagctcttcaaattctagtttttgtagccaatatatataatggtatttataattaaaatcttctgcacattaatcattactattgacttatattatgaaaaccttcaatttcaacatgaattctaatatctgcctagctagttgacaaattaccttgtcctttcctgagactttcaaattagttcattcaaaagtagtgtgatctgagtcagaaaacataaaccatactgctatattcccttttttttttttttttttggatggagttttgctcttgttgcccaggctggagtgcaatggcacgatcttggctcactgcaacctctgcctccccggttcaagtgattctcctgcctcagcctcccgagtagctgggattacaggcatgcgtcaccatacccggctaattttgtattttttagtagagacagggtttctccatgttggtcaggctggtctcaaactcccgacctcaggtgatccacccactttggcttcccaaagtgctgggattgcaggtgtgagccaccgcgcccggcccatattccctttttaagtactgaatacttgggcaagtgcccctttttgtttcaacaaaagatcatctttggttggagtaaatattatgctatagaaatctgtgtaaaactcgtccaggactccaccaacaagtgctgctaaagatcacaaggtcactgccttcactgtcttccatttctttctgcaggtccataaaccagcaatgatctatgaatttacacttatagactggataattttaactactagtatgtgtcacactttttgccaagttaactactgtattgtactctgtccagcttcagaatacagtcgaatgaagcaataagagaaataccagcctcttgaaaaattccaataaatacagaattcggtctaagagagctgggtcaactgtaatagaaattaattttttcatatccatctgaaattctttgaaacagtcaaatgtttgaattgaatgttcttaaaacattcaaaaatatctctgccacaaatctgttatttttggcaaaaaaaattacaacatttatttataaatcttaaagtctgtattaatcggacaatggatcatcatactgtataacttacacaaagctaaaggaaagtaattgaaatgtttcaaatttcaaatgggtcatgtagtctataggcaactgtttagtgaaaaatatctttaagtttttgtgaaatatatttttgtctcttctcataattttctaataaaattttggtacctgcaataattccttctgccatctctccatcttaaactggcttcctctatagtgcatgaatccaagacactgtataggtggccaaagttacaggctcatactctgttaaaatttttaaacttaatgaacatttgatatagtttagatttctgtccctccaaatctcatgttgaaatgtgatcctcaatgttgaaggtgcggtctagtgggaggtgtttgagacagggggacagatccctcatgaatgagtgttactgccatgctaacatctgcagaactgagagccaaataagcctcttttctttataagttacacggtctcaggtattcctttacagtaatgcaaaacggactaataaaacactaaattctgctttcaggcaattacttccatcaattcttcattgacctttgagaaaaaacttctcatcaaatctaccacagatttcttgaaaatgtcttaatattgcccatttcattttctttacattttttatacaattgcaaatgagattcatcatgaagtccctagtctctttgtgttcccactgctttgatcatactactaatttctgtatctgtactcactccgcaacagtagtatgccttcacttcaaatttaaaaactgtccatatttatttactaacaagtgatgtagttaccttaattttatatatcacttaaacatttctgggggatgagggataaaaatctacatgtcaggtaccatgtacactacttgggtgacaggtacactgaaatctcagattttaccaccatacaattcacccacgtaaccaagaacttcttgtaccccaaaagctattgaaataaaaaatttaaaacaaacatttcaatttaattactaatgataatgtacttgcatcactataagctgcactgtctgcacaaaatatttaataaatactataaagtgagaacacagaaaaagtatatactgaataaattatttgacaccagcaagattggtagtgtgtttatgtatgctaatgtagtcttaccaaaacaagaaaactgtgtttaacagaaatatatcgtgcactgcttccatcttaaaaatccagttcctcgggtacgctagtcacactgaactgctcgacagacacatgtggcttatagctattgttcctgatcatacgatgagaggctgtgttcatggcagtctgtatttattaattgtggtaattctcacaaggaagagaagtctttactctaattatccccacattacagacaatggaatttaggcaaaagtaattaagtgacttacccaaagtcacaaagctattaactggggaactgggatttcaacccagacagtctgactccagagactcttatccactattccacaccgccagaagttcaacaacagcacagggtttcatgagagatgaggcaagagatgcagagtgtgttaaaaatatatatataaaccaaactactttgcaatgaaaagaaggaagccagaactcacaggaagacgtcgtgaaagagggagaaagacttgagctgcgtagtccaagataaatgctgcagataaacagcccaggcagctgagcgcaggaggagtaggtgtgcgaagcgcgagcaaagtgtgtttagccatgaacaggtaaagtgagtcagctgtggagttaatgcagcaggctaaaaaatggcccccaaaagacacagccacatcctcaccactgaaatctgtgactgatacctcatattagaaaatcatctttgcagatgtgatgaagttaaggaccttgcgttggggagactggagattatcgtggattatctgggtgaactctgagcataatcgcgagagtccttataagaaacaggcagtgggagatttcacccagtcagaagacgaggccacgagaccacagaagcagagattagggccatgtgccccaagtcaagggattccagcagccactagaagttagaagaagaaagcaaggaattctcctcttgaagcctccaaagggaacatggcctttctgacatacaccttgattttggacatccagaactgtgagaagacagctgtgttgtttaggccactcagtctgtttcaaaagccataggaaactaatacagcttagaacctctcaaaacctgcaacatgcaaagcgaccttgtgaatcagcaagaggtcaatctagcaagcagtcgttcccagtctatttaatgagagaatacccatttcccagaaagagagagctggtggtgaaagcatgcaccttttagcatctggcatacctaacattcctctaacaaagtttgggaattcctaacccaagtcacattctggaaggcaatttaatcaagtaagtctgaactttattcaaacaatgcaaaaacgatcgaaggtttttaagaaatgttgcaagaagtcaaccatttggggtgaggaaatccaggaccctgtgaccctggattcagggtagcttcaaagtagcagaatgcattgctttggaagataaaacatgtcagcagctgagccagccctcccagctgacagcagtgaactctgccctgatggaaccacctcctctgggaagtgctcctgtcatgagggatgctgacaaactaaagtggcttcacagtgtgacgagtgagaaatgacataaaagaatgaaagaagtgttgtgctagagagcaatattcaaatgggaaacaaaatagcagtaccttcaagtaaacgaaaggctaaaatatattgttaataacaaaaaatgagctacaaacggttcaataaaagtcaaaggtgaaaccatcaaggggagtgggatcaggtcaacaggaagctgcccatgggcatctgcagtaagaagcacctggccagtatggatcttcctgtggagacaagttatcaggctgccacaggagaagaaaacccacactgcataggaagctggacctcaaaactgaccagcttccacaagtctaagatttcatgacctaaactggacacaggcctgtttatcatacgcacatgtagagctggaataaaaactgaatttcaaaaatattgtgtgaaactaggggtgaaattcaaaatattgaataacctgcgtagcacaggcactgacccaccagaacgtatcccagcttatgtgcctacaggtaggtgcccacctcctgaatttcagccttcataaaaccgtgaacgctgacggagagttggaaacagattctgaacaggcagggatgaagaggggaggggaagaaactactgccgtttaaaaacttcacttgaactgacagcaggtcccccattttgggaagccacaggatgtcaaggaaaggtgaccaggtaggctggaagccacattctaaatacagcatctctgaccacaaacggccggcagccacacactgtggccctgccatctccaaggccactgactcagcacggctgcgacctaacgacacactgggaagtctgggtttggttttggttgtgcgtgctctctctctctctctctctctctcttctctttcttctcccccacaacactcctcctcccacctacactcccccttctctccgaccccgctcctatagcatacattttggttccactggttgccggcttatccatttggcggtaactgtctggtaggttaatgcccaacaataggcacttgtattttcttatacgggggaggtaaattatggcacttgaacaaagaccttactatttaagttttactgcacgtttactacaagccagtttcaattttacgtttttgtccctaggccataagagaaaaaagagcaggttcctgttcatattcgaaggagctgtttaaataacaataacaacaatacctggcaaaagcgggatctgttataggtcgaattctgtccccctgaaaatgtatatgctgaagccctaacctccaggacctgggaatgggatgttagttggagatacggttggtgcagatgtaattagttaagattaggtcatactaaagtaggtggcccctaatccaatatgagtggtgtccttatttaaaaaaaaagaaagaaaagaaaatctggacacaggcaacacccagcaagaatgtcacaggatgatgaagtggaatggtgtttctacaagccaaggaacaccaaatattgccagaaaaccaccagcggcaaggtaaggggcctggaacagatccttccctcacagccctcagaaggaaccaaccctgacaacaccttgatcatggacttccagcctccagagctatgagacaataagtttcagttgcttgaaccacccagtctgtggtactttgttatggcagccctagtggactaacacaagaccaaaagaatcaggagagtggcaactgaaaggtcaggcaaggtggccgggcaagtttggaggaaagagtttccactctttgcacctctagttaactgtcaggaagcccccagactcgcctgcctgtcacactggctttctctggggtccatcatccatcgctcctgagcttggcataagctgctggtccttcctcaactcttccagctgcccctgtccctcacacactcattcagtggaactcacaattctaaatgccgattcaaccaccactttctcagaaatgcatcctgatccctccagcctgcatcagaccccactgtttcccactggtctgtagggtctacaaggacaggaccatgactgcattgctcaacatgatgttgctggttggctggaatacatatttgctccataaattaaaattcattgtccttgggttactaatctcacaggtcctatggctccagcagacacgccaatgccctgatgatgtctacaacttttatagcaaacctgtatcaccagcttggcctctttgtcttaaaacatgagatacccctgggctctggtctcccacattgtcaattgaggggcactactgaccctttctctgcagagccacacgggctctcctttcccctacagaacttctcagacttaaccactgccatccactcccatccccatcatctgggcagtgtccatggtcttcctgccccagcatccaggtgggagcacccacacaccaggataaactgactgtgctactctttacttaaaaatcagcttgatttccattgcctattctaaagtaattttttttaaaagcagaaatcaaatctatgcaagggattaccacagaactgtctggtttctgggtggggaagctgtgaatggctgtgggagaggcaaggcgcctcccaagcagtggcctcccactaccctttgtgtcacactcccaccccacctcttagcaaatcttgaggcattccaggtaactcagggctcctcacaacagtgtagaaatcacaggtccctctggttaaatccagcctttttagtaaaggaatcaaggctcttcatttaactatcacctccattgtcaaaagcataaccaaataaaaacaaacatcttcacgtgaacattccatatcttggctccaattcttccctcccatattcattcattcattcattcatcagaaatctgctgttttaggaagtggtccaaggttacagagatgccttgccttcaaaaaacagcaatgcagtaaataagacagttgtgtccattgacatatgtaaaaacagtaataataaaaataacaggcaatatttaccacaggcagcactggaagtattctatgtgcattagccttctgaacaaccctttagggagggtcccataattatcccaattttaaggatgaggaaataaagagtcttgaggaggtcaggtcaggtcaccagctagaaagagggcaaaggaagattacaaaccatacgttctatgctattttaggtgatcccagtcaggtgtggtcacaagaggccacacagtagaggctcaggaatcagctgattgtcctcagtgatcctagagacaggaggcccgccatgcaggccacactggaacgcctcaggctggtgagaggcagagtgggcaggaggaggagagaactaggccacagtctttaatggacttccaggaaaaacaaggcggggcagggtgaacaggttaggagtggctaagttgaataatttcagcaggctttgggctacagaggtggtctctagttgcctggcacctagccttgaatgatgtaagcaagggaatactgcttcctgaagtgtaagggccagatagaggaggtctgggtatggactagttggtttgtatctcaaaggcatgctcctggctaggccctggctccctctcagaactggctagacctgcaagggcagcctcttcccaaccacaatggtttctaagatgtcaaaacatcataatatatagaaaataaaaaccgtaaataatacaccagactacctgacttcaagccttcagcaactgtgcctgctacatccccagcatagtgactgcacaaagtaaggccaggtaggagacacaatgaaggcctctggaaggtgagaaaaagatccacaaaggcagcactcaaagcacatcaacaataaaggaaacatagaagcttccacgaggataagaataaaagaaggactttccaagcaaagggactgggcaataaaaaggcaacctggccagtccagttggctgctgtgccttgatgtctctggggccagggtcctgggacagcactaaagatgaggatggagacgcaggcctgggcaagaatccctaattttcaattaggtgtatgataacaggtagtatgaatagatttcaagggtttattaagcactaagtatagtgtaagctcacatataacagaaacatttagtacccaaaacaccaaacgtatctaagaagccttaaatatcaaatttttagaccgggcacggtggctcatgcctgtaatcccagcactttgggaggctgaggcaggtggattacctgaggtcaggagttcgagaccatcctggccaacagggtgaaaccccatctctactaaaaaaaatataaaaattagccgggcgtggtggtggatgcctgtaatcccagctactcgggaagctgaggcaggagaattgcttgaacccaggagatggaggttgcagtgagctggcacggtgccactatactccaacctgggcgacagagtgagactctgtctcaaaataaataaataaataaataaataaataaaataaagagacaacccaatggaaacacagatggcccgctgcatccacggattaaaccaacgtcagatggaaaatattcagaaaacaaacaataaaaaaacagcaatgccacatttaaaaatatagtataacaactatttatacagtgtttacactgtattatataagtaatctagagatgatttaaagtatacggaggactgcagtcccagctacttaggaggctgagacaagaggatgccttgggcccagagttcaggaccagcctggctacatagcgacatctatctcaaaaataaagtatacaggaggatgtacgtaagttatatgcaaataccacaccatctcatatacgggactaagcacccatgagggttcctggaaccaatcgctcatgcatactgagagacaactatgctggcaagtgcatgggcaggtatgtcatagaagacaaaacataagtcaccagtaatcacatgaaagatcctgagttttcattagcaatcatggaaatgcaagttaaaaccacagcgaaataacgtttcacacctagcagattagccaaagtttgataaactaccaaaatcaattattaatgaagatatgttaggaagacatgttcttgtgcactgttggtaggactgtaaattggtaaaaccactttacaagatcaacagtcatttattttccaatgttgaagttgctcataccgcaagatgtaggatataccttgaagacatatgaaggtggttaagttcctaaataagggtagtgatatgaacacataaaggatgggcaaagtcaacagttacagggcaagaggaaggaagacagtcgagttaactgaagaatggtaaaaatgggtgggctggtttggtgggaaaagattatacttcgttttgggcattttgagtctccggcattaacaaaatactcacagacaggaattatgttatattacatgatctctaatgactcttgtagccctaaagctttgtgatcttatgatactatcagaaagggccaaattccacggctcactcaagtattttgctataattaacttcttttgtactctgtattcttgcacactcaaacaagctttttaacaacacgcccctctcaaaatgtctttatagtagggatgtttgatttttttcttggttcttcagctagacaatcagttcctgaaggggtatgaaagtgttgatcttctttcctcagagtgccttctactacaatacacaaagtaatttttccccctaaatggaacaaaggaagagttaactgttaagtacaatctaacagcaaagtcttcctaaagataaattttcagccagccttttggagatggaaaggaacttacttagcagagaagaggaaagtgatattattcttggtagaaagaacggtgcatcccaagggtatgaagactggaaagaggatattgctgatagatctggtacaccattaactggcactgcaggaccaaaggtgaaggaaaataggagtcctatttgacttatacttacccagttgattcttaaactcaagatgtttattttcttttactattgtagagtcaaaggcagtatactgggatgaagagaaaaacagtactattcagaaagctgtttggttttgatgaaaccttaaaaaagttaccggttggccaaaatgcaagagcgatggtctgaaacaaatcatgaagataatcaaaatggtaaccatttaaacctctgacacagcagactctgccaagagtagaaaaccaatactagcttgcccccactcacatacacgtttagcgtccctaatttcagcagtacgtgacattggttgctagcccagaagagatgcataagactctgaacctaaagtttccagtgatttggtccaaaaggatattttgataaaattccaaatggggaaggaaagacctagacatcggactcctataattttgaaaccttagcattaattatctccagtctggcgttaagacattggaaacctctgcatcattcccagatcatcactctagagtcccctacatttatcaatttatccctcccctctccacatacatgccaccaccatccatcaagtgagaagagcaacaagcttgtatttctcacagggattcatttcttaatgagatgcttacaaagcagatcatgctacaaaacacagacctttttctttaagagactcaaaaaaatgtaaagatgtatccaagcctagtacatgctttaaatttagagcaagtcccctgagcatactagataattccacaacgtagaaactaaaagtagttgcattttatgcataatgacacagatgtgttgctgacaagttgtcttaacaaaatatttatatattgactcacatttgaaatacgttaggagtagaatcttgggtaaaagcctctaaaaaggttgttgtatattagacattctcaaagtgcggcacccataccatagaattaaactccctgtttcagtcctgtgttttgaaacacatttttactattcctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagccgggcagcaaagtataaatatgagacttacaagcattctctgatctctgagtttgtattcacatctatcaagtttttgtttgtttgtttgtttttgttttttttgagatggagtttacctcttgtcgcccaggctggagtgcaatggtgtgatctctgctcactgaaaccttcacgtcctgggttcaagctattctcctgcctcagcctctcaagtagctgggattacaggcatgcaccaccacgcctggctaattttgtattattagtagagcaggtgtttcaccatgttggccaggctggtctccaactcctgacctcaggtgatccgcccgccttggcctcccaaagtgctgggattacaggcatgaaccaccacgtccggcctgaagttagtcttgatggaaggttctcaaagacctattattacatcctgtgtattatatcagctttgtcaaagaggtgaagtttaggaagctgtgtttcataaaaaccccaaatctgagtaagtctatgggagcaccattcacggacatgcagcaatacggtagaacacgtgagaaactgctcatctggactgcactgtaacacaagcaccctaccctagaggtacaacatgcaggtaccgctgatacagcaggcttccacagcatggttacgaatcatcacatcagacatggagagcacctgagggatcacctaatataactgcttcaccaatgaggaaagcaagaccttgatgacataaaatacggaaaagaataaaaatagacgcacataacatttcttctgcttgctcaaagttatccccgacaatttaagatgattaagggctttatcttggaatgcttagctcacagaaaaaaaaggtaggcaactatatattcttattaattggaaaaatcattgaacagccagtggtttgatttgaagagagcatcagttttgttgatttcattaaaatgaatgtaaagagaacaaggtgtattgactttttatttttttagccacaccaccagcaaatactgcatcacttacatgtgtgtttccttctgtctggaaatcctgggtggacaatttaactgccacagaactcccatgaacaggcacacacaataaacacgcacataaggattatgtgaggcgtctaccacagaatggctttttcagccacctgaacctaggtccattaaaagaaactaggcagcgtggagcagagcagctgtcccaacacaggcagtaatggagctgacaatattcccacgccagttctgaatccagtctattttatgctcttgcgtggattcaaggaaacagaactactatttaaaagtgcatttacaaagagggctttaaaaagcgttagaataaattactttgaagtgtatttctacaacacgcctccagctttcccttcttttcctatttgctcgtccccagaacccaacggtgactatatttaactgactttacaagctgtggggagactgagtacacacagcagattccagccaggattgtgtgcattaactaagtcccaaggttttttgcttgggagctttctctttctttttttcatcttcttcacatgtcttaaaattaccttatatcctggaaataacagaaaaattttaaaagaccctctattttggtttgctgtataggttgagtcctgatatttttaatcatattaacaatatgctcaaggcaaacactgccacgacccagtattcttacagtttgtaagtattttattatttccttgaaaaaacactcattccatctagtacgtattgtgagagaagatcaagtacttgtaaaataattttcatttaggaacaggtatatacagattaacggtatttggaactgactagaatgacaatgaaatcaccaacttctgatcaaggtgaaataaattaatgatttcactaaggccagatgcagtggttcatgactctaatcctggcattttgggaggctgaggtgggaccatttgagcccaggagttcaagaaaagcctgggctacacagtgagactcctttctattttaaaaaaataaaaatttttaaacataaaaataaaatttcactaagtggaatgcctctggctataaagtctacctctcccactaacacgaaactatctccatggaattctagggatgtggattccagtatcagattagctttaccatttataacaatgtcctgtgggaaaaccactaacttcttttggcttcagttttctcatctataaaattagggcttcacaccctaaagtaatctctaaaattatttccacctataagaagcaattatttcagattaagaatccacaacaatcttaaactaaagaatatttaaaagatggggtgtttctgcaaactttgaagattttggccataaactgagttctaattactcagtaaatttaaaagtgcttaggctgactaccacttctgttatcaacacttctatctttaattatatgatacctaatacaagctatctctattccacaaaaatttatacagaccacagtcaaagttcacagcttctagctaatttgaatatttggaaattatgaatgaaatatgattagactgcttttacactggcaaatttcccttagaaatgcctgaactattagcgatatccctagatttaacgagacaaactactttcatgtatttgtctataaggtaatattagcttaaaatatttaattttatgggtacaaaaaatagttagaaagaataagacctagtatttgctagcacaacagggagacaatcatcaaaaataatataattatacattttaaaattaaagagtataattgggttgtttgtaacacaaaggataaatgtttgagatgatggacattccatttaccctgatgtgattattacacattgcatacctgtatcaaaatatctcatgtaacccataaatcacttaatatgtacccacaaaaattaaaaatcaaaaacttaaaacaatttttttattttattttcattgaagatccccaaaagcaaatataacttgtaaaaataattatctcatgtaaatatgaattggagtgaattctgagtaaataaaatttacaatacatgagcaatatagccatttgctagctatgtaatctggtacaagtaagctatatgtctttgtgactgtaatgccaggaaggtaaattcttgtaatcagtttctgagataatgtataaaagctcttagtgtaacctattactcataatcatcttcagtattatcaccagtactgttatttactaagccttgctattaacaaaatatgcaaaaaacctactctttatctctgaaaatttatgcaccttaatattaatctaaaactgggttttctatatttcaatcaatttctcatactctttaagaatttaagacatctgtgtactgtaaatttttctttaaatccattcatcttaatcttgttctaactaaatgtcaaccattaacacacaggtaagaaatgggtatatgattttttcttatgacaaattaaaattagatataactattatttttaaatgtaccccttaaaatatttcatgttaccttaccaatagttttaagaaacactggcctaaactggcatttgctaatctgtaccaggttttcaaattaaagatgacatgttctgttagaaagtccatcatagttgaaggccacacacaagtcgacaggtcaatgtcataaacacagatagttctctaatctgaaaatatcaatatagtaaacaaatacctaagtccacattttttagttccttatactttgactttatttaagaatgatgtttaaagtcctttattaaatacaaaactaaactcaagactacctttctgaaaggctctttaaaatcaaattgaattcattcaaggcactttataggccaatttaatagtatttaaaaaacgtagaatttgttactgctactagccaatgcaattaaataaaagaaagaaaaagaagactaaaattatcatttgattgatgatataactgtatacctaaaacacaagaatttattaactggctacaaaattattattcaaaatcaggagtttccaaatttaaaaatgataacattcaagaaaattatgctgggaggaaatatcctatttatactagcaacaaatttgaacacttaaaatggagttaacaagatattaataggaacaatataaagaaaactttaagctcttctaagatgtataaacagaaaatatttttaaatattggaagaaaattcttgctcctggattagaagattcaacatcatgaagaaatccactgtactctaattaactttaagtttaattaaacaacaagttacaaaaatttggacaggtgacaaaattatatgttggagtcatataaatatgcaaggataacctagatcttaaaaaatattaaaaggatagaatcattttaatcataaaaattatgtattatgaaaatataactatatcagagataccaatgatataatcaaaatctagatacagtcccaaatacatacaggaatgtagtataagataaaggtagcaattagccaggcgtggtggtgggcgcctgtaatcccagctacttgggaagctgaggcaggggcatcgcttgaacccagtaggcggaagtcgctgcactccagcctgggcaagaaagcaagactcctcctcaaaataaataaataaataaaaaagacaaaagtagcatcttttaatcaatggactattcaataaattatgcttggaaacaacattttaggaagcaagtaaagctacagccctacttcattctttatgccaaaagacctttcagatacaacaaaggttaaaaaggaaattttatgataaaatactagaaaaaggctggataaacgcatttacaaccctagaccagggaatattttaagaaggacacaaaatccagagatcataaaggaaaaagactgataatctgactggctataggaaaactaaaaacttctgtagggccaaaaaataccaaataattaaaaagcaaatgacaaactggagggaaaaaatttatgaatataacaaaaagaactaatgtccaaataaacaaagaatgtgtccaatatgaaaagtaaacataacaacagtccagtagggaaaatggcagttgatgaacaggcaattaagagaaatgagttcatatataaatgaactcataaacagatttacaggcaaagatactgatccctactcaaaatgaaataaatataaatcaaaatgaaatactatattgttcacctattgaactgacaaaaaaaagttatctaaaccccactgtgataaggtgttttcatatgctattggtagagatacttttagagaagaaaaattaccctctgacccagcaattccaaagctaagaattttagactaagaatatactcaaaaatgtacgacaagttatatacatgtgcaagaacaagaatgtctattccagcaaaaggcagaactgtatgcagaatataacgtttacagaaatttgtagaggttagacactagtattgctagaaaacataccaaaaattatactctgaagggaagatatagcactagggataaatgtgaccagagagactttatatacagtttgatttttgccttgtccatacaatactttcattaaaaagaaaagtaagaaaggatgcatgaaggttgctttttatgtttctatattcaagcattcaactaattattcttcccaacacgcacaattccaagtcacaatcatgtttattgaaaatttaaattaaaagatttttatatttcagggtagattttagacacaaaaatggaaaaaccatgaagtatatttagtctttcttcttcagctgttggcccagtccacatttttctgacttaaaagaaaaatggtttgtgaatacatacaacaaccctatttgggaacgcatttacttctatttcagaaattctatccaacagcaaaataacatttaaaataaattttcttttctattcagattgctgttaataatttacattaactaacatacaaaaagtaatgttcaaaaagtactcatattcaaaattaaattaagatactgggaagtggttaaaatctgtaatttggattttggcatataaaataggaaagaaaggcagtgaccacaagtatgcaccaattcttttccaactcaaattcagaaaaaggtttttccacctaaacttaggccactcgactccagacattcattgtctggtgccacccaaacgttgttctcttgactaattctagggtttatagtattaataataattacttcaataaacatatgcccagatatgcaattatatgaccgatcagagaaaagctggatttttcaaagtttttatcactaacgacctgaacttttggccagacccaaccctgtgctgaatttcatttggctaaagacgagttcaacaaaagcctcttattgaagagatgcaaaaaaaaaaaaaaaaaaaaaaagacaaaaaccaatctattccaagaataatataaaaagttgaacaatataaaattccagtattcaacactctacagatttttacctacttcatatggttaaggctaatattcaacctttaaagaggctgataactctttcacaacattatcttttttcaacccataagacatgtatcatacttcattttttatatacatttcccatactggcacaaatacttgataaatgtcgaccacttcaaaaaagcaaacaaattaacatctttaaatgaggctttatatgcccaatctgatataatgcaaagatatcaaatcataaggatatttgtccttaacactcagaagactatctacaaccaagtttatctttactatttcctagtaattatattttaacagacaaaacacaaaagctgagaagctgcaaaaaagactatgatttttccccaataattaattttaaaacaaacagaaaattggacagtttccagaaatgaagtggattcacggcatgacataaaaggtaattaccatttgggtggatgtcttttgtggctgaaccttgtgaccaaaggcccaaaatttattttggacctctctcacagttcctccatttaaaaggaagcattttacttccttaccaccaatatatgacagatcaacatttcaacctaattgcatctgactgacaggagaagattagtgtgtaccaagcagcagataagaatataattgttttaaatttttcaaattcaggcaccacgttcacaggagttgcgtattaatggagcactctgggataccatatccttaagaaaaatgatgtgtaagaagaatagccatgataccagtttcctcttaagcagcagctccatcaagctgtttgctctttcttgaaatgaaggataagaatcagtatctctgctgaaaagtatttttaaattaggtcgtgaagatttcccaaatgcgaattctaaattacgtaaatgaaaccagatacaacagccatgatttgaaaagatattttaaactaacctacttataaaatcaaactcaggtataaagaaataaacccacaacaaaagaaaatttaaatcgctcattgttttttacatttattagacttgactattagggttactttttttaatgattccaggaaggaagaataattgttagctttcctaaatgtcaagaaaaatctaaatagatggataatatagtgttttcttgctttaaatattttcaattgataccactttctgattcggggcttagaaaattataaatatattatagagcgtcttgaaaagctggttctcccatatttgtttgtatgttgcatgtcataatttcaaggtaaaggtgtgaaaggaaaactagcaacagactaattgtcactcaaaaaaacaccttcctatggtaatgcaattatctctacgtcactatcacggtgaatttttttagatgtttttactgaaaaaggatattgattttttaagaaaatcaaaggcaagcctgcctgccttgcacagtatcagcccacagcacatgctcgacaaatggtgagattaataagaaaacaaaagagaatcaggcaaacaagcaaataatgactttcacaacaaatttaagtcactgtttttttacaaatatagtcttagaacatttctttgataactattaaaatattaagtgtagtgatactttgttttaagaaataaaaaaaacttaaatttcaaaatatgaccaacaaagcaaattactttctttttttcctaaagtaaggtaagaactgagattatgattcaaaacatcactatttttaaaagatgaatatgtctcggggtagatattatgtttatctctgtgcatgagaacttttaaacttcctttctgaatatacatctattttctttacatatgccatatataaacccatactttcttcaatgttctgttaaaatgagaagaaaggaaaaaggtctcaggattttaagaaagccaaatgccacagttttctctgtacatattgctaaattcattgaacataaaactatcaacaaattattttaaaaatcacagaaaaactagttcagattttttttctacctgtgtatataataaacttttattccttcatattccagaggaatttaccttttgtaaaaagtactgcagtgactgacagactcactaaaaactccatttataactgtagcacagcacagatcgtcttcatagacttatgttctagagcagagcttctcaaactttacttgtgcatccaaattacttgacatcttattaacatgaaagttctaatttcagtatgattgggcaggggccagagactctgcatgtcttacaggctctcagaggacagtttatctgtaaaccctactttgggcaataagtttctagagacctccactaagatagtcaagtgcattcaaattctttgtcttctttctgactgtgggcaatatgattgctaatttctgcggtagaatgcaagctattgtctttgattcattttaagtgagccaggaaacaagtaagtggtaagaaatctatgtctcagcccactgaccaaggacaactaatctgctgacctgagtagaaaagatgacccatccctatggctaatctcagcatccagatgttgccttaaccagaccagagatgccagtgctcatcttgtcttgtgagtaattttcactaccaaaacgaaatctataggggagagatttgccaaagaaattagggcttcagtaattaggaaaccacaaggcactaggcatcttgcatcagccagagatgaatgggaacacttgcaaaagtatttcaccattagcctgttttgtgaaagagagccacaggaaaaaacaggaattttaaaattcctttattactcaatacaattatatgtttcagcctaaactaatgctggcactgttcaacagaattccttcattcctcaagggtaaaatgagaagcagaacaaatacagatggtctatgtgactctttccctgagtatctaagagagacatctctgtttggaaatgggcattaaaatctgcctgcctgatacagttctgattcactattgtctctaagatggtagctgaaacaaaaacaaacctcagcccccaaaaccacatcaatacctccttcctcatgaaagcaccattctttcatgttcaactcccacagtggccttttcatcaccttgctggttccagcttttattttcccttcatagtttctagtaatgctatatatataatagtttaaaaacaatagcaaaatagtttctagtaatgctatatacatatatacatacatatataatagtttaaaaacaatagcaaaataaaacatatgtacgcataagggaaacagaattcaaaggctatctcaatttgacattcatgtaactgctctgggagggattccttaatttataattgaaaaaagtacttcctacagtttggtaaaaatacaacacaaaagtaaagcataaatatgtgacaactggtttttctgaaaaatgaaaaagaattgtaaagcaaaatttccaatcaacctcaaataaataatctagatgctaaaataaaatggcattccccatcagttaaatggaagtgataatgtttcagaagacatcaaaataggaacttccaacctcagtaagaatcacaaatcaaaactgctcactccttagtaaaaacctctttggctatctgctggccactttttgtttatcaagatatttggtctgacttcccttcagtattggggcaagaaagtggggaaagttaggatggggacttagcgaatcgcttcttaccgccccctagcgctcactcaaagcagtggcaacatggatgcgctgactatggcctttcctttgccaaccggcatcaatgatgcttcctccccacagtgtccacggtggttaattccttacgctgccagaggcggtgaggtgagccaagttcttagctgtttttgacaagtatacctacttacatcaaaaagcatcaagcttaactctcacaagaaaagaaatcactgaacattaggttggggtttagaaggaagataagtaattatgtgctctggataaacacaggtactgaatatgtactgaatttttcctcaattttttagaattgcgacacttcatgaaagtcaacacttccagtgtttctatcacatgttaagttaaactaagtccaactttggggatacatattaaatttaggccaaaaaagttatttttaaaaattccttctacgtatagttgacccttgaacaatgtgagggggaggagacagaggggtaccgacctcctgtgcagtcagaaatcctcagataacttctgatcccaaaaatttaactgctaattgcctactcttgggctcacatgatccgcccacctcagcctcccaaagtgctgggattataggcatgagccaccacatccagccaattttaacgttttatgatagatttgtgtatattttatgagagtaaatgacaaaacagactaatatctacatacattttatgcattcatggcatacctttttcttaattttttcaatatttctttttttcttttttttttttttttttttttgagacagagtcttgctctgccggccaggctggagtgcagtggcatgatctcggctcactgtaacctccatctcccaggctcaagcaatgctcctgcctcagcctcccaagtaactgggattgcagacgtatgccaccacgcccaactaattttggtatttttactagagatggggtttcaccatgttggccaagctggtttcgaacctgacctcaggtgatctgcctgccttggcctcccaaagtgctgggactacaggtgtgagccacagcacccggccaattttttcaatatttctaggctacacagttcatctatgtgttttttcaaattgtcacaaatctccaaaacatcttccaatatatttattgaaaaaaagttcaaacccgtgttaagggtcaactgtaatatataaaatatgcaattttatagtcatattatatagcaccatgcacaggagcataaattaacaacgaaacctacaaaaaatcttgggctgaaaaaatcattcaatcttttagagttaatagaaagcaactatgaacaatttaagcctaaatattaacatatttcaaagaaaaacataaacttctcccccattaaagaaaagtagtactatattttccaacagatttttactacatgcgatagtttttatctttctaaattgcaagttcagccaaaatatcatatctgaactctgagaagagtgaagttcggataacaatttctcatcagaagagtgacagtggctgacattaacagagagtgtccaggccttgcactaaatatgtaacacagcttctaacatttaatcttcactaagatataatggataagcactactatgatcccattttataggtggaacacttttcagctagaaagaactaggaatcaacctaggtctgacaccaaactccaactttattaactcttttttaaaatagattctttttaaagacaaattttcaagttgtagaaaaatgtcattcaattgtcatggttgttatataagtctatgaagattttgagacaggtgttgcccaggctgcagtgtagtggtgccatcatggctcgctacagcctcaaccaccaggtagttccagctacctcagcctcctgggtagctggaactagaggtgcacaccaccacacctggctaattttttgtagagatggaatttcaccatgttgcctaggctggtctccaactcctgagcctaagctatccacccacctcggcctcccaaagtgctggattacaggcatgagccacgaccacacctgaccaaagactctgatgtattgttgttcaaactcaatttactgaatgagcacagactgcaaatattccaataaataccacttctctaaatatattttctttattctttcaagctgaataatcaatgaccataccctgaagctctttgaaagaattatttttaataaactttgtcaaaaggattatatgttaactttttttttttgagacggagtctctctctgttgccctagctggagtgcaatggtgtgatctcggctcactgcaacctctgcctcccaggttcaagcaattctcatgcctcagcctcccaagtagctgggactacgggcacaccatcacgcccagctaattttttgtatttttagtagagacgggatttcaccatgttcaccaggatggtctcgatctcctgaccttgtgatccgcctgcctcggcctcccaaagtgctgggattacaagcgtgagccaccacacccggcctatatgctaagataattttaaagtataaaatctttagttctgtgtatatgttagttttgctcactgactgaaacaagctgttaaatagtaacaaatgacacgactgaccacaggtgctttcagtgcacctactgtatctaccatctgacatcttatgagtactgggacaagatttaggaattatcagaggattgacagcttccctcaggaagcttcacagtgtttcttggaggttttctgtttcaatttgggtgtacttgaggatttgaaaattcattttccacatcttaataaaactgtgctataaagtgctgacccagaggtggtgggggaacccccaattccccactgtgaccttcaaaccaatcagtctaggacagaacaaggacctacgtggggctggtgaaaaagataagggacccaacagagaaaccaaaggacccctttaagggacatttcccaaactgtccctgaaacacaaaaaagggctaagggtttggtttcaaaggacttcctggctgtgactcagactgctaaaaagtcaaaataaaaggagagaaagccaagacctcattcaagcaagtcactaatgacaggagtcactgtcaataaactcaaaagcaagatcttgccacagataagctacaatacagctaattcactcagaaaaaaacagagctggttctctatgcatgttttataccacaatatattcaccaagaaaaataatattctgccaaggaacatcttaatgacacaggaaattgtctatgcttgataaggtcactgcattcatagacaaaaatctcttgagactaaactggccccagagccacaccaagatatacattccaatgcctattttaaaaataaaggaagtccattttccaaggagcagaaagaatacctgtgggtgcctaggttctaatcatgcttctgccccaagctacatgacctgggaattgtgagtaagccacagcgtagggaggccagtttttgcaatggtgacaaggaactgactagacaagtttggtggttctcaaaatctcctcccatggaacaccagggttccactaattaagactgtggctttctgtggctcaaatcaaataatagacatctgtttccaaagttctttcccataattttttccttatacctctggggcttgaaagtacttgtctgctaaaaggaagcagaaaaaaggagtagaccttattgttttttctagtctcatgtattcagggttagaattttaaacttcatacttaaaacagtcttacttattgctagcaaaattattcctggttcaaataatagaataaaaatatcaggttttcataacattccaacacacacacacacacacacacacacacacacacacacacacacacacacaaaactttcctggtgcttccctacattaccagatttgagtgagacccatgagataagtaacgtctaagaagtggccctgggttgagaggagacagcagcagtgatgcatacttcccacccacactgcttccacaggaaaccgagttccctcctgctctccaagctctggggccactgcaatttcagttcattcctgccatcctttgttccttgtggccatccctctcactcactctatcggctctgggactacatcaaaaaataaaaaattagaggagcaacagcccactgatctagacagctctctcattttctcattgatccttgcacactgtagtgtagctgatgtaaactgtcgtaaggaaagtctggacaagttcttgatatattcaatcacgaccgatgacatgtgcctaggaggctacttttataatgctgaataataggcccaggtgacaataataaactgtcctaacagtgaacagggactataaaaattgcctacaagcaagggaagtgtcagaaatcctgtcatctgccttgattctcaggtggaaagagaatcaccaaggaaaagtcagatttccaagcccactcacatcatgtgggattcttgagcaggtccacagggtccaggagaggcaaacactaaatagctgtgttagtcagggttctccaggaaaactggaccaacaacatgtgtgtgtctatgtgtgtgtgtgtgtgtgagagagagagagagatttactacaacaaactggctcgtgtgattatagaggctgagaagtcccaagatctgcagtcaataagctgtagacccaggagagccaatggtgtaagttccagcatgaaagctgacaggttcaagaaccaaaaggagataacattttaatttgagtccaaagggaggaaaagaccatgtcccagctcaagacagtcaggcaggaagagttcttacttgttaagagggtcaacctttgttctattcaggacttcaaatacctggtgatacctacccacattagacacacaggatgaactagccaacaccacaggctgagcgctgccacttggcccctgggatccaattgctcctgctgcattaggtttcccaattcagtgactacagctcccactgtaaggcctaacagacgaaagcaaccacagagctcttccaggatgctggggctcccgtcacaaatgcatttctcaccattgtgaaagccatgtcttctggaccctcccgtggtgggcaagtaggtctttaacgacaaatctactctaacatttcattcttcctaataagcctttgaatccttttctctacattaaaatgagccaagtctagcatttctaattcaatcaccgtaggccaccttttggtccatggttcagccaacccaacgtactattagagcactttctgactcactaaactgcaacattaaatgcagaatctttgcttagtgagtatatgtcaacaaattcagcccgatacaacttcacgtttcttccaccattattccacagtcttaatatacatgcccacatttgttccccaggtttctgtctgtataggttagaaaactcaagtagttattttggagtgtagtgtaccttctcaggggtcatgtcttgaaccttcacctttaggagcctgctggagttactggtctaaaaacagagccgtggtaaaggtgggtcctgagtagactcagcattatcttacaaagcaactgcctcaaggaagccactacagtttccttagacaatgcagggttaatgccctcaaacaggggtggagaggctactcccattgggggtggagaggccacatccactggcaaagaggactcatcagaatttagggttcgatatccccagcttcatcaggatcttcccacacatccccatcccaactttcggcacccccttccttcccaatcaatgcctttaacagtattcaccctatgagactgggagttcaatttgcatcataatacagccagtcacaggataagattctgggttttttagccatttcagccctgcaactaatacaacttaaggttctccttcagggcacacatacaagccttcagggcatttatgtggtgtttgagctggaaaataaaatgcttgagctcatccttttctttccccactttgtccagtgacaaccagccaatctcaccgtatttgttagtttaccaaaaatgttcaaaaatatcatatacacagtacccagatccttgattgctttaagtggttggttaggagtatccaatggtgatatcttgtatatctctattgccagatcatgccatggcctatcagtgctctccttactactggaaagagttatcagcatattttagtcttatcagattagagagccacttctagaaaccccagaatcacattcagaaaacccatcctggaaactctgctcctctagaaccactcccagtaccaaaatctgtactagtcaggattctccagaaataggaccaataaagtgtgtggagagacatagaaacagtatgagagagaaactggcaatcccaagatctgcagtccacacgctgaagagccaggagagccttggtatagttcctgtctgaaagccagcagctttgagacctgagaacagctggtatttcactttgagtccaaagggaggagaagacccatgtcccagctcatggatatcaggcaggagaaattccctcttactcatgggagagtcagcctttttgttccattcagcctttcaactcattggatggggcccacccacattagggagggccatctgttatactcaagtttaccaacacaaatgttagcctcatccaaaaacaccctcacagatacacccagaatgtctgaccaaatgtcagttggcacacaaaataaccatcacatagcatagtatgtttatctcataatctgcatcctgtggaagacaactcatgttaaaagctaaataaaataatgtcagctcatatagcatatattagacaacagaatattctccacaggactttaaaatatatagagttgagacataaaggaaggaatcaaattcataatgcaacaagagaacactttgaaataaaaatgggcagttctgaaaaagaaacacagacattccacgtaggaaaatacatagttattaaaatgaactcaaggatgggttgaacagtagacttgacaaaggtaaaaaaataaagataaaaaaaagaatcaaggcaaatattagaagaaatcatctgaagttactcagagataaaaagccagtaaatatgaaagacaagtatggaaacagactaaatggatgacagactgggcgacccaacaagcaaagcattcaacaggaaaaacaaaaaagaagcaagaaaacagagaacgtgagcattcacgttaacactcgcagaacactagccagaactgaagacggtccccatgcagaaaaaacatatggagtatcaggcagaacaaatttgggaaaattcactcctatactgaatatcttcagtttatcttactgaaactccataaagtaactgacacaaattctgagggaaagaaaagcccaactgttcccaaagattcccagtaaaaataacaacataataaatggctgtcagtttctgtgctgttactctttgccagtccctatactaagaaaatattacaattatctcttgtagttttaggcttcaaaacagcatgtaagaatattttcattgtacagatgaagaaacaagctcagagttcaagtaaattacacaaggacatctgaaattcaaattcggatctgactctgaaccctagaaccttattcatactactcctcacaatcacccacaaatagctgctcttagattcttcatctggaatggcagagtaagaagatttatgtgaagaaagattttaaaataatgttcccaggtcacagagttaataagtatcaagtcaggcgctatcttactccaaaagcatgctccttctgctgtgataaatcactcatcagcaggcctcagtttcttcacctgcaaaaaatgtggccaatgctaattgttctcccagttcctccaagagtctgacaccttgccagcctgtcacacctagtgagcaaaaccccaactctgccatcccactccttcctcatcagccaagatcttgtttacattctctgttcctaatcccaggcagctgaaataggccaaggaaaatcccagggaagaccgttgcctctacaaatagatgattcaattgcaattgcatagtcagaactgcccagcaaacctatgacaccttcaaggccactgtttctcccaagcaattttaaactgtgactgaatcattacactttcccatttcagtaaattcaccaatgacttcctagatacctaattcagtggacattttttcagaccttgtcttccttaaacttttcgtagcatttcacttggttaaccaggaagatatgggtgctaatactcacccagtcacttaaggcaaaatgggaaagtcatcctagatgtctcctctatacccaccaattagtcaatacattctatctattctgtcttcttgatacttaccacacccattttctttgttttatctatactgcctcatctagctcctcatcatccctaatctcaactagtatactagtttccttactggtcatcacacctgcagtttcatttccctctccaattcattgtctaccagaacatcatctaccagaatgatctaaaagctagcagaatgatctttcaaaattcaaatctcatcagagtcaaaacctcttcaactttacaggtcccccataaaccttaattctaccagaagacatacgatgcccttatgattccacctaatctcttgccatgcatcttcccccaccctcacacgtaatatgccctttcctgtctttacatgcagcttcttcctaaaatgcctgcccccagctagcctgcctgaaaaaaacccagcccaagccaatcctcctctgataattcctctggctgctcttacctccttgctcccatcacaagttacacagacttccatttcggcaacatcccactccactaaatcgtatatatatactggtattaattccatgggaacaacattcctcttgtaccttcaatgcctagtgaaacaaccggattcacacagcaggcagtcaataagtactgcttaaataagcgaacaaatggctggatgactaaggtgccttcattgaagcatttattatgtcctaccaattttaaaaattcctttaaagtgaaagttagccaatactgaggcagaaagcaagacaataccatggctcttctttgtgggtgtcatttcatgcccctacactgaggaggtacaaacttctctaagggtgccccttccatctttattgtttctacatttgcctgctctttcccttccttcctcagaaggaaagatgtgttagcaacagtcatgctccaattctttccatttccctccttagctctctgagggtctgcaaactgcagggaagggtgagcgtgaagcttgttctttaccaacaacagcatccaaaaccaaaactaccttgataccggacagcttcatgcgcaccactttaaggcctgagatccatgagtagaagaaacaaggagcaaagcaaaaggtcacttccctacaaacaaaatgtgggcctcagaatgtgaggcaagaaaatcttacatgatatgaatgtcagatggcagcctttagcctacatcaccacaaatcaatattaaataactaagacagtgtatttatacattgagagaggatacactgtagaaaagaccctaactatgcttccatttcataaaccacaaatttagatttctactatgctttttcttttctttgctgtactttctgaagttaaatgaatcagttaaattcttcaaataccagtcagaacacatcaactgcttcttttaaaagaaactcttaaaatggggcaaagtagatgccaaataaggactctgtttctaaacataaatttaatacaagtattgtaagcaaggtcaaaattattaaaaggaactccacttctgaatatttagaataaaaaagtctgctctcaattttgatgtatttctaagtccttacagccaacaaagaacaaaaaactccactggtatttaaaattctatctggatatattacactgacaagatatgattatataaccaagaccgtatcatgtaaatactgaaagtttaaagtcataggtagaaagaacacttgaataaagatactaggattcagagagaatttgtagactttattttagactccacagtcatctttccagagggaaaaaaaactaaaattctcccacattcttagtatctaggataaccttaaacatcagaaggtgttaaattcacccaacatgagtcagggacaaattaagaactggaaggcactttgaaaaacctaataatgaaacagaagttattaatatcgttattacaaaaatacttaaaagtccatttgatattaaaaccagttgaaaaatcttcataagaaagagttccttcaacaacactacatataacagtatggtggctcacgcctgtaatcccagcactttgggaggccaaggtgggaggaacacctgaggccaggagttcgagaccagcttggccaacatggtaagaccctcgtctctactcagaacacaaaaattagctgggtgtggtggcaagcacctgtaatcccagctactcaggaggctggagctggagaatcgattgaaccaaggatgcagaggttgcagtgagctgagatcacatcactgcactccagcctgggcaacagagcaagaatagtttaaagccaccaggcagcaaaaaaaaaaaaaaacaaaaaaaaaggcaatataattttaagttttctgggaaaacagaggccatcagaagaataacttatttttccctttgatttcataaaatatttgccaggatctgagacttttaacttacacaactcctacagcagaacaccatcctcaaatactgattcaaaacacagatccagagagaactcagttacgtgttcagctggcaagccctgactatcaattactgctttaagggtgctgggctgattcagaaggtgctatctggtggtatattagaaaagaggactggctgggcgcggtggctcacgcctgtaatcccagcactttgggaggccaaggtgggccgatcacctgaggtcgggagttcacgaccagcctgaccaacataaagaaaccccatctctattaaaaatacaaaatcagccaggcgtggtggcagatgcctgtaatcccagctactcgggagcctgaggcaggagaatcgcttgaacccgggaggtggaggttgtggtgagccaagatcgtgccattgcactccagcctgggcaacaacaacgaaactacatctcaaaaaaaaaaaaagagagaaagaaagaaaacaggattcgactttctccatgcaattttaagagaatgttattacttacagattggtttaaatccattatccttgttaccatatgttctaaactaaatagaagcacaattaggccaggtgtactagctcatacctataatctaaacattttggaaggccaagacaggaggatatcttgaggccaggagttcgagaccagcctgagcaacacagcaagaccctacctctacagaaaaaaataaaaattagatgggcatagtggtgcacacctatagtcctagctactcaggaggctgacgtgggaggatcacttgagcccaggagttcaaggttgcagtgggctatgactgcaccactgcattccagcctgggtgacagagtgtgaccctgccttaaaaaaaaataaaaaaaaaaaaggcataattacattacagactaacccatttggttaccttttttagaagttaaaactctaaaaacaggccaggcgcggtggttcacgcctgtaatcccagcactttgggaggccgaggcgggtggatcacgaggtcaggagatcgagaccatcctgactaacacggtgaaaccccatctctactaaaaatacaaaaaattagccaggtgcagtggcgggcgcctgtagtcccagctactcgggaggctgaggcaggagaatggcatgaacccaggaggcagagcttgtggtgagccgagattgcaccactgcactccagcctgggcaaaagagtgagactccgtctccaaaagaaaaaaaaaatactctaaaaacaagtatgtatcagactgaaaaaaattactacctttaaatatctgtcaatccaaatcatagtaccaaaaattgcaaatacacattggtaaatgaattcaggaactcatgaacttgaattcaggagtctgtgcttcttaatcttaagagtaaagcttatggcattgtcacacaactttcagtggtctgaggagcttaataaaatggagtgatgagtctgtacacatattcaaaagattaaaagaataacaacaaaaaaggaagacaggacagagacagaatgtaagtaatttgtttaacattttcttggcccattcggtctgctataacaaaataccataaactaggtgcctagttctcttctttctcacagatttggagcctaggaagtccaagatcaactacccgaacagacaagcaaatggcaaaaataaataaataaatggcagatgtgttgatgattagatgcaattaactgagtggagaaaaattaaaatccagaaaacaaacacagaataaagtctgtctaatttacctatgtatctctaggaagcagtcagtaaatatattaggatttaataaagagaaaataaaactaacaaaattgtgcttgctgcaggtgggtggatagcacagggaacaaaaaatgagatcatcatcctaaggactcagaaatacatagtgtgaaactatttaccacagaagccagaagaaagcatcaggaaagtcttcaatatccacattaaaatgcacaaagacttccatgaaaaaggtgcaaagagccacaatgaaagaaagaagttaaggtaaaaagataataggataatgtaaggagatgaacaaaataaggaaggaaactaaaatgtcaacagaacttaaatgcatacagagagcagtgaggggctaaactgacgcaataaatggcagagaaacaactcacgtggccggctaatctgagaggctttcccagactgtagaattaaaaaaagataccttccaaacactacggaagacatcaaagacagcatgtgtaacaaaaagcagacctcccaacccccacgaaaagcaagaatacatttaaaacaaaaaataagaaggcacaagtagaactgaacttatcttttatgatgatcatcataaatgaattgacctccccaatattaaagacaaagtctctcagattgaggagaaaaaatgagatactacctctcaaaacaaccagatatgttgtatctcaagaagataaaaataaaaggagagagtgacaatatgaacacaagacaaaatagaattcaaggcaaaagtattaagtggaacaataattaagacacaaaaagcatgaatttctgtttgaactaccattacactgaaagattaaaaagaattgatatggccgggcgcagtggctcacgcctgcaatcccagcactttgggaggccgaggcaggtggatcacgaggtcaggagttcaaaaccagccttgccaagatagtgaaaccccatctctactaaaaataccaaaaaattagccaggcatggtggtgggcacctataatcccagctactcgggagactgaggcagagaattgcttgaacccgggaggcggaggttgcagtgagccgagatcgcgccactgcactccagcctgggcgacacagtgaggctccatctccaaaaaaaaaacagaattgatatgacaaaatgcaaaaagtattagaattgcatggaaaactggtgccccaaaacctactcacattagaagagcacacacctcagtctgacctactgtgtaggaaaaacttaacaaagcatggaggactggaattatacaattgataacattagtggatatcaggctttgtactgacattttaaaaatatatcttccttctacagcattcatgaaacatttgtaaaaactaatattaacatattaggccacaaagaaaatttgaaaatttcaaaaagttccaaacaaacataaactgtacacaatgccgtgttctcagtttccaaagaaataaaattactaattttaaaatgacacaaatattagaaatttttaaatactagtctaattaatggattaaaaaagaaatctgcacttctaggttattttaaaaacaacatactactgcttatcaacacttaggaaatataatcagatacagtctgaagaaaattgagtcttaagcctttcattattaaaaatagaaaaatcttcctgcctacttgctgatacctagtttatccaaaaagagcaggagggtagaaatgttttcatctacagtaagaaattaaaggagttaaagtacaaatccatagtttaagacaacatacttcagaatgaaccagttttaggccacctgcacccagccgatgatttgataactttaactaataccagatgcttccatgtttttacagggcatggagggaaggagggcagcaaggcagagaaagtcacggatttagaagggttcaaaagtagagactgggggcacagaagacagtttaatatgtatccatttttctttgtataattaattctgagtgggcataaattgaagttatacagagaagtagtgaaaacaggaagttctattctacatcaatgatacaggaaaaaataattccctgattgcttataaaggctgtggttgcttgtagttctgataatcaagagtcaaggaaaatacccaggcttctgaattactgcagtggtagcttttataagtgcaataagcccatattcagagattataaaatagatggtttccacacccactgagtcttacgctagcatttcataagattggttttaggaatatctaccattcctcaagcatctgagtaacatttcttctcatcctaaggaacagaaagggcaggttagcatcgccaatttacttagaagcaaactgaggtccagaatgggtccaaaggccatataactagaaaggtccaagtgaggattccaaccctcgatcccaatacattataattattgagtaaaaccatgagactgaggaccaagatatagatgaattacaggctacgaacagtaactaatcatgtgaccttgggcggtctcactcattcaataaatatgtattaagcatcttctgtgtgcaaggttctgtgcttagatgctggaggctcagagttcctgaatttcaaaaaatataatcaaatacacaatctacttcaaaaggctgaggggatggatgataaaatgcttacaaaagtactttttaaaaaggataagagaatgtttgaataccattctttcctgctaagatatcttcaggtctcgcatagaaaagtttagaactccatgcttaaattcacccatttcatcttttttaatgggtgaatttcatcttttttaaactatgcttgcagagtatctaaatcaaggataaagaccatgctaaattttttaaaactttattttttcatcttaagtattgttgagacaatcaaagaatagccacaaacaggaatagaatttaatggtgcctagttttttttgttttgttttgttttgttttgttttttaaattgagacggagtcttgctctgtcacctgggctggagtgtggtggtgcgatctcggctcactacaacctccacctcctgggttcaagtgattctcctgcctcaggatcccgagtagctaggactgcaggcacgtgccaccatgccaggctaactttttgtatttttagtagagacgggattgcaccatgttggccaggctgatctcgaactcctgacctcaagtgatctgcccatcttggcctcccaaagtgctagcattataggcatgatccaccatgcctggccgaatggtgcctagtttctaaaggctcaaccacaaatatgaaatataggaaacaggataagacatgcacctgggaaggcagaagccttcaggacttggggccaggtctacagccactgtggggcatcagggctctctaggcaggccacacagaccacaccagaggaactatctcatcatctgaaggggaaggggggtgagggtagctatttgaaacacagtgcaaagtaataattttaaagatctcttgagaagtcttatggttggatgatttggggatctatgaaataatcacatttttgcttcttgaaaaaggagatgttttatttattaatgtaagttaacttacaatatattaactcaaaaagagaacagcacatgttatgcaatataacaacagtaaattgaaaaattgaaggtggataaaaatattattaacctttaaaagtctcagcaatttaagcagtctaaagaataacaaaaatatggttcctgtcactgttgagctcaaagaggaaattcttttccaagaagacatatgccacctcggacttgaggtagaaaagttactatgtaaaaactgttaagcaaaagagacatcagacccactactctgcagatattcctgagggagttgtgtcgacagaaaaaagagagcagcattactatacctcagcttgggaagaaccaagaagcagaggttgtatcatttcactcaatgaattgcccctctccaatttaactttccagtcatgctcacactgtcattacccaagcctcacagaacagagctcctgagaaatgagcatgctttggttttaatacacgtacaaaggcagatacactgcccctctcatgttaccataaataaaatatccaataacaatttctattaacaataagagtaattattatttttatagctaacatttatatagcccttaaaacatgttgtaagcaccttatgcatgaacccacgtaagttcatgaacccacataaacagccctatcaggcttgtggcactatgattagccccattttataaggtaatactattttctcaccattttacacatgaggaaccagaggcaatggtaacgctcccaacaaactgcctgtgtacaaaactggatcacacaaaagtgcctcagagcacagatgctttactgtcaagaggctgaagacagcagatgtgactacagctaaatgcacactgacaacatgtaattctggtgtccagccccccttctacaaccagggatgactgcctccccacatcagttacttttgctgattgacaaatagtaccaaaacaggacagattctgattcactatatttattaattatatattagcaattttctaaacaaatggtttagaaaaacccatttttcttaaaaaaaatttttttttcttaatattttatctcactgtggaaagaattccaagcacttaagacaatgcagcaatggttaaaaacagactttgatgtcagaaatttggttcttcccagctgcattacttcagctaagttgtttcacatgtttgtgaagtgagcagtgtttcatgaagtcgagcaaagattaaagcatgaagttcctaacccagtgtctggtaaaccaacttaacttggaggaaattcggggttgggtgggaataaaccaggaaggaagcagagcaaagctcatagaaaccacctactggcttaacttaggcaaggtgtagagacaacctgatctgctggttggggtaggaggggagggcatgtgaagagtgcaaggaagcaagaaaggtgggaaagaatagccatatggagagatccttcatctcacactccctctcagaaactctccccagacaatcctggggagtaaagtgggaattggcccagaagtaattgcttccttccctgcagaagacacctttcagtgctagggcagtcctgcacacaggttatagtgcagggccaaggagggagaagggtcaggtaaaaggcctggcactgaggggacacctcgaaaagatgtggccatcaaggcaagcaggttaggaaagcaacctaagcaggcagcagtgacaaaggaagagagctcttttaggaaagggatggtctcagaaaatttgtaggcagatggggaagagagaaacaggaaagggcaggaaataaatggagctggatccagtaagaaaagtctttggtaccaagaacgcagttggaacgccagccttggtaagcaggaggcatgttttcctgttcagagactaagaagaaggggaccattaaaccacagagagattatgaagggatgaaggtacttcacctaagggcagacttaatctcaatgaagtgggaaaaagattttgttaaagcagatgggtctgcagtacgtataatctggagagatcaggaaagtagactgggtttggggtagtaactatgaagacaaaaacaactagacaatcagatgaataaaaacatagctggccgtcatcctgatatcaaaatttggcagaaaaacaacgaaaaaataaaacttcaggccaatatccctgataaacagacataaaatcctcaacaaaatactggcaaactgaatctagcagcacatcaaaaagtttattcaccacgatcaagtaggctttatttctgaaatgccagattggttcaacatacacaaatcaatatatatgattcaccacataaagagaattaaaaacaaaaaccacatgatcatctcaatagacacagaaaaagttttcgataaaatccaacatcctttcgtgataaaaaccctcaaaacactaggcatcaaaggaacgtgcctaaaaataataagaaccatgtatgatcagatgacagcccacatcatactcaacaggcaaaagctggaagcattccccttcagaactggaacaagacagtcccaaaagaaaataaatcatcctaccaaaaagacatgcatacttgaatattcaccgcagcattattcacaatagtaaagacatagaatcaacgcaggtgctcatcaacagtggactagataaagaaaacgtggtatctatacaccatggaatactattcagccataaaaaagaacaaaattgtgtcctttgcagcaacatggatgcagctgaaggccattatcctaagcaaactaaagcagaaacagaaaaccaaatcccacatattttcacatataagtgggagataaacattgggtattcatggacctaaagatgggaacaatagacactggggactactggcgggagggaagaaggagagcaacagctggaaaactacttattgtgtactgtattagtccattcttgcactgctataaagaaatacctgaggctaggtaacttataaagaaaagatgtttaattggctcacggttccacaggctatacaggaagcatgatgctggcatctgcttggcttctggggaggcctcaggaagcttacaatcatggtggaaggaggtgaaggggaaggaggcatgtctgacatggccaaagcaggaggaagaggagaaagggaagaggtgccacatgctttaaacaaccagatctcgtgggcactgtttgaagagaacaccaccggtaggtggtgccattcatgaaagccattcatgaaagatccacccccatgatccaatcacctcccagtaggctctacctccaacaccaggggttccaatccaacataagatttaggcagggacacaaatccaaaccatatcaggcactatgctcactacctgagtgacagattcattcacgctccacacctaagcatcacacaatgtacctttgtaacacacctgtgtatgtactccatgaatctaaaataaaagtttaaatcaagaaacatagctggcattaagtcaggatttaaaagaattttcatatttaattcccctttttcaatgtctttgaacatccacaggccctgactttccagactaacaatgatattctgatgccaaaacatccttggaaatattctttgttaaaaaatggtgtataccacaaacaagtatagacaaatggagatgtcattatcagaacagaataatttgaaatctctcaatattcttccattgaataactttgtgcaaaagacaatttcattcttcatgtggcataaacagcgaataagaatgctgcctgtcctcaagaatactattatgaaatccacgggatgagaaataaatgcaaaccaccatagtacatgcacatgagcatcgtaaacacagtaaaacgttatagtacaaatattacagaacaatccaacttaaatctaagataactcctttagagaaacaagaggttgttggctctctaataaaacatttcaaaatatcttaaaacttgatttcaagaagtaacagtatcaaggtccacagagaagacaaaaaggttatgccaaaaaaaaaatattttagggttctccattttgaaattataattactgcctgctatagcctgaatattgccccaaatcatgtgttaaaacttaatgcccactgtggtagtattaagaggaaacacctttggggaagtaattaagacatgagtgttctgtcctcacaaataaattatgcccttataaaagaggcttcagagagagtcattctcattcttttgttctcccacgtgagaacatcctccagaggatgccatgactaggcaccatcttggaagtagagagcagccctcaccagacaccaatcctgtagtgccttgatcagacttctcagcctccagaatttgagaaataaatttctattatttataaattactctgtagtattttgttacagtagcacaaacagattaagatactgccaaagtatgtaaaatcagtaaaatcatcatttagaaatagaaatgaaacttaaggtgataaacccatctatctatctacccatctatcagacatttagaagaagccctgaagtttcttataccaatgtgagtccataagatcatacaaatatcctgaaacactcatctatctcaaaacacccatcgtttagaaatagaaatgaaacttaaggtgatacacccatctatctgatcacatttaaagatgagaaagatgcattgtaacaccacaatttcctaccagtgcccattacaaagaacaggttaactgcaggtggactgaccaagcagttcctctggatctgtggtctaaatgaaaccaaatgggtacttcaagactgctcaggaatgcaggaggaaaacaaagccagaggactagcaactggctggctaccaccataggcatagacaccagaggttgtgcaatgtcaaaggcatatttcaaaatatcaaagtacctctctcagggaaataaaagatgaaggatgtcaagatctcaacttacagagcacaaaccaaacataaagcacctagatctttttgaaaagactaatgctacagagaaaggtatataccagaactaatctgctttctcagctgtcctgaccaggggctaggtccagtgtggtaattccaagtttgacaataaattttgatcttttcatcttttgaatgtactaagaaaaaaatggttagcaaacataaaaattggaaaataaagttcaagacttagaatatgaaaaattgaatttttccctttttcctctcactgacttaagaagaattgtgataaagctatatagtagcccacaatatctatctatacttgactacttgagtaacttgttcctctgtggaattagttgagacataaattatatataaataaataaataaatacagagcaagatgtcaccttggaacaaataatagctaatgtgaacaaatcctcccattaattccaaagaattttacaaagaatttccaaaatatttgataaacaagatttctttctccaatgtttttaaactgttagaaccagccagaggtccaagaagcctacttcattaggtatttcctctccaagtcatttgtaacaaaagtacataagacagatggatgaaggccaggtgcggtggatcaagcctgtaatcccagcactttgggaggctgaggcgggcagatcatgaggtcaggagatcgagaccatcctggctaaaacagtgaagcccagtctctactaaaaatacaaaaaattagccagacgtagtgactacacctgggtgcctgtagtcccagctactcaggctggctgaggcaggagaatggcatgaacccgggtggtggagcttgcagtgagccgagatcacaccactgcactccatcctgggtgacagagcgagactccatctcaaaaaaaaaaaaaaaaaaaaagacagatcgatgaaattccatgtttaacagaattcattaaaaaggtacacagcagcaaggaatataactaatacctctcaattcctaattcccacctacctctctcctcaaaaagtgtctctgctcgacagatggcatctgtattcacccaaatgatcaaaacacttaggattcattcttaactcctccctttactcacaaaatccaatccatcggcaaatcctaccaattctatttcaaattacagccatatcttgttttgctgtgctacgttttattgcaattcccagacactgcttttttttaataaactgaaggcttgtggcaatcctgtgtcatacatttttccaatagcatgtgcttgctccatgtcactattttacactttgataattctcacagtatttcaaactttttcattattattatgtcagttgtggtggtctgtgatcagtcatctttgttaccactgtaattgtttaggggaaccaggaccacaaaccaagcccatacaaaatggtaaatgtaatcggaaaatgtcatgtgtgttctgactgctccaccaactgactctcctccctcttccctctcctcaggcctcccccttccttagaaaaacaacattgaaattagaccaactaataacccagcaatgacctccatgtgttcaagtgaaaggaacagtcacacatctctcactttaaataaaaagctagaaatgattaagcttagggagaaagacatgtccaaagtcaagaccggctgaaaggtagcctcttgcaccaaacagttagcttagctgtgaatgcacatgaaaagttcttggagaaaattaaaagtactactccagtgtacatacaaatgataagaaagtgaaacagccttactgctgatgtggataaagttctagtgatctgaatggaagatcaaactagtaacaacagtgccttaagccaaagcctaatccagagcaaggctctaactctcttcaattctattatatgatggttgagagaggtgaggaaattgcagaagaaaagctggaagctagcacaggttggttcatggggccaaagtgaaaaaactatctccataacatgaaagtgtaagctgaagcagcaagtgctgatagagaagctacaagtcagccagaatatctagccaacataattagtgagggtggttacactaaacaacagattctcaatgtagacaaaacagtcttctattggaagaagacgtcatctgggactttcatagctgcagagatgtcaatgcctatcttcacagcttcaactgacaggctgactctcttgtttgggactaatcagctgacttatgtgagccagtgtttatttgcaattccaaaaattataaggcccttaagaattttgttaaatctattatgtttctgtgctataaatgaaacaacaaagcctggatgacagcacatctgtttacaaattggtttactgaatattttaagcacactattgagacctattgctcaaaagatttacttgtctttgagacagagtatcactgtgttgcccaggccagagtacagtggtgcaatctaaactcactgcatcctctacctcgcgggctcaagtcatcctcccacctcagcttcccgagtaactgggactatagggtatgcatcaccatgccaggctaatttttgtatttttttgtagagacagggtttcgccatgttccccaggttggtctcaagctcctgggctcaaacgatctgcctgcctcagcctcccaaagtgctgggattacaggtgtgagccaccacgcccagacaaaagattatttgcaaatcattactgttcactgacaatgtacctagttacccaagagctctgatggagatgtacaaggaggttaatatgttgttttcatgcctgctaacacaacatccattctgcagcccatggatcaaggagtaatttcaactttcagtcttattatttaagaaatgcatttttcttaggctatacctgccacagcaagtgattcatctaatggaatgaaaatcttctagatagggattcaccattctagattcatgattcatggaaaagggtcaaaatagcaacattaacataagtttggaacttattaacataagtttggaagaagttgattccaatcctcatggatgactttgagagggtcaagactgccatggaggaagaaccacagaagtgcagcctgaagataggactgaattgctgcaatatcatgataaaacttgaatggctgaggagttgcttcttatagataagcaaagaaagtagtctgttgagatcaaatctactcctggtgaagatgctatgaacattgttgaaatagcaacaaagagtattacataaacttagttgataaatttagcagcagcagggtttgagaagattgattcccttttttaaagaagttctacagtgagtaaaatgttagcaaacagctgaatggcacagagaaatcttttgtgaaaggaggagtcaaccaatgtggcaaactttattattgtcttattgtaagaaattgccacagccaccccaaccttcagcaaccaccaccctgatcagtcagcagccactaaaagggaggcaataccctctactagcaaatagattacaactcactgaaggttcagatgatcactggcattctttagcataagatatactttagttatgtacattttttagatataatgctactgtacacttaatagactacagtacagtgtcaacataacatatatgcacaacataacttatatatgcataagttatatataacttgtatatgcataagttatatataacttacatattcatgtgactcattttattgtcatattcactttgggatcacagtggtctggaaccaaatctacaatatctcagaggtatgcctgtatcatacaggcggtcaacttctctccattttctctgcccacacttttatccaatcctccaacatctctcgcctgactactgtaatagcctcttaataggtatattttctttcactattggctccctaaaatccatatgcagcaaaagtgatctcaaaccacacgtgagacaccacttccactcaacaactggcactaagaataaaactaaaactcatgaccaagtcaattaagcccctagaagatctggcccttgcctaccttccccccacctctcttaacgattctcttcctcattatactcctggcctctttccatcccttgaacacactaactaggctttttgctactttgaggtctttgcacttctatttgttctgcctagaaaggtcctctctgatgactttagatttcagttcaaatctcagctcagagaggctgcccggacctacatagctatcattccctgtcactctctagcacggtgcttcccaaactatctgtgatgaaggacccattgtttttcattgtcaatctgtcataaaacttttgtaaaaattcaataaaaaattttcttttaaaaatgtaactttaaaaacatataaaatacaagcccaaaattctcattatcagcattaacagtcaaaaaatctatcatattaccataaaagtctcttgttttctgtgtttataccattgggaaccattgtaatcagcacacaactgtcagcagataagactgtgacattgctccagtgtgccaccaagctaattcctttcacaatacttgccacactctagagtcgctattcatttatgtgttgatctgtaccagacactgttttaggcactggaattgaagcgatcaacaaaacagacaagatccctgcactcacagggctcacgttctatggtggaggcccagggaggataggctattggtcaagccgacaaggcaaagccagctttaaacttagatttgactccacggtttttcctgagttctgaaaaatcttcagcacttagctaagcagtgaagtatgccaaatgcatcctaatcagggaggaagaaatgaaagctgggatacaattactgaacaaacttaagttttttcaaagttgatatcaacaacaacatcctcctacaaaacatgcctgtggtcaccgccagctgcagcatattggcatgcatctgatccaatgtggtacttctgactctcatgtacaccaccatttcttcctcaaaactactgcactttacattacgtattctttgtattgtacaccaaccaaatattttaatcaaaataattacttctaaattggtacacattgagataccaactctgaggatccaacaatgtggaagagttaaacatcttcaacgagtgtctggagccaacaacaataaatacagttacagccattttactcattttccacagctaaactgcccagatgtgtaccaaggctgccctgtgtcattccaccctgtgtgcaagttccttcacccacatgtctcagatgagcagttaaaagagccacccaagatgtaatcaatgcctaaatactgccaccctagggccaagataatgttaaacctaacaaatccataacccaatttcctgaagcctcatcagcttgtgattaaaataaggtccccattcagaacacatcagcctcgtctatgtagtaaggctggggctgcaccctgagtttctagaatatgctcacattccttccactgtcattcaatcaactcattatctcccccaaaactctgcagattgttattattcccattttacaaatgagaaaactgagaaccacgcgtttagtaataattctcaaaaaataagttaacatatatttattaaattcttatattaaatacaatgttcttaccaatgagtcccaaacttggctaggcttcaagtcacccaaactgtagtgaacagagttgccaggtggttctaatgaagccaaactggcactaggaaccaatgaaatttgccatgtaaaaaccaagtgtacaaacagaaacataaagggaatgtaggaaaatgaaatctactcatttccacagcctatgcggaccgctgcaatgttttaatgtacaatgttaatagaatactgtttgtgtagcaattcaaaaatcacttcagatgtttatgttactgtaatcaggggatatttttaagtatcccttaaaattagcaaaaataccaattaatgaaatctggcataagtctacctactcaacttagctgattcccaaaataaggcaaagggcactatttaaagatttccattaatacacttgaatatctgaatcaacctggatgaaagaggaatctataacaagcccctacagttacttctgcagaaacaatgtgttcgctagcctttccataataaattaaacatgctaaaagaacttcatctctgtatttgatgtcccttccagctgccttcaagcatttgctctaatacacactgaagaccattgtttaggtatatttattaatttagagaaaaaaaatccattctgtcaagcaagtactaaaaaccacacaaccacctacacagtttcgcttaggaggatctgactaatcaaggtgaagaactgaaattactgagtggttatgtactaattctctcactgttggagtttaaaacgggtgcctaaaagaagtctgtatttggatttgccacattgcacaaatagtatatatacgtgtacatatatttcatatttataattatgcatgtggataagctttatactttcgataaaaagtctactattaaacattagtgattctctatgtttaaaaacaataaatgtaaaaactttaccagatcattaaaacatcctaaatgattcttgctctttagtcaatcgtatttcctattttcctctatattgtgtatattgtatgaattttacaatgacagagatattcttcattcatcagcaaagttcacaaaagaaatggatgagtaagttggcttcagctggtcctttctgcactgaggcaggaagatgtctcaggctggtgtgcaggtaaagcgttcctgtctcaggccaaggagtggcccctacctgtcttcagattctacttcacttctaccccactggtctgggatgaagtcacagtggcctacaagacctgtgggaagtacgtttccttcttttatcaccagcaaatgttcatatttctctcagtttggtttacctatggcaccaacagtcatgtcacaagcttgactctcatccaagcagacctaaactactccttagagaagtagtgagctctgagacaaaatgcaaaatggaagaaacacaaaaatgcctcctcacagtgttctatttagaaaaaatttacattgagagatacagtgcttgctatgcctcatttcacttaatccaccatgagatcctatcctatgagagtggtgccaccatcactctgcctactttccagaaaagaacattaaggtttaaatttgagaaagctttgcttaagatgacacatcaaacgagtagaacagtaaagacttaaaccctaggctgtgacttttgtctgcctttcttttactgcaacagacaatagaaaaatagcatccacattaggagaaaatgaagaaaggttttcacactgaaattattttattcaaggagactgttatttaaaaagggcttcaataaaatttctaaagaacaggaaattgtggattcaaaccaccactctcgtttcagaatcactattcaattcttgcctctaaaatcctaggaaacaatatccacaagtaatttgcctaggaaaggagaacagtcaagccttcagcctccttgcagagcattcagcttaggatggtaatgattagcacactaacccaggtctgttaataactgacaagtcaattccatacacatgcaggctggttctcaattcaggctgacaacctgctgcatcactgggggcaacatgcccaccgaggagggggactcaaagcatcaagaagcacacacagaggctcctgctctggagacagctggagtacaaatccggttattttacccaaatgctcagaaatgtctcctcagacacaaagtccaatttagctgaaatgcatcaatggccaaaaaataattttagctttcttattcaacaccttaattccaaaaccaaaggtaatttagcactgcctataaaaacagtatcagcaaccttcttttagtctccccagctgcctcatctgggatgtctgaaactatcatatgctggtcactaatccatctctccccttgagagccaaagggaaaaaatgctattttgatatggacggggattcattactgaagtaggaaaaagtagttaagaggttttaattcgtactctttgcagcaatgaagtatgttccaggtaatttcacttctaaagatttcaagttattgcttcatcgacaatggttaggttcctcactaagtgtcaggatatcaagatgacaagtcttgattctcaaggaatttactgtcccatcataatgataagccaataactgactgattataacatacaacagaagactgcgaggcaggcgagggcacatgttgcaaaggaggaaccatgaggccttctaagtgcatgaaatttgagctgggttataaggaatggtgggagagccacaggtgaggacgtggaagaggctgccatacccagaaacaacaaggtgggccctggagaaagatcagcagggtaaggtaagagaacactcaacagcccactatggccaaagcttgccatacatagaagagagagaactggggtgaccgtgtcacaaagctagaacacttggctgaagagctgaactcagtatcagaaggctgctctaagaaaacaaatttcatagttatatgaactggtggagaacactgaatccagtaaaaccaatgagactgcaaaataccaagtgagggttaataaaaacatggacaggaaagggacaaggatagataagaaaaatgaaagagacagaacacacggtgactggtctgagggaaaaaagggagcagaaaactgttcaaaggcaactggtgttttgagtctgggttacagggaggttagccaagcaaacaacagaggtaggagtaggttgagaggaaggagaccgtcaggggtgcagatgggttgttttacctgtggtgactttcagatttagggagagatttagagatatcaaatggacaactggagatgcaggagaatcttatatgcggagggttaatttttcagtccataatggtgattcccaaatccatatgaccatcagaatcagctggggaacctgtcctcccccaaaagtcccaccctaagaaatcctaagtaaatctgggatggggcccaggaatcctatgatttagaagcccagggtgggagccactgccctctgtgctctgctcactctgcacttcataatctcctgccttcatagttctgaatatacatccagagcatttttctgggggaagggacatttgcagaatgtgaaactagtacactgctctggaggattggaagcacactctcacatttgaaaataattacttctcagtctgtattctacccgttctggggaatggctttgatatgctactacataactgatggtctaggtcggcaaagtaacaactactacaacacagagatcaattctgctcaaacttaaagtgaccaagataactcatgactccaggactactgggttggtaacaatgtgtagtaagagcgtttctgttttaataatggagcgcagtgagattatggggtaactcgtggtatcaaatgtgaaccttttatagactcctggctccaagtcctttcactactcccatctccttttccaccccatcaaggtgagatcattaagctcaggaaggcagctcagccaacggaaaacattcaaccttcaacttttaataaagtacaaaatgcttttattttatattttatttctgaaaataaccacatcagggaaaaaagagcaaatgtggaatgggaacctgacattgcaaactatgggaattttattttttaaacgtttctaataaaagcaaatatagtttagtatgactaaccctaaccccattttgattgcttgttttctcacttttgtttaaaaaaatagtaaaaggaaaccttttatgcactcactataatatactgtgaaattcacataaaatttctcatttaattctcacagttattctgctctgtaagtaatctcatgatcctcacttctacagataaaaacaccaaggctcagacaagtcatgtttttgctcaaggtctcacttctcatgggggaagaactagaattcccacccagtgtttcctgaggtcagtgtcctctcggacaggaccccaagaggctgccacaatttgggagagaatacttttttctggattccaccagcggccaagttacctcaccctccctgacacagcacatgtttttttgcaaaaaagactgcactctcttggggaaggaaaccagtggcaccatcctccacttggcagcacctatcactgcctatcacaaagaaggttcttaacagtcctattgatggcagcagggggctgtccacggcaggggaggcgtgggtggtggcgggaggcggcagcaggagcggctgcaggagcagcaatggcaaaggtgggtcccctgtgccccgtgtccccaaggcagcaaactgtgctgcccccaccctcatgtggccaggcaggacccgctcccaggcctggaacatcagtggctccggaccctagccccacaccaccactctcacccacaactgctgcggggagggcaccaggaggaggcagcactgggggacccagggcgggagggggaaatgggagcagtgcccactacagggacccagccagtggtgcggtcaccacgcccactgcaccaagggtgccgtgttcttgcgcccccagagaggactctgcacagggccacccacagccatgtccccaggggtccgccccgcatggggtgaccaccgggcctgacactcccgacccgctatccgctcctggaggcaccccctggggaagggccgcaagcgggatgagggggagctctaggctgcccctgagtgcgggggccacgggggagctcacagtgatgtccctggacaccagcccaggcccagcaaggacctagagcccccaggctgcaagggggcacagctgggacttcccgcttcatggaaccgggagccaggagcaggcaccagccctgccctcccagacacatctgcagccgcccaggtggggctgtggacccgggcctctctgcactcttgggggccctggaaggcccccgccttgcccttgcaggctcggaggtgcctacctccactgtctggcctctccccgctccaggcacctgctatgatctccgaatggggttggggccaagccggggagctgtcacagcccagccaggtatgtgagggtcctgccacctcagctccctccagactctgtgtgctgacaagcatgggatgtggaacctagggggacactgagagcagcttgatgctggcctgcaggtaccccatggatgagcagcctgggtaccacagaccatggcaggaagcagacaggctccggggtggaagggggtaggtccctggtgagaccccaccttcaggccagggagggcatgaaggctgggagccaggccaccagtcccacagaccacactgcaggcttatggtgacttttctgggcctgcccatgaccacccatggaccaactggcacacacttcctccactctgaggcccataaaagccccgggctcagctagagcagggcaggggatggggagaagatgagatgaccagatgcagagaggagctactctctctgctaagagctgcagagacaatgggacaagctgcctacagagagaagccacccactctagggcctcctctgtgccgacagctgcagactacaggagctaccctctctgctgacagctgaacacttgttgggatgaccagctgcagagaggagctaccctctctgctaggagctgaacactcatcgggacaccctggctatggagaggagctgcccactgtgggtcttctctgagctgttctattactcaataaagctcctctttgccttgctcaccctccacttgtctgcgtacctcagtcttcctggtcacaagacaagaactcaggacccactaaatggcaaggctaaaagagctgtaacacacacagggctgaaacatgctcctcactcatcaaattgcaggtgaagaggggagaacagctgtggtccttcaaggagccctgacctgggagctccccaagccagggctgtgactccttctttggggccccatggttcctggcatctccaagcttctgggagccattgcattccttggtgccagctggggaagctgtctgcagtgcacctggtccagccgcagcctcacagagagccagtgcccatgctggcacctagagctgacagccccacagcagcagccagcatgtctgactgtgcagtagcccaaccccgcactcactcacacacgtcttgccagtccacgcctgactcagtctcccttggaggtgtgggatccaggccggtaccatgagctaagtgcagcctgccaggccaagtgggaggaacaagcccagcaggcccaaacaaaagttggacaaagacaccactggccacagctttccaaccagaaaaatgacaccccaaagatcctgtaacactatttccagaaagtggcagagaaatgtgctagggcttaaccattggctctgatagccctcatcccaggatccctaaggagggttttgggaatttgtgaacgtttcagttgtcacaatcactgggggatgctactggcactgagtgggtggaaaccaggaacactagaggtcctaagacacccaggacagtctgcacggccaaagacttctgcattcctcacaacttcctcaagtcctgctgaatattcacgtgggtaaaaaacctgtttataattgtctgagcgtaaaacctcactcaagttattacataggcacaacgtatgtgttacaaagtatgtgttaaacaggaagactaccattttattccaaatttaaccaaatttgaccatttcaagaaacaatgacaccaacagcacaccaccagtgcttgctgagtctccactgccatccacgtgccacagtctgcatctgcagctgccacagcagggatgctcccaaagtgtggcctctgagcagttcctccacaccctaggcagcagggtctccacatctgaatactgagatgcaagttctcctggcaaacaacttgcttttcatttcctttttcactgtcataaaaagggtatatggatttttttaaataacatgtgtaattaggatatgttattcacaaatttcattttaggattgtaaaggtggcaaatacacatgaaatagccagatggattcctggaatagtggaagcttagtgaaaatgctattttttttttttttttttttttgagatggagtctcgctctgttgccaggctggagtgcagtggcgcgatctcggctcactgcaagctctacctcccaggttcacgccattctcctgcctcagcctcccaagtaggtggaactacaggcatccaccaccacgcccagctaattttttgtatttttagtagagatggggtttcaccatgttagccaggatggtctccatctcctgacctcatgatccacccgctcggcctcccaaagtgctggattacaggcgtgagccaccgcgtccagccaaaaatgctatttttttttaaaaaaaaagaagcattataaatatgatgtgtctttctcaattcagcatgatgtaagtcaagttaggtagttcccatgcctcaggaaatcctggcttaatctcagctctgtcagcagtttggactgtgtgtgtgtgtgaggggaggaaaaggcatctattgattaaggtgcttctgtattctccattgagttcttcttgagttcaaggttaattttttaaatcactgtaatctttgaatgttctttaaaagaacattaaagcagagagaaatggcattataatattcacaatacaaaaaattaagacttgtaaagaagagtgaagaaagttggggaaaatatgcttcatgattcttaaaggtcgattcctcatggaatatattttaaacatacacacatacatatatagttgtttaaacccaataaataaacatttcagctaaaagtattataacactaaattatatctttaagcatttttaccaattttacttccttactttatcaatcatgtttcacatctctaatttctttatcattataacaaatttcaatttttatatcaagataccaatataaataaaagacaattaaggttaaaaagtgctacacgcacacactttttggttattttatttcctaaacatggaagaggggaaaacacaaacaatttcttccacacgtgtcacacacagtaaacattctttcaaatcacgtcagtttccttgacaaaaattaataccttaataaagatccattgtttaaaactcttggttaccacttggctagccatgcataaaacaggacaattagtacagtcaactgaacattatcaagactttcagacacagtgacactgttccagccaagcacagtagtgatgttccgtgaatgctgctctgtcagccacaattaccccttaaacagcctttggaattatcagcctgtactttgctaaaaagaaaaagaaaacattattttaaataatatcaataaaaatctttgtttcctttctgaggtaattatacacacatgaagttagcaagggtaaaatcatagtaattttaaaacacatgcttaaaagcttgcatcttttctccagtaaaagctttaaccagacttagtataaagaaaaaacggatttgaatttcactgtcttttcctttttcttcttctgtagaagcgatagtacttaatgattctgttcaaaaattctgaagcaaaaagacctagacaaataggaaattagacgttacatttttgaagaagtgttttattttccattattccttaaggctatcaggccaaaaaaaaaaaaatctattccaagaactctgtgattcaaatataaaaagtatgagaaccaaaactgagatgctatgccttggtctgctgagaactgtgataattttcttgaactttgctgcatatatattctaaagtaaagcaaatactttgacattttattctttttatcctaatgtaagtggaaagctacaaagcaacttccttttcaggggataaagtaagtttttaaaagccttctttggaaataattaagtccataaaaattacatgttgatttcttaggtattatgtgtccttctttttttctaaagaatgaaggtataaaataagacaatgtaaaccatggcaacaaggttgggtatggcagctcatgcctataaccccagctctttgggaggccaaaccagaaggctggcttgataccaggagtttgaaaccaccctgggcaacataagaaagaccttgtctctaccaaaaaaaaaaaaaaagttaataaaaataaatatataaataataaatcatgctgacagtttaaatttcaacagtgaagttaaacatctatctattaatttcatttgcaactgtggagagtatatgccaaaataaatatatacatatataagtaaataatcataacatcccaagatgacaattggggactgatttcagccaaaacacaaataatgtctaagtttttattttattaagcaaaacataagtttgtgcccaaaaacttacaaacattagtaacagttcaaaacagtcaatcttctactttagcattctaagattgtgtaaaaaactagataaattattacaatggtttatattaaatggtctccctgaagtacaaagcaactgcaaaactataattatcaaggactaaaacacgcagatgctatatacttgagccacctggtggtttatttccctcactgcactgataaacacctagtgctatgcacacaaccttaattagactctacaagttttacttttggtgccaagaccagaaagagtttacttttaccaaaatgtagtaatagtgtgggtcacaaggcacaagtctacttggaagcacttaaaaagttcactgttgctaagtacagaaggcactcctgaaatctaccatagcaggtctctagaactgttttcttatgtttttttctacagtgtttgatgcctacagtaaacatagaatccaaaacaaattcaaataaactgcagatcatgcctcaggtttgcttgtggtttctttacctcttgcctagttctggacagttcaggacagaccacattaacttttaaaggttgctgtcttaactgtcaagcaaggtagtaataggtgctcagagatgttggttaaaaaacacaggaaaaaaagttaaacaaaagtacactctgttaccaagaggaaagctgcagaacaccaatctttgtgactctgacttcaaattagggactcttggggtgatcaagatttttatcaaagcagaatgtgtccaaagcatacctttatcttcaagcttactagcctaacagctggagtgcattagacaggagccatgacaattctaatgataatggtggtgatgacttgattctaaacggatacttgtcaaaaagccagtgaaaatttaagccttttaactagtaaaagggttgcaagttaaacctctgtgtccagcagcagtcccacacccttcctaggagaagcaacttcctcaatttaagtttcaataatgtcttatgtgaagaacgaataaagtcagtattaaataatgtcattagcaaactgacacatccattatgataactgttcccattactggctttagtaggaggtgatgccagaggctctcccgcaccataaggcaaagcgcttcatgtccctgactcatccaagcgactcaaggccgcccagctctccaagtggaaacactgagtgggaaggaggctctcaaaggatgcctctattcctcctcccgcccaggttcttggtggagggtagatgctattaaaagactagtttcctgaggaaggtagatagtttcagggaaagaccatttggctggaaggaggaggctttgttgccagctgtttctccagctccactgcctgtgtggtcccaagtaagttgctaaacctgaccacgtcaagggccaggtctataaaaatgatgacatttcccgtaaaagggcctgcctggccctgcaccatttgccttcacaagggagcactgcactagagaagctctggctttgctgtgaacaaatcaaaaagtgacacatgggcttggcattttcctccatgcaaatcaaagtatcccatttccctgaaacactttaacaggataatatggctttaattttccacacttcctaattctgggtgctaacaggacacagccgccttgtgagagaaacaatggcacaagtagggatggcaaaggaagacacccctctcatggaagccacgttctcacagaggagcccattctgcagggctaaaaggcagattttactttctgtcattcatttcctcaagctgttattgagaaacaacacaggtaccagtggaggatgcgtgcattagagtcagaaagccaggtctccccaaatcccatctctatcatttaccatcggggagacactgtacaaagtaacttctctgatcattcctatccccatctataaaatggaaatgatgcacatcgtgccacaggcttactgtgaacgaatgatgggaaagtgtgtgaaatttactaaaataagcagccactggaagggagcctgagaccaggaccagccaatgagaaaagtaacgaagaatgcagaacttgcagcaggagctaaagggtaatttcctggccatgatgacaaatctggctatgtatacacagatgcatatgcctgtacacattatacagatacatgtaattcctgaagaaggggctgcctgtcaacaggcatatcctcacttcctgcctcaaaataggaaaaaaatatttgttaggaaatgaaatacatccaaaatatttgagaaagggtttgaggaacatcccataaaccaatgtaccttgtgtccccttcaattctgtttttcttttctaaaatgtcaaagtatgctaagactcttcaatgaccaaaaggtccaagtttatatgagtttttaatcatgttccagagatcactggataagaaacaaataaacaaaaaaaaaaaaacaagagaattaagcaataaagaaaagtaatgctgcagagaagaaatgaataagaaaaatttcattttactgctacgaggtattttacaaaatcagaaaattatgtttgcctgtgcgaaactggaaaatattagaactgctgaaacttctataccacatcagacttctcaacaagttcaagaaaaactaagcattttgaaatgcatggtgtctggaatagaaagggtagcaattgtggatcctaaaccagaagaattatactagtctatctacagaggtgtctctagcctagctctaagaccacaattggttagaatgagaacaggtagaaaacagaccattcataaagtcaataattcaggcttggtaatggcttacagctttgcttatgatgtccttatatcaagtgtttgccattgctaacctaaagagaacatacaactatctttatacataaagctgaatctctaatcatctacccattttcctatcctaaaatatttcaaaatgtaattccctaattcatattaaaaacttcatattcaacattattcatttcttattggacataatggtataaatatttagactaatttaccttttgtttttaacttcatgtccacaatacatggtggtgtttactcattaatcaagattttcctaaactccatttaatgaaaatatttagttttatggatggcaacaaagtattatactcaaatatctctgttggaccttaacaggaacccaaaataaattaattctctgacacaacaactcacaggcagccagaaatctttataaaatacaaatcaaatgtcattccattggcttcccatttctaatggaataaaatataaacctgatacaatggcctacacaatccatttactttctgccttcaaatgcctccactctctgtcctcgctgctctccccactcactgctccctcccctaaatgtactgccactttctctgtgttctagaatacagcctactcaggaccttggcgccatcttttccactgcctgaaacccttcctcctctccattttcagctcctctgaaggccttcttaccaacaacttaatgcaatgccccaagctcatttcaatctctattcctaagatgattttcatggctttttatcatttgttgaaattattagtatcttcctttatttcagtcttcttcattcaagtatcaacttaaaagcagaacacttgtctgcttgttaaccacttttcagcagtacctagaaatagtaccaggtacagagcagatacaggaatatttatcaaaaataaataaatgagtgagaagtctaagaattaaggatttctaaaagataaagcctacaaacctaagctatatatggtaaatgctattccataccatagcaaattagaaacattacaggattgtatgttatacatatgaacactgtgatctggaaatctctgccttgtacaaatagctctagaatatattcattcatttattaaacaaatatttattgcacatccactgtgtcagatattattctaggcagcagagactccagcagtaaacagaacactctacactgaggaagtttattctgtagacaagggacacagacgagaaacaaatacatgtgccaggtgatgaaaagtgctataggaaaaaacacagcagtgtaagagagtggaagggatgggagcctcagtagaagatgacatgttagcagagaggcgaaggatgaagacagaacaccacatgcacatccgagatgaaacaatctaggcagtgagggcagcatgttagcagagaggtgaaggatgaagacagaacaccacatggacatccgagatgtaaccatccaggcagtgagggcagcatgttagcagagaggtgaaggatgaagagagagcaccacatggacatccgagatgtaaccaactaggcagtgagggcatcatgttagcagagaggtgaaggatgaagagagagcaccacatggacatccgagatgtaaccatctaggcagtgagggcagcatgttagcagagaggcgaaggatgaagacagaacaccacatgcacatccgagatgaaaccatctaggcagtgagggcagcatgttagcagagaggtgaaggatgaagagagagcaccacatggacatccgagatgtaaccatctaggcagtgagggcagcatgttagcagagaggtgaaggatgaagacagagcaccaaatgggcatccgagatgtaaccatctaggcagtgagggcagcatgttagcagagaggtgaaggatgaagagagagcaccaaatgggcatccgaaatgtaaccatctaggcagtgagggcagcatgttagcagagagatgaaggatgaagacagagcaccacatgggcatccgagatgaaccaatctaggcagtgagggcagcatgttagcagagacgtgaaggatgaagacagagcaccacatgggcatccgagatgaaaccatctaggcagtgagggcagcatgttagcagaggggtgaaagatgaagagagagcaccacatgagcatccgagatgaaaccatctaggcagtgagggcagcatgttagcagagaggtgagggatgaagagagagcaccacatggacatccgagatgtaacaaccatctaggcagtgagggcagcatgttagcagagaggtgaaggatgaagacagaacaccacatgcgcatccgagatgaaaccatctaggcagtgagggcagcatgttagcagagaggtgaaggatgaagagagagcaccacatgcacatctgagatgaaaccatctaggcagtgagggcagcatgttagcagagaggtgaaggatgaagagagagcaccacatgcacatctgagatgaaaccatctaggcagtgagggcagcatgttagcagagaggtgaaggatgaagagagagcaccacatgggcatccgagatgaaaccatctaggcagtgagggcagcatgttagcagagaggtgaaggatgaagacagaacaccacatggacatccgagatgaaaccatctaggcagtgagggcagcatgttagcagagaggtgaaggatgaagagagagcaccacatgggcatccgagatgaaaccatctaggcagtgagggcagcatgttagcagagaggtgaaggatgaagacagagcaccacatgggcatccgagatgtaaccatctaggcagtgaggacagcatgttagcagagaggcgaaggatgaagagagagcaccacatgggcatccgagatgaaaccatctaggcagtgagggcagcatgttagcagggaggtgaaggatgaagagagagcaccacatggacatccgagatgaaaccatctaggcagtgagggcagcatgttagcagagaggtgaaggatgaagagagagcaccacatgggcatccgagatgaaaccatctaggcagtgagggcagcgcgttagcagagaggtgaaggatgaagagagagcaccacatgcacatccgagatgtaaccatctaggcagtgagggcagcatgttagcagagaggtgaaggatgaagagagagcaccacatggacatccgagatgtaaccatctaggcagtgagggcagcatgttagcagagaggtgaaggatgaagagagagcaccacatggacatccgagatgaaaccatctaggcagtgagggcagcatgttagcagagaggcgaaggatgaagacagaacaccacatgcacatccgagatgaaaccatctaggcagtgagggcagcatgtcctcactgcacagtcgagtaagcacagtcgagtaagactgctgccaatttctttctatttttttttttttttacagatacaatcttctctgacattgatatgcttacatgtctggtttcaactcaaatgcttatttgacaacctcttaattctctccgtgcctcagttgcagaggaggggacaggctgatggaagagaatggagttaattgatggaaactgagtaaggtgggaacagtcacggtagctcataggctcagagactggcctcgtggcctatgtcctggcaagggaagggagctactgcatgaaagagctattgaatctgacatgatgccacgtctgttgtggtttacctggatagaatgggctgtttctgccttgaaatgcctcctgctgcaataaagataagctatgaccctggttctggaccacagtggagagaggggatggagcagagacggaaacaaagaaggttccagattgtgagcttggtcctaaagaagcagtcatggcatcttacacttgacagggtctgcagaaagtcaccctgaatcaagcaataaaggcgcctgggtctgggctgtgcaccccctttggccagaagtatcctgccacattttcatttgcaaggtttctaagaaccgttcttggtgtgtcttgaatggctcatacttgttaactttacaggaatgtgtgttcataggaagcctgttaatcaaattgccaacataaattacttttcctcatttttgaaggcttgtccaattaataaaaggccgatgcttatgtactggagttactttaggccactggggggttggggggtagttaacgtttattgattcaatgtagtttttcctgtcactttgaggacatttattcaattttgaaatgaaaaatgatggtaaaattggaaaaaaaatatgtaagaaacttatgaaaaacaattctccaatttaaaaataatacggccttccctgtcgggctttgctgccagctgttatttaaacttgtatgctcctgcctagtgagagtcagcagctgagagtcttgtattagcaggaaaccagggcatttatgatggagttcctgttattgacttattcttagacaaaatgccaagtttctttggacagtacagtaggcccactgtggaagcacagtgtgaatactggtgtgacatttaggctatgattttttttttatgtgtccagattttttaaataacttttaaaacaatgttttctgtaatgatttggagacagtggttaacactacgaaaaaaaaatgtgtttttaaaatagaatctaactggtataccaaagaaatataagtagtttacgctgattccaataactctaccaggttttcttcacaggtgggtacattttagtagaaaaccttgctgtaggctgggaggaaggcaggtgaaacatcatcgcaatagcacagggaatgaaaactgtaaatgatcacacgatttcacatggaaaaaggcattttgtaagactaaagattattgtagaccaacatacatcagcatttaacgttttccttaattgagggtgggagggtgtgatttcccttgaagctaagcagaggtatctctggaaaacctgactttacaaattttcttaatttgggtgactaacattcttaaggaaacttatttcaggaaactacaaaactagcatcctagttgtctttattttgatagggttagggatagggttaagattcacaccattttctctacatgccaagtatacatcatcaatcaccacagctgtgggctggtctgtgatcgggtcattttcccggccctctttatgtttgcctttccacaggtagagttaatttttttaccaagaagtgctcctgcccactttgtcatctcccttcttcccccaaatcttgtccaatgctctctcatccctctactactgtaatgcaacaattaaatagcaatgattccatttactatcttcctgcatacatcccttatgtgtaaaggataccctttcactcattcaactaatatttaccaaatattgctcatgtgccaaatgctgctttaggcatgtagggacagtgttatgatacgaagtccctgcatttacaagctcaccttccagagctgtgctattcaatacagtagctactaaccacaagtggctacttaaatcaattaaaatgaaataaaattagaaattcagttgtgcaattgcatcagtcatatttcaagtgctcaataactacacgtggctagaggctgttatttcagatggtgcagaacggagcattcccatcattgcagaaaattttattggccagcacttccctagtggacaggttacctttatcactgatggttttgaccagtttacaagaccaaggatcatcatataatgtccctttcgcctactggtaaaaggtggcaaactatttagctccacaacttgaccacagcactcttttttaagcccatgcttgtgttaggggccatttttctgttatctcctacataattaccataatgctaaaatttatgaataccatttgtttctgtaacaaaagtcaatctatactatgtgtggtttgatgaagaactttttctaatattgaattttttttacgtctaaagttttacaaagaaaaataattatgacatttattgagcatttgctgtcgctggatattgtcctaaaccctttaacagagtttttctcacttaattctctcagcaatcccaaaggtggatgttaataacaccattttacaaatgaaaattttgaagatacagcataacttggttaaagccaagttatcagtggatagttgcaaagctgaagcaatcaacccagagctgtatgttctttgcttttaaatgctactattccccatcctctacctaagttcaccattagttgcatataaaactcccccattgaaaagttcatctccttaagttcaatcctgtagcaaatcccacacatcctgccgccttcttaccatgtcctctaatccaaagcacactgtccttgtgtccagactattctaacagcctcctaactggtctcccttcttccagcgtggccctctggagtagcttctataaagctgccagaatgaggattacatcacaaatcagatcctaattcttttctatttaatagctcccatttgtttccgattccaattagaatgacatccaaatgcctacattcttacaagtcctgcacaatgcagcccttgcgatatgcagagatgttaccaaagaagttcttatgctggagccactgcatctctgcttccatctcttccatctacccccacagattgctacaagttggactctttttcactcttcagtccaagccttcagggtgtgtgtgtggggggggaggggggtgttgtaggcttttgtgtgtaagtgtgacagagaggtttttgataatgatatcaatttctttaatagatatgctaccacacgtgtgttctgtttcatgataagtcagtttaggctggttgtcctttttcaagcaacttgtccatttttcactgtaacagtttggtggcagtataaaagcacagacggctgggtgcagtggctcacacctgtaatctcagcgctttgggaggccaaggcgggcagatcacccaaggtcaggagttcgagaccagcctgaccaacatggagaaatcatgtctctactaaaaatacaaaattagccgggcgtggtggcacatgcctgtaatcccagctactcaggaggctgaggcaggagaatcgcttgaacccgggaggcagaggttgtggtgagccaagatcacaccattgcactccaacctgggcaacaagagcaaaactccatctcaagaaaaaaaaaagcccggacatccaactctgaaatgagttttcccattcaagcaaagtgttgttatctttaatatcggatgcttctgggttctcaacccaagtggagtgtggtcagactccaggggtgcctctgggaggctctaggaggcactgaagacctatgcccactccttcataggtctacttgtctcttgcatgaattcatgcatcttttgatgtattcatttgtccattcagtagtaaataagaggaaacaagttgaacagagtccaagtggttattttcatcaactttgtcaaactcaaccatcactgtcacctgaccaacctcatattcatataccactttgagtatcaagatgcagaagaccatatagcagtggttcttaaactttaggctgcatccaagtcactcattcagactgctgggccccacccctcagagctctggcttggtaggtcaaaatgtgggcctaagattccaaacaaattcccagattgatgccggtattgctgatctgaggaaacactatgggaaccactgctttaaagtatttccaggtatatttgtttaggaacagtacagatgatattccttagtctgaggatgtccttacctgttatctgaaattactccagcagtccatcagagccatgaagggagaataagcacaggggtgaactactgaaaaccacactcccagaagtcttagtggtggtattcacagccatgccatgaggtcagagaaaacataagttttacttataaggtcatgaaaacataagctttactctattaggattaggtgaagctgcacataagttagaatccaacacacatcatgtaaaagaagtctgatggtagccagtcaagaactgctgattacggggtcaacaataatcaatgacctaggtagcctccttctatatctggcttctaccctcaagtttatgtcaccaatgaaaactgctgctggagctccagacatcacatccatgtaccaagaaacagaaaagcagaaggtaaaggcacaggggacatgtctcccaactctcaacttcctttaagcaggctttccagaagttccacaaagcactgtcacttatgttcattggccagaattgaatcacagtcacatttactgctaaggaagctggaaaatgtcatcatttaattaagctcagtgttcaccccaaataatatagggattgtatttttaaggaggaagtgaagactaactggttgtccatgccacaatgacaacaaactactgagcttataacattagagtttagaattgtaatcaaacttacaaaatctgtattggattcaaattgcccattaacttgtctgcattgttcctaggacggttttgttcctagcacctagcagatgctcagtaaatatttgttgaaggaatgaatactacccctaagagcaattcgcctattgttacgtaaaaataaaagtgattctcattttagatcaccccttcccctctggaaattacagtcctgcccatttgaagtttctgcagggaagactgtaaggttaacatggccacaggcaattttcttaataactaagggacacagtaaattcctctcaacaggaaaatattgagaagatttctctaaaacaggatcttgagaaccaagaaattaagcatatatatgtttgccaagttagtagctttttccaggcatatgaaaaacccagtcaggaaagatgaggtggaaaaggcagacaggtattcccttcccagattagaaaagttttacttataaggtcatgaaaacataagctttactctgttaggattaggtgaagctgtgcataagttagaacccaacacacatcatgtaagagaagtctgatggtagccagtcaagaactgctgattacggggtcaacgataatcaatgacctaggtagcctccttctatatctggcttctaccctcaagtttacgccatcacccaaaactgctgctggagcagtttagattagaaaagatttatccatcattttcaggagacttgttctgttaccagctgcatcacagctgaacagtgcagttagcttatctacattcaatattccgttttacagatgacacaattgtcacaaagaaaggctaagcaactcacctaaggataaatatcaaatcatagcaaagctaaaaacagaagctactatttctgatcgccagtccatactttttacagtcacaggaaaattgtagagtattatatacaagctgtacagacaattttcccacagcttgcagggccacaaagaggtggtactgatggaggcccacatatgttagatgcttctaagaaactgtctgcataattattcaaaacactttcccatagatttatggcagcccaaactgtggaagagctcaatgtagctgaaatacccgaaggaaagtaaaagcactttagaaaatagcttgcccaagatgtggtaatttgagaagccataattttagaaagagcatgttttactattttcttcaagttaaacacattttgctaaacgattatcactaactgaattctaaggccggtacagtgggctacattaaaaaaaaaaaaaaaactattaggcaatctaatgttctcatcagtagcacaggtaacaactacgtgtctgacccaagctgtcctgtccaagcataagagcaagaatattaccaaacttaattctcaagctcagttttagaaacctcttccatcacttcaagaaaactgttttggatccccacctccttcatgttaacagcacatggttaagtgttcagcagggcattgcaaaataaaaaaagaaatcaagatttattagataagcccatgactccataatcagacttcttataacatcttttgagattacttcctaactattctggtgttaaaatatcctttattttaaatgatgggaacccaaaatacacttggttgaaaaaataagagcactggttgccccacagtgaacctgaaattagtacatactgtgggggtagaggctactagttaaggaaataaaaaagtctgggccactgaacacaatgtactctgcagatctgatgttttaagcagcctcagctcaatggcaaatgccagaactggctgactagctcaccttccccctgcagggggagtagtcccgcacaataggcaggtgttagccaagatgccttgaccacagtgggtactcacacacctgctgtcagttttcaagtgccaagtcaaaccttgcatgtaatgtatctctaatacacatacatacacatacacatacacacacacacacacacacacacacacacacacgttctctctctctctctctctctggactgaattctagaaaacttctgcttattttacctatgtttagcattatcaaacgtgcatttataaaacctctagaagccagtaagtggccctaaaaaaggacacgtaagaaaaaataattttaaaattgggaggaaaatctatcttcggggttctaatacgatttaccacaatgtttaatgctaggcttaagacagattcttaagctgtttcagataaaccaagaggctaacagagcccagctcacactaccatggctgccaggcacaggaagatagaacacacactccttacccaaaggacccaaaacctagcgtgaaatgatccgtaaacaagacagccttaacatatagaaaggtgatatattctgttgtatgtaattagtgaaaaagataatcactattctacactagagaaaacaaagcttcatataaataaattttctagctactgaaagtaaccaatttagctcctgagtgcctttattataatcaacaaatttgtacagaatatttcaaaaatctatttcctactttccacagattgcattttaaggatgcaagctctgaaaccagagtgcccagttagcatcccaggtccaccacacaaggcaggccaagttcatctccataagcctcagtttctgcacctaccttagcacactgttaaaaggattaaatggcataatgcacataaaatacttagaacacttagcctggcaaatagtaagtgctcaatatattttacctattattaagaaaacctgtagtggtcagggtttgttaactaccaagttatctaacaaaatccccaatgtgcttacccatcctttcctggtgtaacgcagccccaggagtgcctcgagaatggacgggctaagacatgagtatggggttcatttcagaccaatgagacaggaaaggaaatcagctaggggcttccaggaaaggtctgcttactcccaaggtgggaaaggaaatcagctaggggctcccaggaaaggtctgcttactcccaaggtggggtaagagacagacagaggtgggccatgggcagtggtgtctcctcctgaacccgcatctctgggcacggcacctggagggtctacacccaccctctgccctatcacaccacatgtagttcatccctttcacggcacttagtgactaacatggtttggctctgtgtccccatccaaatctcatgttgaattgtaattcccagcactgagggagggacctggtgggagataattggatcatgggggcggatgtccccctttctgttctcgtgataatgagttatcatgagatctgatggtttaaaagtgtgtggcacttctcccttcactgtttcttctgatgccatgtgaagatgtgcttgcttctccttcgcccttccaccatgattgcaagtttcctgcagcctcccaggcatactccctgtacagcctgcataactgtgagtcaattaaacctctttttcttcataaattacccagtctcaggtagctctttatagcagtgtgagaacggactaacacagtgattacccaaaacagctctggtttgtttacttctgtctttcctctgccaccacactagaagagtaagaggaatgttttttggggatgtgcattactaacgccccttacacacgtacttgacgtctggggccatgtctaccacgttcattcccacctgaacatagtgggtgttcagcaaatacctgctgaagaagtaataaaataatctcaagtatctatttgttttccaaatgacatctgcttatttttaatgtgtataacactttcaattactttctcctacaattctctaatttgcatgttaaactttagataagactaattaatagtaacatctgccctatatgtttttttaaaaaatagaccctacatcaaaagatgttcaaaataaaccaaaaggatgctcaaataggtctatttgaaatgctcaaatagtctcactcctctttgtagcaagatcttccccaccaaaaataactagaaaaaattttttaactcccaaagaacacgtaaggcaggaaaaaatacgtatttcatgttagtagtttttaaataatctatgccgtagggtcagaaaacagacattagtgagaatgagcccagaattctaaattcccatgaaatatttattcaatttgaaaacaatgttaccaagtttacgacttccagtcttttaggtgagccaaagtaggaactaggtactcttgtaagacattatacataaaagccttccaaaaatatgactttcctatcccttttcacagtttcgtcacctaaaatttaactaaaccttcaacaattggtaataatttaacccatctctttttaattacagttcattcaagtaagtaaatatagtataactgtgcagggaattttaatgtcatagtacctatttgtttttaatttagaacctgtgttacatttctctgtaattcaattgattaagaagccaagtagatgtgatattttgtgatatgataaagaaaagttatactacttcaaacctggagcttttaacatatgaattcaattataaaatagcaatatctcaactaactcctgcagtggctctactgttattttctacttgggaaagttaagagttcaagaaggtctttgtcaaaaacttaagcaggcaagcatacagacatgttaacaattcagaatccacccaagcttagacaaaacactgcttcaagcagcgagcattgcaggaccaacatttcaaagaatttttcctaaaaagaaagagcaacaaaaaaatcaacaggacaaaacctcaaaaacattacaacaatttttagataataatacaagttataggatattccttatgtgcttaaaatttacacttaaacaatacatattctctaactgcacagccccaaacccatgttttgcaagggaataaaaactataaagttattaagaattgctggagaaaacatccttagtggtctttgtgttagaaaggacctgctttctttaattatcaacttttccacttataccaaaattagattaacttgtaaaaaaaaaaaaaaaaaaaaaactaaattagaaacattgagcttactacttgaaaacaacatgacattcatttttcacatgtgcagctcgacatggattctgactataaaccataagagcgtgtgtcatcctctggaaagcttaaaagggcagtattttctgaatggttactcctgtaaaaaataatcagtttaagtctttaaaaagaaaaatatcaccttttcttatcatttcttctgtatgcccatggcattcttttacttaacttgtatcccctaaggttactccctttctaggtggcttaggaaccttagggacagggaaatcaaaattagccccctactgtacattatttttgtcccagtatttttgaattcaataaagggggcgtgggctctcactgctgatctctgtccacagtattagaaatcataaaactgtaatccacagcaaaagctcaccacaggtggcaaatatcactgagggaagcctttttagactgtcctgactcaagagtccctcaaaatacgtagcaaggaatcccttgatttatggtagttggtgaaacctggcagtgggggtggactctgcagctctaaattctaattccagctgctcattaatctgtcatttactaatggtgggaccttaggcccattaagctctttgggtttcaatctttttcatttgtgacatgaaaataacaatacagacccaatggtcttgacaaagcagttgtaggaattaaatgggatatttgatgtaaactcactttgaaaaaggagagcaaataaaatacaaattgattttgtcataaaggtacacaaaacagttctactatagtttggggtgaaggaggggcacatacggagtaaaaaaataaaacaagggtagtcccagagcagattgctgggccgtgcttcagtgcagggcagctaggaagagcaccctttaaaaactaacccacataaggagaataccaatcagcgagcattagaggacacagcaggaccagaagaaagcacagtggggtctatgagaataggaggacgaaggctagaattcaagcttaagggggagaaggggtaaactaacactcttcagagtttctgattaaatgaaaaagtgaacaaggtaatgttccttacatactttgaggcaacaactaaaacaagtactttagcagcaacgtcaagatgacctacggagtgttaatttttcatttaaatattttcaaaattaaaataaacctgcctttgggctccttagaaaaagagctgattccagatctggtgcaggaaaaatgtatgaatcctcttgtcataccagaaagcaatgaagcaaagactatcaagcctgtatcaaaaggacacagaggccaaatggaaaggttcacagattaggacaactagaacttcaacaataggacaacaagcttcaactgacacacatcaacaatatttcattccatgaattcataatggtactaaaaacaaaattagtcaccattggaaattggtatgaaaccaagtcattaaaaactggtaaagaaaaataactgatcatttattttgccttttctatacctcagagtaaccgaatacagttggcccctatatccatcggttcctcattgaggattcaaccaactgcagatcaaaaatatgagggaaaaaaaatggatggttttgcacctgtaatgaacatgtacagacctttattgtcattattccctaaacaatacagtataacaactatttacatagcattttcattgtattagatattataagtaatctaagtatgatttatcatacatagcagaatgtgtgcaggttacatgcaaatattatgccattttatttaagggacttgagcatctgtggatgctggtgtctgcgagggtcctggaatctatccttcatggataccaaggaatgattacacttatgagcttctttttttacataaattttctttctttcttttaagagacaaggtctcactatgttggttgggctagtcttgaattcatagcctcaagtgatcctccctcctcagcctcccaaagtgctgggattacaggcaagagccaccatatccagcaggagcttctctttttaaaagtattccactaatcactgaagaaaaaactacagaattagattatcacaactttgcaacttctaatgaaataatggataatcttgagaatgatcttcaatggttgctgatattacatgaagaaaaccaagacatcacatgcttcttaatgtaagtacgttaagaccaactgtgaagtacttttgtctccaccccacatcaagaaaaatcaagactgaatctgattaagtctttaaatctaaacatcaatttacaggaaataaagggataaaagaacactttgggaatataaccaaattcagactatggaagaaacaaaacacagcaaatggctcagtgtcctcaacaaacagattataagagaggatggggaagggagaaagagacacatacagagatagagacacagagaaaaagagacagagagaggatgttattagtccgttttcaagctgctgataaagacataactcagactgggtaatttatgaagaaaaagaggtttaatgaactcacagttccacatggctggggaggtctcacaatcatggcagaaagcaaaaggaaaaatgagagccaagcaaaagggtttccctttataaaaccatcagatctcatgagactcactcactaccacaagaacagcatgggggcaaccacccccatgactcagtgatctcccaccgggtccttcccacaacacgtgggagtaatggagctataattcgagatgagatttgggtagagatacagccaaaccatatcagtgggggaaggagggagaaagagacagtagagagggagaagagagaaagagatggggagggaagaaaaataggagaaaggaaggaaaggaaggaagggggaaaggaggtaattaaagacaggctaagagacattgaccaatttaatgtatcaccttattcggaccctgattcaaacaaattattaaaaataattatgagacaattagtgaaatctgaacattgatagacatctaattgtgttaacaaactattattaacttagtaaatacaataaaggttgtgtagttactttttcaaagagccaattaaagatatataatataataaatacagctgaaatcatatacagtgaccagaatttactgtaaaaaatttggaaggggatcacggaaacatagagctacatatgaaataaatttgtctatgagttaataattacaattagaggatgggtatgtgggggctcactatactatgatttttacttcagtatatatttgaaaacttccttaataaaaagtttaaataaataaggctgccttgaatcattttgggaataggacagcatatagacttaaaagattttagattaaatagttttaaaggggacaatatatgctacttaaggagttacaatgaaagatattttgatttctagttacacagcatttaaagttcagaaatatgtacataatgtgtttaaactcaattgaagagactaacaatctcattccataattcctacattataagttattttgaacattttaacaaaaacatgatctttactggcttaagttagtatgaaacagattctaccttaatcagagtaacaggcatgtgtttccagagtgctatgaacctctaagattacatggaggtgtgtgcaggtgtaagcgtgtgtgagcacgtgtgcacatgggtaaactgcactcacacttctttgtgggaaagagcctgacttcagttaaagaggtctgagctggtgtggcagcacgcacctgcagtctcaggtactcagaagactgagacaggaggagcacttgagcccaggagttcaatgccagcctgggtcactgaaacctgcttaactatcaacttgcacacatacaaattttctaaggaggaagcacatctgtaatataatcactaggattcttcatagccctttgtgctatcccttttacactgcatttacgtgctccaaacacccccaaagtgctttaagttggctgcttcccacccgcctctcctgggcaggtgcctctgcagcagcccctgcacctcaaccccttttcgcagccaactcccatggctcctcacggaaagggagctcagtggttcctactccaggacacttccccgagacttggcaaggtttgcaccattctgagacccgcacatcagacctccctgccagcctcccgcagccgccctggcttcagccgcccacctggcctgagcgctcagcacgtggactcgagctggctctgcacccagctcagaacacagctctcaactgtaagcatcaggtaagcagcttggcattggtcactagagggacagagatcatcagacagcagtttctgtgaagcccacactgggacacctggctgcaccccctcccacctgaccctcccctgcttcctggcctgccctgcttaatttcccctcacctcactctgcaccacaccaagagctgccagttctattaccaggacacgtgtttgcctgtaatagagagctgccatatatttttaacatactataatactttaataatacaacttaatatttatatagtaaaatatatgacatgtaataatattttcaatattaagtgaaggtttatgtttgtggtttgttgtttaactttaagggagaaacacatataatctcattaacttgcttttgaactaagccttttactggggtaaggtaggagaaacacctcccaactctgttttaaatagtaaacatcaaaatgtgcttacaataatgctgcaaatagcttataaagtgatggtatcttctgaagattaaacttgcaaacatcttaacacacataaggcctggtatatataagcactcaatatgtttcagctgctattagtggctttgcatgttaataactgaactatcagggcactttaataaaggtaagtaagcccctcccattcccctccaagcctcccagtgccccccaaagccctggatgaactgagttaactggagccaaagcctaccaagaaacagccctacacatccttcttttaaaggagtaaagaaaagattagttttgatccagaaaataaaaagtcaagcagtattttacccaagttaatttggactctggaattattctgccagtgtctaaaggacaaagtgactgaaaacaactgctctcgggctccaaatgagctgacaagtggtttgtcaagtgagtattcacgatcacctgtgggggtacccctaagccccaaaacgccttccaaacctcctcaccacctttcctcactgcttccccagcaccaccccaagcctgaccattttctcacttactcccctttttgtaacatatgcagagttggagcgaacacctcagagaaaaagaggaaaagaaagagaagaaagttgaggattacgatgaactcatctgaataccaagacaacacccagactcacctctggaaatgcacaggtgaaagaaaagcaaggcagtaaacagcaaaaaggaaccccatctttctccacctcaagtccacagaaattgcctcccttctaagttttaaacaagggatgaagatatctttgaccaccggaagtgaaaaattaggacaaaccagttagatcagatcatccgtaaattacaaaatttttcaccttatattgtttcttggactaagacactctgtctttgccagaaagtagtgattcacttttgcaaatatactatgataccacacttttacatcttgcaatggaaaataagcaatttttaaaaattcacctcagagagtacagaacattatcttaatttttatctttcccaaataattattaaatatatttaatatgcacaattgtaattatgaatcttctatatatcttaatgtgcattctaaagtatttcagattacaatcaccagatcatttattgagagctatgttacgtgccaacaaccctgaaattagagttaattatcttcattctatacattatgaaactgaggtttgtagaggctaaagtttattcagggtcacaaggttccaagagctaacctaacacctgtgctttttcacagattctaagcattaggaatttctttaaaaatctcttaataaataaataggctgggcacagtgattcaggcctgagttctggctacttgggaggttgaggagggaggaccgcttgagcccaggaggtcaaggctgaagtgagctacgatcataccactgtactccagcctgggcgacagagcaagaccctgtgtgaaaaacaaaaaaagaaagtaaacaggcaacaggtcggtcctctgagaagaggaaatggggaggtggcggacaggcataggacgactcacctgaatacccatttgcatctttatattttaaattagctgaatatattacctacccagaagataaataaaaatttggaaataaagcaaaatctaaatagaagccagatgatagagagggtagaaacttgagtcctacagaaccagtttggctgaagagcatgctgtcattaggccatcagccaacagtgcatcctgttaagtgagaagacaacatagaacttactatatggacgatattcgtaatcactttacacaggatcctctaaaccagtgcttctcaaactgtctgcagtaaagaactagttattgtcagcatcctcattttaaatttctaatccatcatgaactggttcttttgtaaaatacaactgaaggtgagttactaaaaaaaaatgattagatgtaaatgtctcaggaacttgctataaaagcttctaaatttactctcattttctgtacttaccttgtcacagaccagtaacaaacagagcaccgaccacaccagttaaaagaccacacctcctgggcaccaacttaaaccagaaactttaaaaaaaaattccctctgatttcagtatcatgaatattgctcctgagcagccgggtcacttccgttttcttcaaatgtcataaattatacaactacaggttaagcatccctaatctgaaaatccaaaatgtccccaaatccaaaacttttttagtgtcaacatggcaccagaagtggaaaattccacccctctggtcccaagcatttcagataagggatattcaacctataatggtgacaatgaagatgatgtcaacactgcagaaaaagtgcccagagacaacatgttgaaaatgtgtgaagggcttattcaagggctagggcagtgtgcattcacaataaaacatgaaatcctgtcagtgtataaaatcaaagacttgtaagacaaaaatcatggctaatgaggcagatgactccggaggaaacatctttaaaagccatccagcagaacgcctccttatccctagaggactcaatttcccggtccttcaatacttctgatgtttcttttcacccaccaaacacaagatacaggtacggtaaccttttagtcaacacaaggcctcacagatggagacggaaagcctgctgctgtgtgctgttgctgtggtttagcagctggtacagatgtctggtgatgctctgtgctgcttggttaccctgacacttattttctcgctgtaataatggcatgtcatattttttactgttaagtgctttaatgtgaatagatgtgagacaataattgcttatacgtagcatataaattcagcctcaagaaggatggggatgccagacaactacagactgtccacatgggtggctcagatagagtcaccttcactttctgacagttcaatgtacacaaactttgctacacacataaaattacttaatgtgttgtataaaattaccttcgggctatgtgtttaaggtatatatgaagataaacaaatttcatgtttaaacttgggtcccacccccaagatttgtatatacatttctctacgtatatgaaaatatttcaaaatcggaaaaaaaaaaaatctgaaacacttgtgctcccaagcacttcagataagggatactcaacctgtacttgtatgtccctgtttgataatggtaataaagctgtggccttctaagaagggatgtacaagctcaggcacagtggttcacacctggaatccaagcatttggggaggccaacgtgggaagatcacttgagattaggagttcacaaccagcgtggggaatacagcaagaccccgtctatacagaaattttttaattagccaggcatggtaatgtacacctgtagtacattaccacaagtaatgtactcctcaggagactgaggtgggaggattgcttgaatctaagagtttgaggttacaggagccactgtactccagcctaggcaacagagcaagaagcaacacccaatctcaaacaaataaacaaaaaaacacaaaattgtggctcaaagattacctctcagctttattcctggcttcacgtagaattccagttctcacttgtaatatcatgatttatccatctgttttgacttcaattgcattttattattttaatcaagctcccttaaacacaatattacattacttaaagtagtgtcatctaaaatgttctttttttttttgagacggagtcttgctctgtcacccaggctagagtgcggtggcgcaatctcggctcactgcaagctccgcctcccggcctcccgggttcacaccattctcctgcctcagcctccagagtagctgggactacaggcacccgccaccacgaccggctaattttttgtatttttagtagagacggggtttcaccgtgttagctaggatggtctccatatcctgacctcgtgatccgactgcctcggcctcccaaagtgctgggattacaggagtgagccaccatgcccggccttaaaatgttcttttaacaaagggattttagtgaattttgcaacatgagtaaatgaattaatgagaatatcatattcacattatagcagtcccaagcaaaaagaaaacaaacaacaacgaaaaaagaaaatactctcagaatgtgccatggggtataaaagaagaaaaagaagacaatctgtggccactgcccacaggggcaacaggaaacttggtgctgcccctttaagaagccgccaggtcagtgggaagaaaaagagaaaatgaaagtcaaagggccgtaaagaaacaggttttcttaaataggaaatacaaaaattaaacagtaattctacctaaattattctccaaaataatgaaaagcaacaatgtttcagtctaggctcccctgcatggaggtgattagctggaagcgactagtatgctgaagtctgataatgacagcttttacacactgtcaccaaattacgatgcaaattctatggaaatcattagaccagcactcactgtaagaagtatgatctgggattgagttttggagcttctcagaggtttactccgatcctgtcaatctgactgcagagctgctttccctaggcgtctaaaatgctctcctggggttagagaccacaccctggtgcagtgaatgggattcctccaattccaaatggctccaaaacctctgctttctccctcaactgcttccattctcactgcttatctccgaccctttggcccaaatgtctccattcattcggtgcctcattacacaattattgggtactcatcaggtgcttaagcactggtgaatgtaaacaatagaagcttggtccttgaggcatactgattctgttaggcaatttaagaatactcacagcaaagggggaatactgtaatagacgcaattaccagccaattaggaacaaaaaaaggaaatgctgtactaagaaatgctgtgctgcttgagaaggtcagggcaggctgagagtggagcacaggatgagtggcaggtttccaggcggtcagtaggcaccacagtaggtgtgggggaaatctggacagatacaaacacgagcaacattgagaaagacagtgaggcagttaattttgtgtgctaactaggatatgccaaccagacttggtcaaacacctgcctagatgttgctctgaaggctattttttagatgtgattaacatttaaatcagtacactgagtaatactccctacaatgtgagtgggcttcatccactcaaagacattacccaggaggaacaactaattctgcctccaagcggcctagatgttggactggagctgcaacatcaactctttcctgtgtctctagcttgccagccagccctgcaaatctcagacttgccagcccccacaatgacatgaaccaattccttcaaatcaatcaatcaatcaatcaatcaatcaatagcgcgctctctctctctctatatatatatacacacatatatatatatccatatccatccatcccactggttctgtttctccagagaaccatgactaatgtggatatggtgaattcaagaaactatccgtacaaaatggctgggttacaaaacacacacaagccagggggcatgtggtgcaaaggcaggaaagtgctagtcacaaaggcactgggacactggagagtttacactccccccagggcaagagagagccaccaatagtttaagctgaggagcgaccatctgacatgatcagatggtcactccagctaaaactcactggcagcaaatgaatggaaaaaaaaaagactggaagcagaagaccaggtaggaggttactataacagcccaggcaggacaaggtaactgatgtgggcaaggaaaggacaagagatgacaccgctaccaaagctatgctagtggggtaaaatcagcaggacctgctggtgaagacatgaggagtgaggggaaaggaggacgataggatgactccaagatttctgactttggctcccaaatggattgtggtcctgctttgaaatagggtggggaaaaacacagagatgatagaagggagggacatgtggagtaggagatgtctatgaaatacctacatggaaatgttgaggcatttggaactcagggtctggaactcaggaaacaaatctggactggagacaaggctttgggattcacaagggaagagtgactgcagttgtagacatagaaagtgaacaaagtaggagagagtcaggaatggtatgttaagacacactaacctgcaagggtgggcagaacaatgcactgacaaagaggtacaaggaaaaccagcagaggagggaaaatcaagaggaaaagtgacagtgataacacacgccaacaaagcaagtaagacaaggactgaagttgcagggtttagccgtgaaaggtaatttagaagatcttatataacaacagtttagggtaggatggggaaagcaaccaaatataatgagttgaacagtccttaagagataagaaaatggacatagtgactgaagccactgggctgtgaaacaaaggctgggggaataatgagaaagatactgacagcccgttgtggaaccctagaaattatccacccttattgacacaggtgttgggttactgtgcttcatctttaattcagctctgttgcagggatccctaatgcagaacactgaccacagggccacaatgacttctggacattagactcagacaacttggcattttcagtttggtgatgatgttggaaactgttttcaatttgcaacctaattgcttcccaaataaagatctcaatgatgcttctcataggagaaatacatatattctaaagagtgcactgagtagtttttagctattttacatataattttatagttataggagcgaagatcagtgatcagaaatattttatgtacaagtttggtattatgtctcagagaaaaaaaatcataagtatagcatttgttaatgaacaccaagtaccttcataaaaacatgtttatttgaacatgcaaataagagttagttgtttactctcatcaaaattatagcgtgtcttcaggaaaagaattctaggtcaaagcagactaatgttcaggacagccaagagtaaaacattaatgaatatttattaatattatgtgccagacactgtgtccttcaaccctcacctatggctagtaccattatcctcactttacaaaagagaaaactgaggcacagagaggctgaataattacttgaaagtcacagaactgagaactggcagagaggagatttgaacgcacgtacgtccacacgatgtcagacgctacctgagatgaacagtaagccttggccgggcatggtggctcaggcctgtaacctcagcactttgggaagccgaggtgggtggatcgcttgggcccaggaattcaagaccagcctgggcaacatggtgaaacctcgtttctataaaaaatacaaaaaaaaaaaaaaattagctgggcatggtagtgcacaactgtggtcccagctactcgggaggctgaggcagaagtattgtctgagctggggaggtcaaggcttcagtaagccaagactgcaccaccgcactccatcctgagtaaccaagcaagaccctgtctcaataaataaacaaacaaacaaataaataagcctttatcctatgatctcattaaagacagaggtgccccctaacttgccctttaacttgcagtcttgatccctgcaacaaagctgaactaaagatgaagtgcaataccaaactgctccctaacttgtaccttctcctgctcctatgccacagctctcttccataagttcattctgaagagtcctaggctgttctatgcaaatgacgaatcatttgccaacccttagattttccggcttgcatccggatcagtgtgttggctgtaaaccaaccaacacagatgatcaatattacagcacaaaggaagtaaaaagcctttgtgattatccagtaagctagggatcagaaaagaatgattgcaaaatcctaacgtacagtagaataaggaaatgtttccaggtatttgtcagaaaagggccagcttccatctggaccatgacctacaaacaacattaatgctcctaacagaactatttaaataagattccactgtttgttctctgaaatctcctgggacacaatgactacctagaaggtaatcagacctcgaccacaggagagccaaggactgccattccagctttcctgccattctcacttcctggcaggtgaactctgctcccattccagcccctgaaagcctaacctaagaaaagaaaaaaagagagaggaatagaaaagaaaaaactgtgaaaagaaagaaatgaaatagaggcagaaaacaaagaggagggagaaaggaaacaattacactagaggtagtttctgctagaccaacactgagccaggccatcccagttttcactctcttctggacactcaccaacaatatactttaattttgtcaaaactgcctttgggtgaggcatcctgattcctgggtagaaataacatgaaacccgtgaagtcagagactcttctatagtagagacccagaatgcagttcactaattttgaaagaatttgtcagagctgtaggagacctgtgagatcatgattgctgttcccatctaagagttagattctgcctatgataactgtccataagggcaacattccaactaaattttcgcattactgtgtgctacaattaatttttttaatccagttaataaagtgctttcacagagtatatcattaacaaaagttaatcgataaatactccagagcaatagccccaacaacagagatattataaccctcctatcagaatacacagaaatggaatatgagtatctggaaatgcaaacttcagcaaacatcacaggaatttttttaagtgtttgcatataacatgtcaaaaactaatgaactctgattctactagcatttactctcctaaattctatcactcaaaataatatgaaaccattaaaaacacctaacatgtgaactaaaatatacacacaaatgtctatgacaatcataataggaggtgctaagctggttaactaacaagatctcttgaggctgggattttcctcaccctagacccccagatgcattcatccctggagtccctcgtactcaatcagtacttgatgactctgaaagaatcatccaggaatgattccagatggaatttaagttccatatccaactcaaggccagtaacatttgctgaaaagcagtgaagtcaatcagtaacaagttagtcaaaacaatgaagaaaagataatgcaggcagtaattacttctgagtggtgggattgcgggtgttgttttttttccccctgaaactttatatcctcctatacttccaatttttcaatagtgaacattatttttactattctgaataaatgttaaggaaaaaagtttatgaaatatatatatttccatatatatgtcatatatatatataaaatgtttcaagtcactactacggtccccataaatgaatggttctcaaccacaacacctcacttttcaaacacctcagaatgtttctaaaaacagccagctccaagttctaccctaagcccactgaactgcatagaagagccaagagttattcaacctgcccaagtaattctattacaccaccaacatcagaaccatgctttatggatgcttcaactacaaatggcaagtttcttatctttggagaggactgaaatcaaaggtcagaacatcaacaaaaaagcaaagtattcttttggaacaagctccatatctagagaaacagctgattctagtgagaatttcagtagttcctagagagtgactgtggaaaaggcaagcacagcaggagacacctgagattgcactggatgcagggagtgaggtgccaattgtggctggaactataggaaggagcgggcaggccagagctgtttccctgggattccagaacagaaggctgtgccacacagaggtcccctgggtcacaatagcagctgaatctcagtggccatgacagcaaggcaacaacggggccagctccccaaggtccatgtaagtgcagctgcccaggactccccttgctgtccagacataggctctcctacctgcttccaacttcagttctgtggcatttccaggaaatatgggtagttaacacataaccatgctcaatgagagccaacctgtggctgtgcggccctttctcggcacgtggcccaagcctgtgctgggtctacgcagtgaagtacaaggtaaaaagaaggcaagcagcttcttacacctccctcccagtgctgaacctagacaaaatgtacccctcttagcacctttaggaacttttcctagagaaacaagaatggcaggcacctatctgagtgtgcttggttcctcttggatataaagtgcaagcctgtgtcaccttctgtgtcactcaggattaaacgtttatgacatcccaccactgatctaaaaggatccactcacagaggaaaatgaagactgaaaagccaacaccaacaccacccttctgtgcttctcagcacttctgggccttcacgtcctccttttcctcccccacctttataagcactctccttttcttcaatatacactccaaaccctctccgtcccaccttaagtgatctgccttgagctgagcccgttttttaaacaggtaaaactgcttttaagagaaagaaacatttctcccatgcagagtacaattaagaaagcatcccttccccatccccagggcagccatgcctccttccacctaagcttggtgagctttggaactggtggtaagaactgatccaaagtgtgtgctttaacaaatccttccaaagaaaacttggaaatcagctatttaaacttggagtccacttctctgtaggaagggcattcatttgaacacaaatttagttcctgcgccataatgtgcagtgttaagagtaaccctgaacaatgcatttgctgcatggaatagctttctcagtacaactgtgtagtgctgtagagctccctttttgcccctggaattagccccaataccccccgttgacagcttcaacaagtgggatccaggtatgacatctgagaagtgagtaaaataaggctccagtcgacaatggggcaatggaagtggccaggcagccaggctctgggcagcaaccacaccagaggctagctcctggaggcaaactctatgattgatgtgatgaagtggggaaagggaaggggaagaagacaggaaaagcaagagtccctgaagcaaacttctagtggtgggggtctcccgtggctccacttttccccagggcttcactgcagatggggtgagagagggcatcagccaatcactgtccagaggtaggacactgcccgcatccagtctggtatacaagaaaaaccaaagtgatcctccaggataacaatgttctcatttccagaagatcattacgcaaggcactttctttcgtcctagtacagataagggtggttcaaaaagactcaaaagtttgcccatgggctgtgcatggtgattcatgcctgtaatcccagcactttgggaggccaagataggagaatcacttgagcccaggagttcaagaccagtctgggcaacatagagagaccctgtttctacaaaaaaaaaaaaaaaaaaaatacaaaaatgagtcacgtgtggtggcacacacctgtgatcctagctactcagaaggctggggtgggaggattagttgagcccagcatgtccaggctgcggtaagcaaagatcacgccactgtactccagcctgggcaagagcaagacaaaaaaaaagtaaatttgcctgtgacacccagtgagtactgaggtcaggaatcaaactcatgttcatctttctctcctctccctttacagatttatcttaattccaaggccagaattcaggtaccagaaatgggtactttgcccagatcatccctgacaaaaatatttgcctattaacacaatcttactacaactaaatagaaaacaaaaactgttgacctataagataaatgaatctttcaaagcattatttggttgctctacctgaagaatactaaattgtaacccagtcatccagcatgagactctacctgtaaacctcgaaggcttattcctgcctagagccccagggaagcagcttccacctccacattccaagctgccatggaaacaacaatgctgcctattccactacaggctttgcgagactcctctgaagacctccctccagagtccacagttgcgagactcctctgaagacccctatccagagtccacagttgcgagactcctctgaagacccctctccagagtccacagttgacttcctcctcagagtcctaccacaggattaattcctgaaatctttcccaaatccaaacgttaagcattatctacatcagtcaatgtcctactaaaagtttccattacacatgctataaattttgactgatgaaaactaaaaatctagatgcttttattagctacgtatatttacatctattttctgaaacgtatatttaaagagaagaaaaaccacagcccataaaggttaagtgatctccattcttcaaagacctaagcagtaatctcaggtttcctggatccatccctaagccctccactaacagcgatgtcctatatagagaatctgctaagatttctagttgggctcccaattatttccctggcctagataaaatacttccttgtttttagcaactaaaatgaaattttccatagtaacaatctggcaatagtataaacttttggtaacgcttaaataggttaaaacctatatgttcaaacagtaaatattaaaagacaactcaatggaaagaaaatactacataaatttaaataatttgaacttactaaattagtcaaaatagcaaaattgataagggataaaattaaaaaccaccgttgtccataaaaaagccaaaaggaaaaaaaaagggacttcaatacttggtcaactcttcctatttctccttttcaaggtttatatttaaatgtagaaaagcaaaactttaacaaaaatctactatgtattattacttctcctcaaaaaaaaaccccaaaaccttcccatccaccttgagaaattcacttaatgcatttagtattctcttcccccctcccaccccccccccccgttccttcccctaatacccagggttgaccaactcacaaagctagcaggatgcctaagtcaacattataaggacagggggacaagaaagagtgcctggtcaaaacaacaagatctgtcaccacccagaaggtccccaaaacttgatttcagtttcaagttcccaagttaaacctgaaacaacacaatgatgatttgaatattccttccaagcacactcagagactagggagagctgcagaaacagagctgtaaggattccctgggtatcttgactcctaagttctgctagtatattctttgtgaggtatgaaaagtgcccaagggccaggaacagtggctcacacctgttatcccagcagtttaggaggcctgaggtgggcggatggcttgagctcacaagtttgagatcagattgggcaacgtggcaaaaccccatctctacaaaaagaaaaatacaaaaagtagccagatatggtagaacccacccaaagtcgcaggtactcagggggctgaggtgggaggatggcttgagcccaggaggcggaggttgcagtgagctgagatggctccactgcttttcagcctgggcaatagagccagaccttgtctccaaaaaaaaagcctaaggaatttgctcagcatgccaaaggaagtggttaaaatgaaatctgaaacaaccaacaaacgaatgcttaccaagcaccttttatggtgctcaatatcaaatgggtaccaggaagaatgaagtattataaagtatagtaactccaaattcttccagacagccctggtttccaacattcagttccactctagatcatttatatatgagataacgtgtgtcctaccttggagtcaagaaaaaaaatggtcaccacaggtttaagacatgatccctatccccaagaagttcatatttcggttctgagcaaatgaaatcagataaatgaaattgtttttcatttcagaatctgaacaaatgaaattggacaaatgaaatttttttaatagtattcaataggtggttcccaaatgtactgtatggactaatgccaatccatgacacatttttaacccgttctttagcaaaatgaaaaaaatggaaatgagaaaaagtagttcacatagtcaaaagtatataatttggtgagtgttctttattctgggagcatgttcttcttacattttggtgtgtaaaacgggtttttttttttaaatactgtgatagcagacagcaatttgttactcctaagattcttactttcaaaataacctagccaccatatatcaatctcaggtttttaccagtctatgtaaaatctaacactccatgagctactgacattcaggatttttactcattcattctcctagaccccaaaagggggtacaacaaacactttatcctcaattcctgatgccccttttgaaacatcaaaccataacaatctttgtttgtcagcacttatggcccatgaaatttactcacaacactctaatcaaaatcacaacctcactggtgtgatctaccactcacatccactttcatgtttcttagaggacttcaaaactggtttgtcatcttaccgtccaccatcatatatatcatcattttctatcttcgttcaggtaggaagccacaaaaaccaatctgcagctaattgaatcagaaatctatgaaaggtacagtgcagactgaagaagatgactgagaggcttcataatgaggaacagcacccaaaatcacgctgcggaacagctctcagagaacagcactgcagtgacagagacggcaccactgcagcaccagcgccggtgcaggactggatgctcatgcacatctcaggcctccagatgcccgcgaccttctccccttcagcctcttccataaccacactactcctttcctccatcggcttctcccctgactgcacagaagcccatttccccaccatgacgaaaaaaaacctttcccagatctaaggcaaagggaaaaacatacaagacagaatgtaaatttgtgctgccaggggctgggaaaggaggggatggggagtgactgatgaatgggtatgggctctccttccggagtgatcaaaaagtgttctggaactagagtggtaaagaaggtacgacctcgtaaatgtactaaatgtcagtaatgataaattgtatgttacatgttaccaccaaaacaacaaaaacatctctggcctccctcagattccacgatattactcagtacttttgttctctctcctctcccctccctccctagcttccttctcttccaagcctgaaatgcaaacattttcctcctcctcactctcatccttctgtctccacattctctcatttggagatatcatctatgatcagtagcaattccactatccaccctaaggaagagagctctacagcaaaccttagaaaactttttcagtgaagggccagagagtaaacatttcaggctttcaaagccacatggtctctgttgcagctatttaactctatgtggaagcagccagaaacaataagtaaacaggtgttctatgctctaacaaacctttatttacaaaaacagggcttgccgtggtggcttacacctgtaatcccagcactttgagaggctgaggtgggcagatcacttgaggtcaggagttctagaccagcctggccaacatggagaaaccccaattctactaaaaatacaaaaattagccaagcatggtggcaggcacctgtagtcccagctactcaggaggctgagggatgagactctcttgatcccggtggggggcgccgaagttgcagtgggcagtgatcgcgccactgcactccagcctggacaacagagggagactccatctcgaaaaacaaaaacaaaaacaggaggcagctggacttggtccaggggatacagtttgtcgatcctgctctaaagtatgatacactgcacatctacattcccattccttcttatatgcagtgtatttcctccaggatttctgaggaagtatgaactccagatgtcattcaataaatatctattgagagcccaccatatttcagacactgcactagggatacagcagtaaaatacagtcttgtcctcatggatttacacaaactgaatgtcattggtatcaaccataaaaataaagacaacaaacaaaacaaaaacccttacttctcctgactttcccaatccaacaatccaatcagtagctaagtccttttattctcctctcaaacagctttcttattccttcctatccatcatacctgaggcttcaccaagaacaagcattccttgtgtacaaaaagcagactctcttaaataaaatatgcagatttctagatatttcaatgataacatcaaaattcatgaaaatcaaaacaagatcctactgggaggccgaggcaggcagatcacctgaggccgggagttcgagaccagcctggtcaacgtggtgaaaccccatctctactaaaaatacaaaaaattagctgggcatggtagcgggtgcctgtaatcccagctactcaggaggctgaagcaggagaatcacttgaacccaggaggcggaggttgcagtgagccaaaatcgcaccactgcactccagcctgggcaataagagcgaaactccgtatcaaaaaaaataaaaaaaataaaatcctagcaaacttacaagatttgaaaagacataaattttctgacctcgagggcaggccctattagcatatggtagacaccagagaaacattctcaaaaatgataggagtaatctctaaatgaaggtatgagagtttacatcaggtacaattttaaagcaaaaaaagagaaagcattgaaattaatgcaagaagtttacggtcactcagtgagtaaattaaaaacaagtgaggacctgtaatcccagcactctgggaggccaaggtgggcggatcacctgaggtctggagttcgagaccagcctgaccaacatggagaaaccccgtctctactaaaaatagaaaattagccgggcgtggtggcacatgcctgtaatcccaggtactctggaggctgaggcaggagaatcgcttgaacctgggaggtggaggttgctgtgaaccaagattatgccattgcactccagcctgggcaacaagagcaaaactccatctcaaaaaaaacaaaaaaacaaaaaaacaagtgatgatacgtgtacacaaaggtgccacagccaacagagttagaatcatccccttaggggtgatggggaagcaggcatattcttcttcagggctggaaaaatgtccttctgagctagacttcttcaggccaactgagactaatctatcagattaaacttactaaacattccaacaaaatcaaacctactatacttcccatgcctatacatacagggaaatataaaatgcctcccccagggacaatgcctaattcattccatactaagcacccaaatccaggtcttatcattttgttcttcaagcaaaaagaaaacaaatgcaaagctggagctccccatagtctgcatggagacataagaggaaaactggggccaggcacagtggctgacacctgcaataccagcacttggagaggttgagatggtagaattgcttgagccaaggagtttgaaaccagcctgagcagcacggcaagaccccatcttaacaaaaaaaaaaaatacaaaaattagccaggcatagtggtgcacatctgtgatcccagcttctcgggaggctgaggccaaaggatcgcttgagcccaggaggttgaggctccagtgatctgtgtttgcactgctgcactccagcctgagcaagaccctttctggaaaataaaaaaaaataaaaaaaataagaaaaaaaaaaaaagaggaaaactggtctgtgttgccaatctggtaagtttcaggaacaaggcaaacaaatggtgttgggagccagttctctatgggtctctccagtttctgcatgtcttatgagcagattgcactgacagcttttattggctactatctttcctgtacaggacatctgtagatagcattttaagatagcaatagtgtttctctctggagcagatggaagatttgtttgctatgcagaataataaaaataatgtctccctcaaagcaaaggctgggcaggattattagttcccttataaaaaattggggtttcccaatctcagattttctcaactgtggtgcatacccactgcatgggcaacatccacctagacccacccagccaccgtgttacccacatggtctttgaggggcaagaaaatactatacaaacagagctgtcacaaacatgaagttcatactgcctgctgacccaggagtgctgtgtcttctgccatcatccgtggaattttaagaagctaacttgttagcctgcaagtaaggtaaaatctcaggcctcccacaattcttgacaaacagggtttctgctgtctttctccttgactgggtttactccaacaagcatatatgccacacttgcattttgtcctgcaggtctcttgcaacaaagcttccattttgaaggattccactgtaaactacaataaacacgtttatcaatattgatcaccaaaaaatactactagtgtctgcatatacttgcaaaattccaattcatcatttttaaagaaccgatgtaaaaatatagttcgaataaagcaatactaaaaatctaacttttgtgaaaagtgatagaaatacagtaccattctaagaaacatagaaaaatcatgttttgattttaaaagatttctaaaagtgccaattagaggctttttcactcagcattaaggaacatatttttgttaaacatgatcaagcaattcatttcacattacaatcaaaccaaatgctcaagcataatatatatataatacaaccaagctttggtggttcattttcccaagtgtaattagtcagtataaagaaatactttctataaatccctagtaaatacctttattttttcactcttaagtttaaaagaacttagtatgaagatctgagaaaggattcccctagaatcacatgtggtaaattgtttaaaaggcacagtatgaacagtctgaaacaaatgaagtaaatacccttcagccaagaacgtcactgcatataaaatcatctaacctcaagtctatgtaactcaattctacataagtaaatgccaaaataatatcctggaaagctgagtcatttcaatgagtaaatttatataaacaattgggttactacttatggtaagtcacaagattttggcaggaaaattgcttactagcttgccaaagactaggtttggcacattggtgccccactgccaagaacattactgataatcagctttctatcctataggattacctttcagacatgttttactcactcatttcctatgtattaagcttatacaggaatggttaatgcaactgagcaccttacttctggaagtgtgagattcccaaaattcctcaagaaaggaagaaaagcatgagaaattgtaaattggaagtttggaagtacctttttttttttttttttttttgagacaaagtctcgctctgtcacccaggctggagtacagtggtatgatctcggctcactgcaagctctgcctcccgggttcaagcgattctcctgcctcagcctcccgagtacttgagattccaggcgcccaccaccatgccaggctaatttttgtatttttagtagagatggggtttctccacgttggccagggtagtcttgaactcctggcctcaggtgatctacccaccttggcctcccaaagtgttgggattacaggcatgagccacctcgccccgcctggaagtatctttaacattaggaaatgcaaataatcaacaaataaataaaggagaaagaaaggagaaaactgaaatatactaagaatagcctggttaacatcaatcatgaaactaaagggaaagtgttaattttcatgccttctaagtaagagctacagaaagttctgggagacagggaagaagactggctaaaggtacagcacagcagcatggccacctttaggacttgcccactctacagcagccacctctgagcacttttaagtcatttttaagacaaagaggccaggtgcagtggctcacacctgtattatcagcacttgggaggccaagaccagaggattgcttgaggccaggagttcaagactagcctggtcagctggtgagatcctgtctctacaaaaaaaaaaaaaaaatagtaaaaaaatcagtcaggcttggtggcagctaccagggaggctgaagcaggaggatcacctgagcccaggagttcaaagctgcagcgagctatgattgcaccactgcacttcaaactccagaggaacaaaataattcactgtcttcccccagaaaactgattttccttcccagtggttgcatttctggccatactattaccatccaacctgtcaccaaaatgcatttgcatccttgatctcattatcctcatacttttactattctcattcatcctacatacccctaactgcattcccaagcacttctccatccttctctcattccttcccactgtgagaacttattcataataaataagaactatcacttcataaacactacatgccaggaacagtgataggccttattataatataatcatcatttgtaatccacacatcaatttgtgatgtgggcataattaactccatttttctacccaagaaaaacccaagaatttaaaactccttcctctatcctaatttccctgatttgaactttacaaacatgtaccaaaatatcacacataccccataaatatgtacaattattatgtaccagttaaaaaaaaaatcgttcctcaccaaaaagtcacttcattcatttgatatgtcctacaaagatggacagctccaagttttcactctatccttacaaattctgacaacatacaactcatatgaatttcttcttagtttacaaacttaatttcaaattcagtaaaattaatagttcattggtttcatttaaaaaaaaaactatcctggccgggcacggtggctcacgcctataatcccagcactttgggaggccaaggtgggcggatgacttgaggccaagagttcaagaccagcctggccaacatggcaaaaccccaactctactaaaaatacaaaaattagttgggcgtggtagcgcacgcctgtaatcccagctactcaggaggctgaggcacaagaatcacttgaacccaggacacggatgttgcagtgagtgagatcataccaccattgcactccagcctaggcaacagagtaagatctgtctcaaaaaaaaaaaaaaaaaatccaattggctttatgtctaaaactgaaattactgcactgcttaaatataaagataattgcataatttctctattgtacacataataagtcagcatgtaatccaaacatcacactactgtagactaggagcagcccttagatccctaagaataaccaggtaaccctttcacttgacaagttaagaaaaacactcaaaaaatgtaaggctatacaattaattggtatcaaaacccaacctctgattcccagtccagagctctttcaattaatcacatgtaacagtctttgattaagcaggacagtactcaagacatctctctcacttccaataatgccagaccttttttttttttttgaaatggagtcttgctctgtcgcccaggctggagtgcagtggcacgatctcggctcactgcaagctctgcctcccgggttcaccccactctcctgcctcagcctcccaagcagctgggactacaggcacctgcccccatgcccagctaatttttttgtatttttagtagagacagggtttcactatgttagccaggatggtatcgatctcctgacctcgtgatccagagatttgggaggcccgcctcagcctcccaaagtgctgggaccacaggtgtgagccaccacgcccagcccaataatgccaaaccttttatcccaggactgcaaatcccagcaaggaagatttagaatggaagtcactgcctacaatcctcttatatgagaagataagaccagctcccagatctgctttgcacagtcttgaaagactcactggacattaaatctgttggcctcccagtactttatagccttgtggttgattccaaatattacagaactttctgcttctagataatagattccccatgcaaagcaaggctaaatagtaatacctcccacattcaacttcctttcctaaaagtcaagaaatcttttattattctgttaacactatggagggaaggtccattccagtaatgaggcaaaggccactactatgtgcagatttatttcctatttgataagaattattcttccaacctggcagaaaagataagtgacttacccaaagccagtgcagttcagaaagagctaagcagtaattcaaacacctgtaatcccagctactcaggcagctaaggcacgagaatcatttgaacctggaaggtagaggttgcagtaaaccgaggtcacgtcactgcactccagcctggacaacagaataagactgtctcaaaaaaaaaaaaaaaaaaagaaaagaaaaagaaaaccacctcatagaagctctctgttgcttcaacaaatatactttgaacaaaatgtaatgcactttgaacggtacctggcacaaactaaatgctcagtacttgttaattattttaatctaccataattataactatcaccatcatcataccactagactatcaatgtcataaggaagatggtaattcagtctgttgcatttgctgttcaaagtgcattacttgtagaattggtagagaaaagggaaacagatcagaaaaatttttcaaatctacaacctggtcatgtgatagtgaaagaaaacagcatttttcagtaaagaaagccaatggtgctggggagcaatcacctgctaaagaggttggcatggataaaagggagccaggtgctaatagtcagaacaatgggaaaagaccctgaaggcatctcagacatctttgaggctgtctctcccatcagaggcccagagacctaggaggacagcatggtttggggagacaggcccggggcacagctggcctggcacacctcaaggagtcctggaacgtcctacatgctgctccgacatcctggctgctgcagtcacagaatgtctacccaatgaccgtacaaccattgtatcttggaaaaaaattattcgtttttggttttacaggctcatagctagaaggaacttgctttgagtctcagactttgaaccgttaagttggtgctggaacaagttaagaattttagggactattggaattgtattttgcatgagaaagatgattgtattttgcatgtgagaaggatgagatctggggggtcagggatggaatgccatggtttggatctttgacccctccaaatctcacactgaaatttaatccccaaggttggaggtgggaactaataggaggtgttttggtcatggaagcagatccctcatgaatgcttggtgccatcctcacagtaatgagtgactcctcactctattagctcccgctagagccggttgttaaaaagagcctggcaccccacaccccaccccacctcttgcttcctctctcaccatgtaatctctgcatacactagctccatgagtggaagcctaaagctttcagcagaagcagatgctggtgccatgcttcttgtacagccttcagaaccatgaaccaaataaacctcttttctttataaattacccagcctcaggtattcctttatagcaacacaaacagatgaagacaactttcatatctttatatctgcagcagcaccaaaacaagccttggacactgcagacatgcagtgaagatgtgttctgctaatggaaaaagtaagtcaacagttttgaaaccccactagatgaaggcatgtgggaggtaacaggctgaaaatgagatttctatcttaaagtagttcataatctcaagacaaaagatatgaaattacttatacaatcaacagggactgcatacatgtaaatacagaggaagttcctggaatggctgcatttatcaggattaggctgagaacactgagactcaccttaaaaggaataagaattgtgaggccattcagccacaaataattactccaaagaggtacaaggcaacagtattcaaaaaacagcaagaacatctccaagagtgcagtaaagaacagcatcattagccaatgggggtgagcttttaagagtggctggcagagggcctggagacagcaatgcaaagccagagcctgagcttctttaaagcctatttaataaggttcccactttggaaaaggagtgtgtcaagaaccgatgggaggggaaggctagaataagaagcctgacaatacgtactagagatacacagcagacaggacaccctggctgtccgcactattctcaagcgggaatttgggacaacccatttaagagcccatcttggcacaaatgccatgatagccccaagtgccagagcagtggcatttgaatctgaaatctcttcttagagtaagactatttatttctctctgtctcataaggctcaccacagtctgtataacaaaatgacttacagcaactgctgagatctgggttcagatctcagttctgacactcattagatgtacgacctcagggaacatatttaaccttacttagccagggataaatggggatacttattatacctgtctcttaggtagggatatacaaaatgcttagcagagtgaatagctcagtaagttctcagccaatattattaagaaaacatacaataaggtatggattttcagaccccttgcattaacaccacagtgctccagagatccttgatactcaagttgggagtcactgtcctggaatacaaataaaaaacataaaagagcagtaaattccatctgcaagtgtttatgtggtagctacagaattcagcactatgctaggggtacagaagccaatgcaacaccaaatgaggagacaatgcagagggcagatgccggagggaagaaagaaacactggggcagagattcaacccaacctgaaagccatgcaggtgttttaagttggaaatgaaatgaggaaccaaaaaattccagtcagggagtggtctgctgagtgtggtgcttcaggtagactcccatgacaggctgcaggacaaactagagtgggggcccacttccataccttcctggccactcagttccagccaaatgactgctcttaaaagtcaaaattaggttccatttctaatctgcactgattcatactgctggtcgtgtaaattggtataggccacaccaacacagcacattagttaagatgttaatcttaactaatttccggacaatactaaaataaaatctctactttccagagattaggtaaacttggtaaacatttgagcttcaggtccagtctgacaaaatggaaaaaagggaatcatctgcagaaaggtcccagcattagaaaacaaagagaagggggaggacagtatgtaggccctgacctgtcttactgcctcaattcaaggattcaatttctcaacctcagatccttgccctcttactagttttcaaactcagatccacctcttactagttttcaaactcttgtctattatgattaccttaagcaaagcaagatgcatgaataaccagcagtaaatcaggtattcaatacttgaaattgtgtaatattctgtgactgtgcatctggccaatttcaacttctccttctttttttttttttttttttttttttttttttttgaggcaggatctcactctcttgccccaggctggagtacagtggtaccatcattgctcactgcagcagcctcagactcccggactcaagtgatcctcctgcctcagcctcctgagtagctagcactacaggtgagcaccaacatgcctgcctcattttttaaatttttttgtagagacaacgtctcaatatgttgcccaggctggtctcaaactcctggcctcacctcgagcaatccttccacctctgcacaccgaagtgctgagatttcaagtatgagccgctgcctcctgcccacttagccctttctaacactagagaactttgagagtggtttcaataccaactggacacttcccagcggtttaacctcaggcaaatcaaactcccatgcctcagtttccacatatatagagataataaaagtacctcctcaaagagtttgttatgagaactaaatgagttaatgttaggcaagcgactggaacatgatagacacaatatgtattagccattatcacctttatctcagtgttatattggccaccacccagagatacccaggagcacacacatcacattctttctacagcaatatgtgggcacgattacttcatgaccactgaatctaaaacagcacagcttggtaagacacagcggtcggatcccacctactgcaacacctctaagaggcgaccctcacaaaccagccatgcttagcctgagacattccgaagacctcctcttgattaccttactcgacgaacttattcctttgaaaatggaactagccgcacttttggaccagtgtgcctcggatacacttccaaatgtgtcaacctgaatctcagaagttggcgtgattttaaaaagttttttaagttctttttcctaaacatgtcctagtaggtgactccacagcattactttctttcatgttctcttttctatctggaaatccggtgataggggacgaaaccagcaaagcaccctttttcttgcttcccaaacgttagcaggtaagcgccccttgagccgagacacatcaagaagacctcacccgcaagttcattgatcaccggttcttttccctttccggcactaggagctgcgaagcacgacatgggcttggaggaagagacgctgcggtcacctgaggggcaggtgagagcgggcggtcctgcccgggtgtgagcgcgacatcccgcgcggcacacacgctcacagcccccagagaaagaccagaggcgctcgatgtatcccgcacaccccacacgcaacacactaactgcaccgtaccttccgtcccacctcccggcagcagaccccttccgggacgccgagagggctgttcctggagagaccgcagcccacgagtagcggcgcgtagggagagcacgcgtgcccaggctgcctcggccggcgcgcccccgcccccgcactcacctggcctgtgataccggtgatgagcgccacgttcctgggcttgcccatctcgccgtccccggagccccgggcgctggggcagcgtgccggtgcgtgtgccatgtcccgcggcgggcgtgcggtcggcggcagggcggagcgcggcagagggcaggcgcggtgccggcaggaacgcgggggtgtgcagcacgaagcgcctctccaggctgcgggcagggagggagagcgcaccgcgcgaccggccgccacagtctgacaggggcgcacgggaggccgtgcagggagggccggg

SEQ ID NO: 1395 - DNA, 967552 bp, Homo sapiens; identical to SEQ ID NO: 982

SEQ ID NO: 1396 - DNA, 139316 bp, Homo sapiens
tgggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 1397 - DNA, 196522 bp, Homo sapiens
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagctatcacgcccagcctcataacaaatttttttttaaaggattgtttacatataattatctctttcctcatctctttcgcttttcaagacaaaattgttaactaggtcctcttctagctatttttccagcagtatttaacataacttgacgacttcctccattaacataatgcatgtaaaatacctgttcttatctatacaaaaatatatatgatatatacaaatatgtgtatgtctaggttaaagaataataaagtaaatacccctttacttgaagaaatataaaattatgccaggcatggtggctcacatctgtaatcccagtacccctgcacttcagccaaaataaatataaaattcctagtagctttgatcccccatgtgttcttctttgatcatattttaccttctcttcctctcacatataacccaaacttaatttttgagttatttgtttcctggacttttataatgctattaccatacatgtaatattcctgaataatatcttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatctctactaaaaaaaaaaaaattacccaattagctgggcgtggtgacgcatgcctgtaatcccagctactcgggaggctaaggcaggagaattgcttgaacccgggaggtggaggttgtggtgagctgagattgtgccattgcactccagcctgggcaacaagagcgaaactctgtctccaaaaaaaaaaaaaaaaaaaaaaagaaagaaagaaaaatcaagtgggaagaggaatagtgagtgctttcaccagaggggatattatgcagtttaaaatgggatgatcagggaaggccttattatgaagggaatattaaagcaaagacctgtgaaagaggaagccttattgatatttgagaatgaacattccagtaataacaaatgtaaaggcaccagagttcaagaaacagcaaggaagccagtggggcagtagtgtcatgagatatcatgaatgaatgtggtatgaaagataagaggggtgatgaggtttggagtggttcacaagttgtaaactgtgtagatcatttttaggactttgtcttttattctgagtgagataaacaatatttggccagtttttagaagaattatatgatctgggttatattttaatctggatcactgtggctgctgtgttgaaagcaaaagtaaggaaaagaaatagataggaatgcaattttcaagcaagagatggtaatgacttggactagggtgatagcaagtggaggtgatgaaaagtgattgtgttttggatgtgttttgaaggtcaaataggcagaatttcctgatagattttattatgagacatgaatgaaaaaaaaaagatgatccaaggatggctcttaaacaactagaagagttgagctgtgacattttgagatgactgggattgggagaagactagatttgagatgaagatgaggaatttagttttggataggtttaagatgcctgctgtatatttaagtagagtaacttagtggagagttggatatatggatctagaattcagattagaagtttgcctaggtgcatatatttgatagtcatgatcatattaagactgaaattagtgtagaatagaaaaaagaggttctagagccaagctctgaggcactgtgatgataagaaattggaaagatgaggaagaaatagcaagggaagctgagaataagtgatcaatattgtaggcagaaaaccaagagactggaaggtaagtaccataaaggttttaaagaggagggaatagattatttgtaagaatggatccttggatttgacaatgtggaaattactggtgattttgagcagagcagtgatatgacactgttagaatctttgctggagttgattaaaagcaaatgggaagactggtagaaatgtaaaatagtgcgtctgctgtggaatatagtttggtggttccacaaaaaattaaacgtagaattaccatataatctagctattttatttctaggtatgtactcaaaagaataaaaaactggtattcaaacaaattggtgaacataaatgttcacagtagcactattcagtgatctcccaaaatggaaacaatccatatgttcatcagtggatgaatgaataaacaaattgtggtatatacatacagtggaataatattcagccataaaaaaatgaaattttggccaggtgtggtggctcatgcgtataatcccagcactttgggaggctgaggtgggtggatcacaaggtcaggagtttgagaccagcctggccaacatgttgaaaccctgtctctactaaaaatacaaaaagctgggtgtggtggtgggtacctgtaatcccagctactcgggaggctgaggcaggagactcgcttgaacctgggaggcggaggttgcagtgagctgagatcacgccattgcactccagcctgggcaacaagagcaagactccgtctcaaaaaaaaaaaaaaaaaaaaggaatgaagttctgatgcatgctaaacatgaatgaacctggaaatctctatgctgaatgaaataagccagacacaaaaggacaaatattttatgattccacttagatgatgttctctagagggacagaactaataggctatatgtatgtatgaaagggagtttattaaggagagttgactcacacgatcacaaggtaaagtcccatgataggccgtctgcaagttgaggagcaagtaagccagtgatggatcagtcggagtcccaaaacctcaaaagcagggaagctgacggtgcagctttcagtgtgggccaaaggcctgagagcccctggcaaaccacaggtgtaagtcccaaagtctaaaagctgaagaacttggagtctgatgttcaagggcaggaagcatccagcacaggcgaaagatgaaggccggaagactcagcaagtctagtccttccacattcttctgcctgctttatcctagctgtgctagcagctgattagatggtgcccacccagattgaggatgggtctgcatctcccagttcactgactcaattgttaaactccttcggcagcaccctcatagacacacccaagaacaatactttgcagccttcagtccaatcaagttgacagtcagtattaaccatcacagatgaggtatttagaatatgcaaaatcacagaaacaggagtagaatagacatgctagaggctgtaggatacaggggagttgagttagtgcttaataggttcagagtttctgcctagtatgatgtaaaagctctgcaaaaatatagtggggataattatgtaatattttgtactaaatgccactgaattgtatattgacaagtggttaaaactataaattatattatgtatattttatgcaaaaggacagataaaaatgcaaatggtagttgagtaattgttgaagagtacagaaaactctttcaagacagttttgttataaagagcacagaaatggggaaatagctggttggggttgtggagctaaagacttttttttttttaaagatgcaggtaattacagcatgtttgtttggtgatatgagtgatctaatagagaggaaaaaatcgatataggcaagagggggagaattggctggagtaatattcttgagtggataagagggcttggcacctcttgtagagatggaaagtctgatgatctctaatgggacaataggtcattaattcatgatagcaggaaagaaagcaatgtgatcttgcacccacataagtggtttggtagaaaaggtgatagcggtttttgaaagttctctttggattatttttttctttaaatagttctcttaactcagagtaagcatggggaaggaggagaagctttgaggaaagggaagaaggtataaaattgtcatcttggggaggatgaggagtaatggcctttgaatatgtatgttcactagggacactaaggacctactacacaaaagtgatcatgaatttgaagatataccagtcattgtggttgtatgtatttttctggtcatattctgctgctttagttagggtgatggtgaaaataatctggaggacaagatcaatgcagaagaggtggtcaaaaaactgagaaatcagacttttggaatgatcatctctctggatattgaaatcaccaaggattatgacagtggtagtgtgggactgaatccaaaattaaatcttcagacaactagtagaatgatgtgggattgatttatgagtctaagaaagagggataatgggtcttacagtctgttccatatattttgctatattttgaacaatgctgatgtaaatgttctggtacagatcttctgacatatatatgtggaagagtttctttgggatatgcttctttttctttaaaaatgttatcgctgggcacagtggctcatgcctataatcccagcactttaggaggccaaagcaggcggatcacttgagcccaggaattccagaccagccatgcaaatatggtgaaactctgtctctacagaaaaatacaaaaattagctaagcaggatggcgtgtgcctgtagtaccagatacttagcaggttgaggtgggaggattgcttgagctggaggggtggaggttgaattgagctgagatcatgccactgccactgcagcctgggtgacagagcgagaccttgtctcaaaaaaaagaaaaaaaaaaaagaaagaaaagaaaattatatctgggttaccagggacttttttgtagtcgtttttggtgcttctcctcttctgtatgacctttaaatgttggcatatagggcttggtctttgaccctctcttcttttctatctacaaactcccaaggtgatataactccatcatgatatagatgctgatagactaccaaatttgtgtctccacttttcacttttccctgagctctagaattcaactgccaattttatatttccactttcatatctgattgatacttaacacatacaaacagaactcttgatttttctttgcagttgtgcacccccacccccactattttacctttcattaaattgcaacattatctactaatttgctcaggcttaacatttatcagtatcttttcttctcccaccacatctaatcagtcagcatgttctgtcagctgtacctctaggatgcagtcatttctcatcagctttattgcaacttatagaccagtagttttcaaactttttgatctcaaggctccaggaaacctttgcattcttaaaaattattgagaactctgaggagttttgtttattcagattacatctactcatatttattgtattagaagttaaaacaaatcttaagaatatgtatatattaatttattttaaaatgaatttattatatgttgatgtgaatatcattttataataaaagtaaaattactgtattttaaaaggtaagaagggacatgcattggttttatttttgtaagtatcttgaatgtctggcttagtagaagatagctgaatttttgtgtctgcttcagtattcagtctgttaggacatgttttaattaatgtatatgaagaacatctagcctcacatagatatttatttggaaaggaaggggtattttaatagccttttgaaaaattatggatattccttttgatattacactaaagctcattaagtggtaattttaaaaggtttgttgggctgggcatgatggctcacacctgtaatcccagcactttgggaggctgaggtgggcggatcatgaggtcaggagttcgagaccagcctggccaacatggaaaccccgtctttactaaaaatagagaaattagcctggtgtggtggcaggcgcctgtaatcccagctacttgggaggctgaagcaggagaattgcttgaacctgggaggtggaggttgcagtgagccaatatcgtgccattgcactccagcctgggtgacagagcaagatactgtcccaaaaaaaaaaaaaaaaaaaaaaaaaaaaaaaaaaaaaaaaatttgttgtttcttcagcacttagaaattgcctggtatgttttctacaaatatttattttttgaataagtatgtgcatccatccattatccatacatctgcccaccttttcatctgcttttcagtttacaaaaatttatggactcatttttcaggttttgtttcctctccaatttcattttttgtgggtttattatttcatgtctgcatttttgtaaaggagataaacccatgtgaaatgagctaaacttttgaaatagtggtataggtattattccaggcaacttgttacattgtggggttgcagcagtggaaaaaaaaaaagtttctgttcccatggttttaaatttagcatagattttctttgtattagtactaaagctacacaatttataactacaacagatggcaagttataaaatactttaagatagctggactcagtggctcacgcctgtaatcccagcactttgggaggctgaggcgggcggatcatgaggtcaggagttcaagaccagcctggccaatatggtgaaaccctgtctttactaaaaaaaaaaatttacaaataaatattaaagacttttctacttaagataattcaatgttttctaatatgacaaaagttgaaaaatatagagaataaatttcaactaaagtttgtgtcatagcttgattgatttaattttttaaagtttgggcaaaaattataatgcatatattagctgtactattttaacatcattattctcagttctactgaaaaaaattatttttgtgattgaaattcactgatttagcattgattaaagggataaggattcatcttcaaaattaaaatataataaaataagatattaaaaaatataataaaaaggcaactgttgataaatattgttggatatgttgtcagtttttttaatatcaaaagtcctgacatatagcctgggcaacatagtgagaccctgtctgtacaaaaaataaataaataaattagcagggcatggtggcgcttgcctgtaatcctagcaatttaggaggctgaagtgggagtattgcttgagtcctggagtttgagctgcaatgagccatgttttcaccactgtactctagcctgggtgaccaagcaagactgtgtctccttaaaaaaaaaaaaaaaaaaaaagtctgacattttgtaaaaagaaaaaaaagatatattgtcagttttagattggaataaagcacttatttttgtggaagattgtgagggaagtcaaggattacaagttaagtaccgtcctttctggtgattttttcctgtttagttttaaatttgaaattattctgatatatttctgttaacttgattgttgagaggaattatattcaacggaatcagtcaaaataggcatttatccaacctgggcaacatggtgagaccccatctttataaaaaaaaatagccaggtgtggtagtgtgcacctgtagtcctaactactccggaagctgaagtgggaggattgcttgagccctggaggttttaggctgcagtgacccatgatcgtgctactgcactgcagcctgggtgacagaggaagaccctgtgtcaaaaacacaaacaaaggcaaacaacaacaaaacaaaatagtcatttgtgtataaaatttttatagacttcttgggcagtatttgtcaatagttaatatatctttttataattttagaacatttatgtttcttaaagtttgctcttagggaaataccttgatattaaggaggaaagcattagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtcaaaactaagaaggcttcattgatgcattactgttacattttgaacattaattgaatttcatgatatgttttttctgtaccgtgattcaaaccaggataccatgttgcatttagaatagtacttttgtaaaataatttatgtaatttttgaaacatataaataatatgttataagcatctggggagttaagaattttttgttttgttaatatctagattagtacaggtgtacctcagagatattgtggacttggttccataccaccacaataaagcgaatatagcaataaagcgagtcacagaaattttttgttttgcctaatgcataaaaaattatgtttgcacaatattgtagtttgttaagtgtccaacagtatgtctaaaaccactatatataccttaattaaaaatactttattgttaaaaaatgctaacaatcatctacactttcagcaagtcataactttttgctggtggagggtcttgactcagtattgatgattgctgtctgatcagggtggtggttgctaaaggttggagtggcagaggcaatttctcaaaataagacagcaatgaagtgtgccacgttaattgactcttcctttcatggaagatttctctgtagcatgggatgctgtttgactgaattttactcagagtaggactattttttttgagacagagcctctctctgtcacccaggctggagtgtagtggtatgattttggctcactgcaacctccgcctcccaggttcaagcaattcttgcacctctgcctcctgagtagctgggactgcaggcatgcaccaccacgcttggctaatttttgtatttttggtagagatggggtttcaccactttggccaggctggtctcaaactcctggcctcaagtgatccacctgacttggcctcccaaagtgctggcattacaggcgtgagccactgtgtccggcttcagagtagaacctctgtcgaaattgaagtcagtccttttcaaacactactgctgctttatcgactaaatatacagaacattctaaattcatcgtcatttcaacaatgttcccagcatcttcaccaggagtagattccatcttcagaaatcactttctttctttatccataagaagccagtcctcttcaggttccacttctaaatctaattctttagtagttacttcctccacctaagtcttgaatacctcaaagtcatccaggagggttaaaatcaacttctttcaagctcttgttaatgtggatagtttgacctctttctatgaatcacaaatgttcttaatggaatctggaatagtaaaccctttcaggaaagtttttgatttactttgcctagatccatcagaggaatcactatctatggtggctatagccttacgaaatgtattccttaaataataagacttgaacatcaacattactcctaatccatgggctgcagaatggatgtcattttagcaggcatgaaaaacaatattcatctccttgtatgtctccatcagaggtgtagggtgaccagatgcattgtcagtgagcagtaatattttaagaggagtccttttttttgagaagtaggtttccataggcttaaagtatttagtaaaccatgccataaacagatgtactgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtgctattgggaaaatggtgctgatagacttgattcatgtggggttgctacagacttccaatttgtaaaaagtgcaatatctgcgaagtgaaataaagcagagtgcaatacaatgaggttcgcccctacttcttatctagctggctttcaataagtatttgttgcatgattgaatgagtctatgagatttagtaggaaacatcttttgaaaagaaatatgcttgattctatttccttcataggaactagaaagagcctgttttatctttttgcatttcatcaccactttcttttttatttcaaatagtgagaagtcttggaaatgactgaaactacacgttgttgaatgttttgttgaatataaaatgaactgaggttatactatatgtaaatttttggcagaatacataaatgattttgtgagtatgggactgttattgcacacagctttcactttttaaaacaatattaagaaggagtttaaaaagtatttaaattctctatatacgttgagactagcatattcaacctttataccatggataatctgttacagctgtttttgttgcacctgctttcctgcttaatatttaaatttcctgaatcttaaaattggccttgttttaatcaattaatcatcataatgacaatttattgctctttaatactaaatttgatttacttaatattcttatatttcttagctcacagaaatgcaagttgagagtagttattacagtccacagaaagtaaaatctaaagaagtattgtgttgggaacaagaaggaactacagttgaggtaatctttcaatattgaacctgtatttttaaatattttgttctttaatattttataaatacctgtttttatcagatgtagtgtatttaaaaatacaagtaagatgtttgtttcttattttaatagagtttactatctcatggatagtataaataaatagtatagaataaatttaaaaatgacataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttatttatgccctgcttcaaaaataatcgtggaggaaacatgttgaattacctctgttaatttttgttacttttaatgtgtgggattgatgtaaagaaatgaggaatttacctttttactatctatacttcttagtgttttttaaatgtaagaatatattaatatgtttatggaatattaatacatttatgaaatcagttaaaaattcagataattacctgaagattaatgcaataggataatttacattttactctttttttatcaagatttacttccattgttaaaatatttaatgttgacttgcataattaacatacatttagaatatttcagtatatctttagtgtttgaattgtttcatgatatgaagtatttaaggattaattctatttgagagtatacattattagacagttttgtgatagtgataaaggtcaggagtgtactatctcctccattgtaggtatttattaactagacatgattaataaagtggtcaaaatgtctcataaaagtatggatgtcttttttgtgtggtctgtaatagatggaatattacctttcttagaagtaaattcttggaataacctctgttcttttggtcatcctttgtgttgttatacattctatataaagatatgtgtctaacctatcaagctttaaactcaaaagtttcttttatacaatgtttattctgtttgcattgctttgttggcaggagacatacactgagatagctggaatgcaacggtttggggctttttatatggattacctgtatacaatggagaacactagtggcaaaggtattggcttctttcctttatgtgtgccatttcttgaacaactgaaacaaagccttcctcagaatcaattggtccttgactggttgtactctgctacataagatttatcttctagtactttggggagtggtttaattttaacatcatgttagaattgtcttagattcttgtcatttcaaatccattctttatacagctgactgaagacattttgtataacctgttagaattagttctcatgtgtaccatatattatgattctgatatatcaaattttatattacattaaatttttaaaaagaataaaccttttctattctaaatacactttgaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattctaatatatatatattttttgagacagagttttgctctgttgctcagagtgcagcgtcatgatctcggctcactgcaacttctgcctccctggttcaagcgattctcatgcctcagcctcctaagtggctgggactacaggcatgcgctgccatgcctggctaatttttgtatttttagtagagatggggtttggccatgttggccaggctggacttgaactcctaatctcaagtgatccatccaccttggcttcccaaagtgctgggattataggcgtgagccaccgcactcagccaggttctaaagctttcttactggtcttcctgctttcattgtagtcctatagtttctactgcaatcacagggatttaattctctgctgttaattttcatgggcctgacattggtttgtttaaaaacaaaatttaaatagtttactagattctggtcttgagttacttggtggatagtgataactattaagaaagctaaataagaggaaaatttttggaggaaaagatgagttttgagataactgtggacattgaagtgtaaatattccttagccagttatatatatgaaagtgcaactcagaagtcttgtgttctaatagcattgcaaattattgtagtgttgtagttgccacttgtaaactggtaggtttcctcttgttcaatataatgtcttatgcatgtgctgtggattccatgtcttgtgaggaggtgaagtatgtagtagttaccttttaagcaaaggaaacctagcacagaacatctttatttgtatatatgcctctcctgcagtttttaaaagatagaaacatgatttatgtttgttagattgtttatatattacttctgagaagccagtagtttgttaacttttgggtttttcatatttttcacttccatgaatactatacagtgttacagatattatagtccttaacttttaaaacaaaatattgaatattgcacatgtacagaacagcaaataatttaaaactgaacacctgtgtattctccacgcacaccaagaaataggacattgttagcatccagtaagcctcctatgtgtttcttttctaccacactctgcctcctttactggaggagattgctgttttgagattcatgagaaccactgtcttgcttttggtttatccccattttacagatgaggaaacagcaaacccaatacaggtaaagtaacaagaaccaagatcacacacagtatgtgggatttgaacccaacctatccagctctagagcctacatttataactattctgttgatatttcctttttttttttttttttgtttgagaccgagtcttcctctgtcgcccaggctggagtacagtgttgcaatctcgactcactgcaagctccgcctcccgggttcatgccattctcctgcctcagcctccccagtagctgggactacaggcgcccgccaccacgcctggctaactttttgtatttttaatagagacagggtttcaccatgttagccaggatggtctcgatctcctgacctcgtgatccacccgcttcagcctcccaaagtgctgggattacaggtgtgagccactgcgcccggccctctgttgatatttctttctttcttggtttacctgaaacaagaaatttgtagaattttaagtattaatgagctaggaaaagtaatgagttcctataagaggatacttgtaaatacttaaaaaaaaaaagctttatctaaaactcttgtttttttgtgacaactttttttttgtttctatagtctacattatcaaaaagtgccctaaattttattaagtaaatatctaaacacgtattgagccaatatttttacagagtttgtagtgaatcctgatagtttgaaggcggatttgattttgtgtgttttaagtaagttcatggcagtattctaattaatgtaagaaactaggctgagcgtggtggctcatgcctgtaatcccagcactttggaaggctgaggtgggcagaccatgaggtcaggagttcgagaccagcctggccaacatggtgaaaccccttctctactaaaaatacaaaaattagccgggggtggtggcaggcgcctgtaatcccagctacttgggaggctgaggcaggagaatcacttgaaaccggaaggtggaggttgcagtgagctgagatcataccactgcactccagcagcctgggcaataagagtgaagctctgtctcaaaaaaaaaaaaaaaaaaaaaaggaagtaaatacagtaataaaggaagcttctattatttatttttcttgtaataaatgataaaatagtatcttgtccacattatactatggcatataaataaaaattaagtttcctctgctactatttggtattgatgataagctgctgcttctcttcttctcctccttctcctcctttcttcttgctgctgctgctgcttcctccctctcctccccttctcttctcctcctctccttcctcctcctccccctccttgccttcctccccctcctccccgtccttctccccttcctcaccctcctcctcctcctccttctccttctttgtgagtatactttagtcatttttgtttacaactgaaactctggaaaaattaacatcttttgcccaggagcttcttacagacaccagtaaaagtttgaaccttgtgttccacaagataagcatcttctgacaattattttacttttttttatggtacttgaaagcaagtgatgttttaaaaactaaatggaaatatttattattaatataattgtgtaaatatttgttaatgttgtaatgactacctttctagtcttttctgtttaagggggttattacaaatgttatggaccctaaagtagatagctgaaattgtaatgtacaacaggaagattttagagataaccaattttagagatacaataggagataaatctgaaacaattaagttattgaattgaagggcaagaattgagaaagagtcttgactcttaataagggcagccaaacattcagggagctggagtggccagatgcatgaaaggtgggcacaagtaaatagctgaaaatatatagctaaaagccagttgtgtttttacatttcagacaagccatggtatctaaatttaaactgcattatattcagttttcattatggggggcattggcctgtattattttagagacaattttgtgtctaaaagaagagtcttgttatacagtgacatcatttagggagtctattatcccctaaaggacgcatagcagggcatttttattgctttttgagtattttgatttgtaaccgaagttctatctttaagttacctcattctgtcttacatgtaattctagaaatgtaatggttttagctatgaaaagtaatggttttgatgtgaatggtatgttatttatacctaattcctaatgtgagtcagtattaatcatacatcttacaaaatatgtataagattaattttgtatgttttatttgatgtgacattgggcttatagatttttacttgtattatatagttaactttaaaataatctttgcactaagtcgtctggttaaaaatatgtgagtaataaatctaattaatttttggccaggcgtggtggctcactcctgtaatctcagcactttgggaggccgaggtgggcggatcatgagggcaggagattgagaccatcctggctaacatggtgaaaccctgtctctactaaaaaaaaaaaaaaaaaacaaaattagccgggcgtggtggtgggcgcctgtagtaccagctactcgggaggctgaggcaggagaatggcatgaacccaggaggcggagctttcagtgagccgagatcacgccactgcacttgagcctgggtgactgagactctgtctcaaaaataaataaataaaaatcaatcaatcaattaatctaattcatttttgttcatatgatgaagactaaagattgagctgtactcctttgcatgaaataatggaaatatatttttgtataaaagtattagaaggtatagatataaaagttttgtgtaagtaggcttttctagtttctaaggttattaaatcctggaaaattctttcttctttttgtctgaataaacaaaatgcattataaattaaaaatcatttttatcacaataatggattcatgtatacaaaaaacctctcatttaagagatgtacatattagataatgacacatgcctatacctggggccaatatcttatttagaaaacagtgtatgaggagatgaggagtctaggaagtaggattctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactctagagtagagcataatagtgtaatgaggaagtataagataatgaagaactcaccctgtggagtcagactgtggtttaaaatttgaccctcacttcttagtatccttaagaaatttaattaacatctttgatgtttcatttctctgtctctacaatacgtttagttactgtgacagagatggctaattgtctcctcaatatccatcctttttcatagtaatagaaatttctataacagaagtaaagactatacatttaagggatagtcatatgactaggttctgtctactgggatgggagcagaactttatgtgatgttttgggccatgactttaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatggtcactcatacctgtaatcccagtagttagggaggccaaggcaggaggattgcttgagcccaggagtttgagaccaacttgggcaacatggcaagacccagtctctacaaaagattaaaaaaaaaaaaattagttgggtgtggtggtacatggctgtggtctccgggctgagcagggagaattgcttgagcctgaatggttgaggttgcagtgagctgtgattgtgccactgtgctccagcctggccaacacaacaagaccctgtttcaaaaaaaaaaaaaaaaaagctgctgtttttgttgaaatttctattactttacttttgtcccagcaactttactgttaccttaaatgatacactgataggacctacttccaatgattgttctgagcactaaatgagatagtgcacataaaagcacttaacccagtgtacagtaagtgcttgacacattcatgcattcatttattataccttacttgaatgcctaccctgtgccagacattctttatgtgctaggatagtatagcaaacaagacatacaaagcctttggtctcatggagcttatatcctcatggggtagacaaatagtaaacaagttaaaatatttcagtcattgataaatactagagaagaaaaataaaaggaagtgtgagcaagagtgccagaaacagaaggaggggagagctgttttagtagggactttaggaaagttttctctgaagtttatatgtgagctaacttgtgaatgatgtaacggagtgaatcatgcatgtatttgtgaaaagagggttttatgtagacaagtgcaagagccttgaggtaggaacagtttggcaatatacagggatacaaacaggctagaatagctgaagcacaataaatgtttgtaagtcatagaggtagacatcaatcaccttgttgggttttagggaccatgtagtctggattttattctaaatgtgatgggaaatcatcagtaagttttgaataggaagttattaacttattattttaatagtaaatagtatggttggcatatgttttcattttaaaaaatttagattttcctagttttacttgcactcatttgtgtgcatgtgtattaagttctatacaatttcatcacctttgtaggtttgtgtgttcactaccatggtcaagaaaatgaacagttccaataccacaaggatctggcatgttgctctcttacaaccacacccacttccctaccatgttcctttctcctccctcttttccaggggctagggataacccctggaaacttttgtcttccatttctaaaattttgtcatttcaacagtgttaaataagtgaaatcatacagtatgtaagcttttgaggttgacttattttgctgagcataattctctggagactcattcaagttgttgcatgtatcagtagtttgtttcttttcctgctgagtagtattccattgtatacatatactatagtttgttaattccctcacttatggaagaatatttgggattattctagttttgggctattacaaataatgctgctctgaacagttgtgtactggtttttgtgtaaacatttcttcaggataaattgctgggtcatatggtagttgcatgtttattattttttttaaagaaactaccaagctgttttcaggagtggccataccattttacattaccatccaacgatgactgtgtgatccagcttctttacatcttcccagcattttgttttgtcactgctttttattttagccattctgatagatgtgtagttttaatgagcaatctgccatctcattgtggttttaaagttgtgtttccttattggctaatgatgttgaacatctttttatgtgcttatttgccatttttatttcttcagtgaactgcatatgtcttttgctcagattaattgggttaatctgaaagttttaatgtttttcattttatactcaagtatgtcatcattttgaattaattttttacataaggagtgaggtttagataggggtttatttatgtgtctttgaattttcaattgcactagcaccatcctttctttattgaactggttttttacctttgtaaaaaatcaattgagcatatttgtgtgggtctgtttctgagtcctctagtttgttttcagttagtagacctgtggtatttcccactgtcagtaccatgctgacttaattactgtaactctatggtaaacctttatattggagggagaagttattcattttggttttgagggaacatttgcttaggttagaaataacctcattataactttcatttacatatatctctaatggaatattgggttggctgtttcgttttgtttttgtttggagatggggtctcactttgtcacctaggctgaaatacagtggtgtgatcatggttcactgtagccttgatatcctaaaatcaagtgagtctcctgcctgagcctcctgagttgccaggaccataggtgtgcaccaccaagcccagctaatctttgttttttttgtagagatgaagtcttactatgttgcccaggcttatcttgaactcctgggctcaaacaatcctgccttggcctcccaaagtcctgggattataggcatgaaccactgtgctggcacttgactcttttaatatagatctattggtgttatttatttttctcatggaaaagtccaagttggtcagtattccagggaaactgttttatgaggttgtcttagacccagattccttctattttattgttctgccaaccccagagatatgccatatatacatggtcagaattgggtcaccattatagtgtgtaattttaatcaggaggaagggggaacaagactataaaggaaggtatgtagtcttatttatttatttatttaagatgtagtctcgctttgttgcccaggctggagtacagtggcgtgatctcggctcactgcaacctctgtctcccgggttcaagagattctcctgcttcagcctcccgagtagctgggattacaggcacctgccaccatgcccagctaatttttgcatttttagtacagatggggttttaccatgttggccaggctggtttcgaactcctgacctcagatgatctacctgcctcagcctcccaaagtgctgggattacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctctcaagatgggaaggtgaatgagaaatgctcttttagcagctcctcacaagaccacatatgatcctttgtttttagaggatcacaggatattctaccaaggtctgctgtggttgagtattgccttcatggcatggatttgtgtaacattatcaggatgctggtacagactagacccaccatagtacttagctcctaggattattttaaattttcattgaaataatgcatgtaaactattttgcatgtattaggaactgagtgatgtctgctgtaattgttgagaatgcttaatatttgtttatggtccatatacaatgtattgctttctgagtttgacttatacatacaaggccttatttgttcgtttgtttgctttttgagacagagtctcgctctgttgcctaggctagagagcagtggtgaaatctcagttcactgcaacctatgcctcctgggttcatgcaactttcctgtctcaggcttctgagtagctgggactatgggcgcatgccaccacgcccgactaatttttgtatttttagtagagacaggatttcaccatattggtcaggcaggtcttgaactcctgacctcaggtgatccacctgcctcagccttccaaagtgctgggattacaggtgtgagccaccacacctggcctatgtgtttttttttttttttgatatatttcttttgatgttcatataatgatcaggggtccccaactcctgggatgcggaccagtactggtcagttgccttttaggaactgggttgcagagaaagaggtgaatggcaggtgagtgagcgttaccacctgagctccgcctcctgtgagatcagcgatggcattagattctcataggagcacaaactctattgtgaactgtgcatgcaagggatctaggttggcactccttatgagaatctaatacctaatgacctgaagtggaacaatttcattctgaaaccataccccttctcctgtctgtggaaagattgtcttcaatgaaattaatctccgatgccagaaaggttggtgtccgctgacagtgataatcatagaaataaaaagtgtcctaactttaaagaagttatgtaagggaattaactatatgcattaactttatttttgctccctactggccactcatcattaagtatggtagtgtattacgattaagagatcatgtagagaaaatttcactggagacaattaaaatatgtctgcattttgtcatctctgtttttgctatcatctaatttttaaaatagatactattttttagagcagttttagattcacaaagcagagtgaaaggtacagagatttttcataaactgactccccccacgtacatagcttccctctttgtcaacatccctcaacagagtagtatgtttgttacaattgatgaacctgtattgacacatcagtatcacccaaagtccacagtttacattagggttcactcttggtgttttatgttctatgagtgttgaaaaatatataattatctgctataacaatatcacatagagtagtttcaattcccaaaaaatcctttgtgctctgcctattcatcccttcctctccctaaccactggcaaccactgatctttttactgtcctcacagttttgccttttctagactgtcatatagttggaatcatatagtatgtagccttttcacattggcttcttttacttagtgatatggatttaagtttcctctttggcttttcatggcttgatagctgatttcttctttgcacttactaatattccattacagatgtaccacaatttacttatccattcacctactgaaggacatcttggttgctttcaagttttgagagttgtgagtaaaacaggcatatacatccacgtgcacgttttggtgtgggcatgttttcaactcctttgggtaaataccaaggagtgtgattgatggattgtatgctaaaagtatgtttagttttgtaagaagctgccaaattgtcttccaaagtggctgtatgattttgcatccctgccagcagtgaataagagttcctgtttctccacatccctaccaacatttgatgttgtcagtgcttcggttctttgccattctaagacatgtgtaatggtgtcttattgttttgattttttatttccttgatgacatatggaaacatcatttcatatgcttatttgccatctgtatatcttctttggtgaggtatctcttcagatctattgcccattttttaagagttgtttgttttcttaatattgaattttaaggattccttgtatattttgggtaacagtcctttatcagataggtcttttgcaaatattttcccccaatctgtggcttgtcttttaattttcctgtattttgcagagcagaaattttgaatttttagtgaagtcctgcttatcaattctttgttttatagattgtgccttttgtgttatatctgaaggtcatcattatacccaaggtcatcagcttgtatcctttacgaattggtccatttcatctaggttatcaaatttgtaggtatagagttgtttatagtacttctttgttttttttttgagatggagtttcacttttgttgcccaggctggagtgcaatggcatgatcttggctcacagcaacctccacctcccgggttcaagcgattctccttcctcagcctcctgagtatctgggattacaagcatgtgccaccatgcctggctaattttgtatttttagtagagaaggggtttctccatgtcagtcaggctggtcttggacttctgacctcaggtgatctgcccaccttggcctcccgaagtactgggtttataggcgtgagctaccaccgcacctggccttttttagtattttaaaaattatcattttagtgtccttgggatttgtaacaatgttcctctttcatttctgacattaggaatttgtattctcttacactttttcttagcctggctagagaggcttactgatttttattgagctagcttttggttttgtttattttctctattgattttctgttttcaatttcattgatttctgttttgattttaattcttttcttcttattttggatttatttaatttcctgaagtgtaagcttaggtgattgattttagattttccttttttgtaatatatgaactcaatactataaacttacctctaagcattgctttcactgcatgctacaaatttcgataagttggatttttgttttcatttaattcaaagtattttgtatttctcttgagatttatttctttgacttgtgttctttagaagtattttatttaatgtccaagtattttgacattttttagttatgttactgatttttagtttaattccattatggtctcatagcagacattgtatgatttcttttaaatttgtttaggtgtgttttgtggcttagaatgtgtctgtgttggtgaatgttctatgtaagctttagaagaatgtgtactctgttgttgctgtatgaagcagtccattgatgtctattatatctggttgattataagttcaattatgtccttattgattttctgtctgctggaactgattatatctgatagagggatattgaagtctccaaccaaaacagtgggtttgttggattttttccttgaaattttatcacattttgctttatttttttggcactgtgtctttaggcacatccatgttagggactgttatgtctttttacggaattgacacctttatcattatgtaatcccttctttatatctgatagctttccctggtctgatttttcttctgtctgaaattaatatagccactcctactttcttttgattagttttagtaaggtatgtatttctctattttcttttaatctacaagtgtctacatatttaaagtgagttttggctgggtgtggtggctcatgcttgtaatcccagtgctttgggaggtagaagtggactgatcacttgagcccaggagtttgagaccagcttgggtaaaaccctgtctctacaaaaaaatacaaaagttagccaggcatgctggtgtgtgcctgtagttccagctacttgggaggctgaggtgagcggatcacctgagccctggaggttgaggctgcagtgagcaatgatcacaccacttgcactccagcctgggtgacagagtgagaccttgtctcaaataaatacataagaaaaatttttttaaaaagtaggtttttttgtagacaatatatagttgggtcttgtatcttcagctgccttgacaatctgtcttttaattgatgcatttagaccattgatatgaagttattattgatataattggactaacatcaaccatacttcttgctattttctattttttgcccttgttatttgttcctgattttttttcccgctcttttttggccttttgtggttttagttgagcattttatattattcgattttctctcctctattaacctacctgttatacttctttttagtgtttgtcctagaatttgcattatatttttacaactaattcaagtccactttcaaataacaccataccactttacaggtagtcagagtttcttataataaaagaaatactaattctgccatcctgcttcttgtatcattgctgtaattcattttatttttatataagcattcataagcctgccacacacaatcatacgtaattacttattactattattattttgacaaaatttatgtattagatcaattaagaataacaaaaattaaaagtctttttttaccttatgccttttctgatgctgtttttttttatgtagatgtgaaattctgacctttatcatttttcttctctctgaagaatttaacacatctagtaaggcagatatactggaaacaaattctctgaatttttttttttgtctgagaaagtctttttttctccttttgaaggataatttcgtggggtatggaattctaggtttgtgggttttttcctcttaaaatactttgttttactctcttcttgcttacattgtttttgagtggaggtcaggtataattcatatcattgctcctctataagtaacatgtatttttttctgtggatttttttgggcgactttatctttgatttctatgatttgaaaatgatgtgtctgtatgtaggttttttttgtttttttttttggcatttatcctgcttggtgttctctgagtttcctgggtttctaatttggtgtctgacattaatttgaggaaactcacagtcattattgtttcagatgtttcttctgtttctttctgtcttttcttctcttgtggaattcgtattacatgtatgttacatcttttatagttgttccacagttctgaaatattccgggtttttttttggtttgcttttcagttttggcagtttctactgagataacttcaagcttagagattcttttgttagccatgtctggtcttccagtatgcctgtcaaagggaaaaatgctaacaaggaggtcttactcagaaggcagcccaaaaatttgtataaaatttcctttagattgttggctaattcctaagctgcccatgtgtaatgcaagacttcaggaaacccagcagaaagcaaagtataaatttgactatttgcatggtgctgtgtatctacaattagagttcaggccctgccacattagcacctggggccttcctttgagaccttataagggccacaccctaggaataagtacagattgaaatagattagtctgagcaatcctaattccagtcctggataggaccatgatgatgtacttgtattctgtctgcttgccaaagaatggttaacttactttaggggaagatagcattatcaaagcctctataattttttacccatgatgtcatctgcttgatacaaaattatgaggtatactaaaaatagaagcaattgaattaaatataataaaaaatcaataatataaatagacttagagatgattaaggtattagagttgttagacatggagtttatgattaattgcttaaggaaaaagacaaaaaggtggaagatttccaaagagacctcaatccattaaaaaaaagcaccaaattaaattgtgaaactggaaaatgtaaggatacaggtttgaaggaaaaggatggaaaaaatataccatttgaacactaaccaaaagaaagatagcatggctattttactaagagataaagtagattttaagctaagaaatattactgaaataaagaaagccacttcataatgataaaagtgtgaactgaaagaaagaacaacacagataattctcacaggtgtaatattgagtaaaaaattatatactatatgatttcatttatatgaagttccagaagagagaaaactaatctatggcaattgaagtgattggctacgtctgttgaggatttagtattgccttgaaagggacatgggacagtctcatagggtgcttcagatgggtggtggttacagatgtaaaaattcattcagctctacccttcagatttgtgtgctttattctgtgttattttttagtaatcccaaagaaagtcacttaaaaaagcaacataattcctaaataaatggtggttttaaaattattagtaatgagtaaaaaatcagcattgtattttcgacttagttttaagcacagtgattctcagtaatggcacttttggttttttggattggagaattattatgtagcatttaccatctttggccaatacccgctaaaggccaatattattgtgacaatgaaagacagacaaagcaatgaaactgctcttcttgcattttgtcatattcttctggatgggaagtcatggcattcctcattgagaaccacaggtagagcattttaagggagtgagtgagtgagttctaggacagggatcatttgccactcagggtacatacgctggacatcttgaaacttacctgtatttatttgaaagctcagaaagattctgtaaaactgagaatactgtgccgtcctcaagattcttaggactttatgagcccttaacatgtgtattgttagtagatacgatacagataaggaatttttcttacctgcaaacattgcttattgtgaatgtttttgacattgtgtggtgtagtccatttagttctttagtcagctaaatgtgaataaaagagattaaaataaaagatgctgactcttggatatctaggaaacattttggaataattaagcttaataaaatatcttcatcatactgaggcatgtcgtgatactattccagttgattgaaaaagaaaaaaagcttgagctgaaagggcaatgataattttgcaaaaaatatgcattctttgaagtctgggacatatttaaaatacatggaaagacatttgttatttggttatggcaagagagttctgtagaaaggcatcatttctagattgatttgatatcactgcaaatgtgcagatctgaagcttgcatagagggaactgcaactcagtcactgctccacttttaaaatataaagcgaacactattattttctagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaaggtatgaaaagtgaattttcttgtttgttagcatgggtttggctttgggatcatcagataagtttcttttttcttgatgttgtaatttcagagaaatagtactctaaaaggtaagatttaaataagaaataagatgtatttattccaataaattaaagtaagtaataaaaatatacttattttaaagatttttcaattatgtgagattagtagcttgatatttataaatgaatggttaatcataacttttgaataattttatttatcattgatggtaatttttataagcaatgtgaaagagcacttagtttaatatggatgctttgaagactcatgtttttttgaagggagcatttgtgtgaggcataatgaggcataaagagggcctaaaacttttttatgtcacctttatttaattcatgtcaatttattgatgcaagggaaatttattttaaatacaggcatatgccattttatcatgcattactttattgtacttcatagtaattgtgtgtgtgtatgtgtgtgtgtgttttttttttttaacaaattgaaggtttgtggcaatcttgcattaagcaaggctttggtgccattttttcaatagtatttgctcacttcgtgtctctgtgtcatattttggtaattatccaaatatttcacaagttttcattattattttagcattgtgatctgtcatcactgttctttgatgttgctattgtaactgtttttcgggcaccaagaagtgcacctatttaagatggtgaacttggtaaatgttgtgtgtgttctgggtcctccactgaccagttcccccttctctctcccttatcctaatccttgagacacaacaatattgaagttaggccaattaatagccctacaatggcctgtaaatcttcaagtgaaaggaagagtcccataactctactttaaatcaaaagctagaagtaattaaccttaatgaagaaggcatgtcaaaagccaagatgaggccagaaagctaggcctcttttgcaaaacagccaagttgtgaattcaaaggaaaagtctccaggaaattaaaagtgctactccagtgaacacaggaatgacaagaaagtgaaacagccatattgttgatataaagtttgagtggtccagatagcagatcaaaccagctacaatattcccttaaatgaaaagcaaggccctaactctcttcaattctgtaaatgctgagagacttgagaaagctgcagaagaaaaattagaagctggcagaggttggttcatgaagtgtaagagaagccatctccataacataaaagtgcaaggtgaaacagcaagtgctgacatagaaactagagcaggttatccatatctagctcagttaattgatgaaggtggctacactaaacagattttcaatgtagacgaaatagccttctcttggaagaagataccatctaggacttacatagctagggaggagaagtcaatgccttgcttcaaaacttcaaaaggcggccgggcacggtggctcatgcctgtaatcccagctcttttggaggctgaggcgggtggatcacaaggtcaggagatcgaccagcctggccaacatggtgaaaccccatctctactaaagatacaaaaaaattagccgggtgtggtggtgtgtgcctgtaatctcagctactcaggaggctgaggcaggagaatcgcctgaacccgggaggcagaggttgcaatgagccaagatcaggctgttgcactccagcctgggcgacagggcaagacgctgactctcttgttaggggctaatgtacctggtgacttcttaagttgaagataatgctcatctaccattctgaaaatccaaagtgctttaagaattaggctaaatcttcactgctcatgctctataaatggaacaacaaagcctcaatgacagtacatctgtttatggcatggtttactaaacattttaagcctgtggagacctactgcccagaaaagactcctctcaaaatattagcgctcacggacaatgctcctggtcaccctacacctgtgatgaagatgtacagggagatgcacattgttttcatgcctgttaacatgacattcattctgcagcctgtggatcaagagtaattttgactctggggtcttattatttaagaaatatattttgtaaggcttatagctaccatagatagccattcttctgatagacctgggcaaagcaaattgaaaaccttttggaaaagattcatcaatctagatgctattaagaatatttatgattcacagaaggaggtcaatctatttacattaacaagagtttggaagaagttgatttcagtcctcatggattactttgaggggttcaaggcttccatggaggaagtaactgcagatgtgatggaaatagcaagagaactagaattggtgtctgaagatatgactgaattgctacaatctcatgataaaacttgaatggaggaggagttgcttcttatggatgagcaaagaaagtgatttctggagatggcaattactcctggggaagatgctgggaacattgttaaatgattacagagaatttaaaaagttctataaacttggttgataaagcaatggcatggtttgagaggattgactccaattttgatagaagttttactactgttaaaatgccatcaaacctcaaatcaatcatcaatgcctgctgtggagaaatctttcatgaaaggaagagttaatcaatatggcaaacttcattgttgtcttatttttagaaattgctgcagctagccccaccacttttagcaaccaccatcctgattagtaaggagccatgaacatcaaggcaaaaaggttattacttgctgaaggttgagatggtcattagcattttttagcaataaagtactttttgtaaggggtgagggcagagtcttactctgtcacccaggccgtagtgcagtggcatgatcttggctcactgcaacctccacctcctgggctcaagtgattctcccatctcagtctcccaagtactgggaccacaggtacacatgcccatgctcagctaattttttgtatttttggtaagatggggttttgccatgttgcccaggctggtctcgaattcctgagctcaagctatctgcctaccttgcttcccaaagtgctgtgattacaggtgtgaaccactgtgcccagccaataaagtgctttttatttaaggtatataagtttttttttttgacataatgttattgcacacttaatagactacagtataagtgtatacataacttttattatatgtactgggaaaccaaaaattattgtgatatttgttgtattgtggtgatgtggaacttgcagtatctcctgggtatgtccatctggttatgtaaagtgaattattggtagctttccccagctctttcaatttttaaaaaataagtaatacatccaatgcaggtatatacaaacaataacctcaaatgttgaacaatacatgttttagctaagcaagcagagatgtatagtttaaatagaaatagtgtgtacacaatcaacttctgttttatgaacaaaagaaaactataaaaagttgaatttaagaatcagtactggctgggtatcgtggctaacgcctgtaatctcagcactttgagagtctgaggtgggtggatcacttgagcccaggaggtcgagacccccctgagcaaagtggtgaaacctcatctctacaaaaaatacaaaaattagccaggcattgtggttgcgtgccagctacctgggaggctgaggtgagagatttgcttgagcccaggaggtcaaggttgcagtgagctgtgatggcgccactgcactccagcttaggcaacagagtgagaccctgtctcaaaaaaaaaaaaaaaaaaaaaaggtactaaaaaagcactaattttcatgtaatgtatcaaaagattagaggactccacaaataggctcttggcctaattagtttatttgaagttataaagtttttaagtatttgtatatctgtaacgcaaaaataaaccaatttcaagataccagttttagatcacctgcaggtgtatataaatgtaagatgttaacatttgactgttttcagaccattgcagactagaagaacatgttttcttggttgtttttgcaaagccttttttctcaaggatggctcctttggtggaagaacaacagatcacattgcaaaagggtgtggacacagggaagtgtgactcattggggccattattttagtgatctaccataatgttttatgttatatggagagtagcagaaatattttcaaaacctagatataaagattataaatgtactttatactttacaatgctttatactctataattttcagattcaatgctttatacttaagctttatttattgtcacaattaatacatagaagtgtacaattttaaaaaatattggtacaaatttaatatcagattacagtgttaagaatatttgctttgttttttcatgtcaataatatattttatttaacccaatatatgcaaatattggttaacatgcagtcaacataaaacattgacattcagcttatagataaatgaagtgagtctctatactcaagaaggatgttcaccaaaaccattggtcatcaatatagtcaccatccatactgacataaaatttattggaatacttcttcacgatttctacttgtcaatatgttaaaactcacatttccagtgtaatgtaaaagttatttacagtgtactaccgatatagttatattttggaaaaagggcctttgctacacatgctgtctagttttcttttatattttggcttgtttgaatacagtcataatggatacgtttaatgtctcaggaagtaaggtgttaggcagagtgggaatagcattaatatgcgtgggaaaaccattccctggtgttaagtgtactaaatccttttttttttttttttttgagacagagtctcattctgtcacccaggctggagtgcagtggcacaatctaggctcattgcaatctccacttcccaggttcaagcgattctcctgcctcagcctcccgagtagctaggattacaggtgtgcaccaccacacccagctaatttttgtatttttagtagagacagggtctcaccatgttgaccaggctggtctcgaactcttggcctcaaattgatcctcccacctcgacctcccaaagtgctgggattacaggtgtgagccactgcgtccggccaagaatactaaatacttttgaaaataaagccttgaatcttgtcttgaatatttcatttcattttcatacttctactgtgacataggacttttgaatactttcaggatgtggtagagagtttttttttatacggctattgtgatgtgactccatttaccagtttgctataaagtttatagcagttcatattacttgggttgattttagtagcctttgaggaagtttttaaagttttagttttatcatattacagtagtacagtagaggattcgtgtgtttggcattttagtccatatataattttcaattaagtacttaaacaaatccttgagttttaattttgtatactgaaccttggctgtattggctatatgatgaaattgtgtccggagttggtgggttcttggtctcactgacttcaagaatgaagccgcggaccctcgcggtgagtgttacagctcttaaggtggcgcgtctggagtctgtcccttctgatgttcagatgtatttggagtttcttccttctggtgggttcgtggtctcgctggctcaggaatgaagctgcagacgtttgcagtgagtgttacagctcttaaggcagcgcgtctggagttgttcgttcctcccggtgggctcatggtctcgctgggctcaggagcgaagctgcagatcttcgcggtgagtgttacagctcataaaagcagcgtggacccaaagagtgagcaatagcaagatttattgcaaagagcgaaagaacaaagcttccacagtgtggaagggaacccgagcgggttgccaatgctggctcgggcagcctgcttttattcttttatctggccccacccacatcttgctgattggtagagctgagtggcctgttttgtcagggcgctgattggtgcgtttacaatccctgagctagatacaaaggttctccacgtccccatcagattagttagatacagagtttggacacacaggttctccaaggccccaccagagcggctagatacagagtgtcaattggtgcattcacaaaccttgagctaaacacagggtgctgactggtgtgtttacaaaccttgagctagatacagagtgccgattggtgtatttacaatccctgagctagacataaaggttctccaaggccccaccagagcagctagatacagagtgacgattggtgcattcacaaaccttgagctaaacacagggtgctgattggtgtatttacaatccctgagctagatataaagactctccacatccccaccagactcaggagcccagctggcttcacctagtggatcccgcaccggggctgcaggtggagctgcctgccagtcctgcaccgtgcactcgcattcctcagcccttgggtggtcgatgggactgggcgccgtggaatagggggtggtgctcgttggggaggctcgggctgcacaggagcccatggagtgggtgggaggctcaggcatggcaggctgcaggtcccgagccctgccccgtgggaaggcagctaaggcccggcgagaaatcgagcacagcgccggtgggccagcactgttgggggacccagtacaccctcggcagccactggccggggtgctaagtccctcattgcccggggccagcagggctggctggctgctctgagtgcggagcccaccaagcccatgtccacacagaactccagctggcctgcaagcgccgcacacagccccggttcccgctcgcgcctctccctccacacctccctgcaagctgagggagtgggctccagccttggccagcccagaaaggggctcccacagtgcagtgggggctgaagggctcctcaaatgcaaccaaagtgggagcccaggcaggggaggtgctgagagcaagcgagggctctgaggactgccagcatgctgtcacctctcaatcccccctctaaacaggacaccccaattgctgttgggaatttggccgttgactgctctagctacttcctgctggataggggcgaagaaggggccctgcagttgtggtgtccttcagaggggaactctccaggccaggggaagtgccagtgggtcggtccaggggtcccgggtagaagttgttagttgaactcatttggggttccatttgtaagaccatctgttgcttgatggtctcgattctagaggaaacaaaattgacaagaaggttagaaatacagggcccaaaggtgagtaacagcaagatggctgccacaggacctagaaaggggagaagccatgttgcccaactccagaggttggtataagtatttgaaaggcattgtctgatttcagaagccttttcctgtaaacgccgggcagcatctcgtactatccctgactggttagtgtaaaaacaacactcttcccctaaaaaggtgcagagtcctcctttctcagcagtgaggaggtctaggcctcagcagttttggagagtcactgctgccaaagagtctatttgggattgtaaagtaaggatagatttcgttatttcttgcaaactgtctgagaagcaaatatgggttgaagacccacataagtagaatatgccttggctgggtagatagaaatttaccctggcttttaaaggaataggatacactgttttttctttactacttccatctctctctttctctcttcgacttcttctttgtctcttcttctctttttaactctctctttaactttctgtgtctgtccctctttctctctgactccttttctttgtctctgtttctgactccctctttgattttctgtctctctgtctcttcctctctctgtctttttgactttctctttctctcttcgactttttctttcctttctgctgcctctgccagctgcttatgctgctgttctcccctctccttcccgttttgatggctttgtcagtgtaagaaaatgattcataattcccacttcatgtaataaaatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagaactgtttaaatctgctgtcattgattttttaatagaatacattgttatttactatagtcttcatgttgtacaatagatcttttaaatttatttctcctatctaattgaaattttgtatgctttgcctaacatctcttcaacctcctctccccgagagatgacacttgcttatggcttaccaattcctctttatgtatctggcaaacccatcgtttgaatatgtatggtattgagtagctaagagtttcaaggcatctgatatttgaaacatatgtagaaaatttggtaatgtgactgcgttgtgtaatttgtagaatagtatataactttaaggccttattcatatggatcagctgcaatacatacttcagacagaacaaggagttagagtaggatggaaaccctttggattctttggatctgttaattttttacctcaagaaaatcccaggggatttggaggaaataatgttttcatacacattttacggttacataaattggcatatttattttggaagtagcagcatgtaatacatttgaaagcacatctaccttaccacccatttgttccaattttcagtgtataccctccagcaggggtcagcaaaattttgcctacaggctcagtatatattttaggctttgtggaccaagtggcaaaattgaggatattatgtaggaacttaaataacaagagagagaacaaattttacaaatgttgagtttataatattcaaaatgtaataattgagtacagtttttgggtaatacacagttttatttttcttttatttatttatttttttgagatctagttttgcactgttgccctggctggagtgcaatggcacgatcttggctcactgcaacgtccgcctcccgggttcaagtgattctcctgcctcagcctcctgagtagctgggattacaggcacgtgccaccactcctggctaattttttgtatttttagtggagacgggacttcactatgttggccaggctgttcttgaactcctgagctcgtgatccacccacctctgcctctgtctcccaaagtgctgggattataggcatgagccaccgtgcctggccaggtaatacagttttattaatgagaagaatggaactctttttggagggacaacatttcacctaattgggatttcaacttattgttcccaccatgttgattataaatgtttatgtgtaaaaattattctttgcttgtaggctatcccggaacaagcagtgtgtgggatttggcctgtaggctgtagttggtttttgttctgttttcttagaggtttattgtttaggaattaacttaaccaaggaagtgaaagacttttgcaataagaaccacaaaacagagctgaaagaaacgaagatatacataaatggaaacgcatctcatcttcttgaattggaagacttaatattgtccatgctatcctttctacacattttcagtgcagactctattacaattccaatgtcttttttcagaagtagaaaaactcatcctaaaattcatatggactctcaagggaccccaaataaccaaaaagatcttgaaaaagaacaaagctgaaggacttactcttactgattccagaagctactacagagctatagtaatcaaaacagtgtggtactgttgtaaacacagacatatagacccgtagaaaagaatgcagtgcccagcaataaaccattgtgagaaagattgtttatttttctttaagaataaacagagaatcagccattcctttttaggtgaagagaaggaggaaatagaggaaggaaggaagatcgggtgaaattttgagttaatagatgagctacatcaaatgaagtatcatatccttgttacatcaatatataatttcaaagatgtccctaatccttttggacttcatttttcctgcatgtgaaatgagatgattgagttaaataatctctaagcagtttgagctctaaaattctttggttgattttgatttcattcttttcccctgaagagtttttcttcacaaggtgttcattattatgctgtacaaccctagttattattattctttcttcagtttttatgtgtttcagtgtattattgcatacataccaacttttaaaatgaaagaaatgcttatttgttcctttagtgaagggacaaatctttatgatgctgattatactattatgtgttttatactattatgtgttttatttaatggtataaaactaccatgtgttttataatggcagtaacaaaaattatttattgtatatcataattataatgtttttattgtcatttacaattagcatgtgctttttatacttttgtctttttaaaatagcaaattctaatttatgataatttttggcaaaatcttacagaagtaagttgccatataatgtttctaaatccattacaatttcttctatttgagatattaattcaagaacatttgttgtaaaatgttaaaatcttgatgatgtattcatttttgttatttactaattgggatttttaaaaacaggtggcaatacatgtttaactttttatttaatgagatgtgtaagttctcttattcaactttacagtttcctttagctaaaatttctactggtagttatacttactgtttcatacatttttattgctccagattattagtttgcaacatttaccaaaccagtttttgaatatgtgagctatccttcatgaaagcaacttcagtttacactgctggttctgctttttccagattaagtatttatagtcttggtcaagggatgttgacaaattattagcttatataggttttgtaaatctatgtatctgattgctgtaatttaaaagagagagtttaaaaatttatttttaaatagttctttttgatttggtggataatagaggaagcaaaaatatgactcataataatttggcaatatttagaaggtaacttctttgtccagtaggtcctgttttattgtaattttcacctggttgaatgttttcttagaagcatctctaggcaacacaaaagtataataaagacttttaaaaaaatgacagaatagtatgtagtttccccaaagccctttgcaattctgcagacaaccagcaggggatctcgtctacacccaatttccttctgagtacagttggtagatagtgtctgtgattatactgttggggcatttaatggaaaatttgacagtggctttgagagagttcttagttgagcataggtaatatgatgtgataaaatattatctttattcataactcgaaatatttggcagttggatattgttttaaaaatgttttgtattgttataataataactgtaaattccagaatcctttgaatatttggcctttatgaggaaataagaaatcctgaaattgtacagaaaccaacgcagtactttgcatacattattgctcagaacaggtcttcaaaaagaatgaatgtgaaatatcttaattttaagttatgattttaagtaatcatttcagtattagaaagatatctttttctcaattctgtacttcttatctattggttaatagcaggttataggtgctgatgggtgcatcacttttgttttccttgatagtaattacataagtaggttctttgaaatgcagttttccttgaaaatgtaattttaaaaaatgttttatttctaaaacattgttttgttcactcaaaactgagtgtataagaaataatttgacattgtcgatttgatgaatgttaggagtataatagctttttgaaactatttggaagtagcttaatacttttaaagaaattgataattattttatgctcattaaatagtattttgaaatcagttatgaagaaattctaaacatattttattatagaacttcacagttgatattaattctagagatatggaagtcagtgctttataaacccaagggataaaaaacagtaactaaagataaatgttgagattaagctacttttacatttactggaaaacagtaactctttgttttgtatccatgtgtgtatttccactctgaggtgtttatcttttgttgttttacaaataattgaagcagaaatatcatcagttctctacagtatttcatgtaacgtgatgttatgttgtttctttctattatgacaaatatagtatccaggaatttcagggattgcttataaaattttgtagtatggtctgcttgctttaagcatagacatgcttgtacatatgaagagtaatttatgccatgtaccaagttttctggggtttaaaacctcaatcccacaattattttcacaaaagaaaatagaaataacattttaggatatttttcgatatcctttttgtatgtacattatacaaggtgaagacaaaatacatttttaaacagtttttcttgtagttaatgttattttagtcataaaatattaacattaatttataaaatttgtagtttactgtgtagaaaatgcagtcagcggtttatatttatggaaaaatgtatattttagcagataataaaacactacctgaggagtatgtatagaaataaaatgtgaaacttaaaaaaatttgtcaaaagagcagtgatctttcagggatgtgaaataaatactgtatatttaagtttcttaattttgacctactgtcaaattgtatagaagaaaatgttgatcgtttgggaagtggaaaaagactttggaacatatttagtgtgcagctgttgtaaagcaagttgaaactgacgtatttcatcctgtgcttattaaaactttgtctgtgtgaacacttgcatcttttctttttgttttagatatttggtttccaggcaggactgacgtctttggattgcagtggatcttactgcttacctgtaccagttattccctctttcagcactgctctttatgggaaacttctgaaactccccacatgctggtaagtcttacatgttaaaatgtgatttatgttaatttccatttattaggagggaaaaaacccccaaatgtatctgtcttatgcccatgctagttttatacaaaactttagaaaaaaaatctaaacttgtacttttactgagacactaaaagtcttttttaagtttctgaaatctgttagttcatcatgtcttttgtgatagcaataactgttattagggtaataactgttaattcatgttggatgtgtgtaaaatactacttgagattataataggaactgtaagaggaagtgcctttttttcaagagtgggtataaagattttaaaaagttataaattaatattcaagaccaaagtatttatctattaaataataatttcgtatatattcatacccactgacaaaagtatacacattatgtagagttagaatgtatttacatgtctagtagctatattttataagaaattgattgtagccctcaccattttcattccgaattgaatgctatatttggaggtcacatttccttaaattcggagagatttacagaaagaaagccagtagttaccagttataaatttttagtttaaaggaatgcttttaatatattgtttaaatatataaaataatgtttaaatatatgaaattaatttttagtgaaccatttttccaatttaaaatgtgatttagaatatgtcttttgtattctcattctaattagtaagcttatttttgcaggatagtttttctattagttttttactaaaaatgacataacctttagaaaattagcattaatttcttatctaaaatacttcagttgctaaaaatttgtttctttaataatatataacttttaaaatgaaattataaaataatcgctcatattttcaagaaactttgcctgctgatacagaaaatttttttaaaagtcgtagttaagtcttagtaccaattcctctataaagtgaaaccattattaaatgataattcttaatttctagtgataaatttcattttgtccttactcctccatacctctcacatgtcatttattatgttatatagagatagatttaactttttattagcatacatggtatgttgcatttgagtcaagttttatattctgatctattaagaaataaactgggatatgtcacagttgatatggtgatatcaattttaataggtatttgtgaaaactattttctccgttatgtgctgattaatttatcatttctaggaccaaaatagttttattgcaaacagtgcaatttactatagaaaattcttaatttctttaaaaaagtccatatttttcaaaatgattatagcctttatataaaatcaatattgaaataagtaagacttatttgaaggatacaaagagggtattatgaatactgtcaaatgttacttaaaatatgcctacagacatctagaaataatattccaattaaatactgaaagcatgagatcacagaatgccaatattttttggatgtgttttgcttttttgtagttaagactacttctgtgttatttcagtgatatttttgctatgctttatagaagtatattgatttgaaatatttcttgaaattttcttaataaatgtaaaaaaaaactttagtaactgtaacttgaaaataaagagaaaacttaataaattgagatattggttggttttagtgcagtttgaattcaataaaatactgcttaagcagtatgtcctataagtttaaagaaagcagacagtttccctgggacgtcagagatagctgatgagatgaggtcctgttagaattggacattagtggatgagacagatatccatgtatctatcactgcatacagtgggcgaagaatttggacagttactctaccttagacttgtccatgagcaatgatatctaaatgttttaatatgaacacttaaagatagttaaaccagttaatcaaatattcattagtcccatttcttcatgttcatgtttgttaaagcctaactaaaatatagtctcaaattcactttgtcctataattgagggttcaaatgtgtgattctatttgtagagaaatatatgcaacatattttggaagtttggagtatagaaatagtatattggcttagaaagtcatggaaaacatggaggggtaatttttaagcaggatattgaggaatggatataatctgaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaatacttattatcaacacaataagtaaccttccagggcttaaaatgatgtttatacaactgccctgttcttcgtaataccacagttcgaggcctcaagaagctatacttgagtgtttttaatgaacctggagatagatcttccttccaaaactgtgttcatcagtctggttttgtgattaacattccctttaactaaatgccttaaaactactaagccttaaatgggatgttaattctcttatctccacctgataggtgttagactgatttttcagctttggttctgccatctaagatgtgcttttatggaatgttttgaacaaaaaagaaacattaacatctgttacaatcttctcatttcaaagatgggaaaactgagttccagagaggtcaaatttcttgcctaagaccacacagttaattaatatcagtgcctcaatttgatcctctccttcttgattcaaggctcgatcaactgtaccattttgcttaaaacaattgctattactatttcaaaaaataactatttttaaatgtaaaattcagtagcattaagtacattcacattgttgtgcagtagtgccaccattcaactttctgtctctataaatttgactattctaggtacctcactgaaatggaatcattccatatttgtcatttgtgtctggcttatttcacttagcataatgttttcaagattaatccgtgttgcagcatgtagcagaatttccttccttattcattcgtttgtaagactgaattttatgtattcattttatgtatatgccacattttgtttatccatttatccattgacaaatacctctcaccttttagctattgtgaatgatgctgctgtgaacatgcatgtacaaatatctgtttgagtctctgctttcagttattttgagtatatacctagaagtggaattgctgtatcatatggtaattctgtttttgagagctgccatactgattttcacaccacttgacacctgcaacagtgatggaaaaaggttccaatttctccatattttcatcaacacttattattttctgttttttgataatagctatcgtaacaaatatgaggtgatatctcattgtggttttaatttgcattttcctaatgattaggaatgttgaccatcttttcatgtcctatctattcaagtcctttgctcatttttaattagtttttttccttgagttgtagaagttctttatgtgttgtgtaaattaatcccttatcagatatatgatttgcaagtattttcttccactgtgtggaaccatattgcagggtcctggctggagatgcatcaataaacaaaataggcaagttatttcccctcatggcaatagagaataaacattctcttaattaagggaattttaaggagagaaaaattgctccatgtagattgtcttttaaaattgaatcataaaatcatcctttttgctgtactgagccttgaaaggaggtgtttaaatagttcttgatagcataacacttttggattacttaacatttttctatttattattttttatgtttcagtgaatgcagcatttttactttttcttaatgattcatgtttgaactgaaaaccatcgaattaggagtagagcaaacagtgataggaattgaaatatagattcttgcagataaatgaaaaaacccattggataaattaaatatattttttatttgccagctctgaaaacattcttcagttattgttgaatgatgttgtaggagggtgcatttgatgattcaggacttaatgcaagcttttctaaaaacttgatttctcatcaagtattttaacatgtacagcttgaacaacatgggcttgaactgtgtgagttcagtttctttcaataactatattggaaaatttttttgagatttgtaacaatttgaaaatttgcagatgaaccatttagcctagaaatatcaaaataatgaagaaaaagttaggtatgttatgaatgcatacaatttatgtggattttgtctattttatcatttactaccatgcaatatacaaaaatttattataaaaagttaaaatttggccaggaatggtggctcacgcctctaattccagcgctttgggaggccaaggtgtgaggattccttgagcccaagagttccagaccccatttctagaaaaataaaaaggtaaccaggcatggtggcatgtgcctatagtctcagctgtttaggaggctgaggtgggaggatcacttgcgctcgggagattgaggctgcagtgagccatgatcatgccactgctctccagcctgagtgacagcgagaccctgtctgtttcaaaccccaaaaccaaaaaggtaaaatttgttaaaacttatgcacacaaatgcttagggaccacacatggcaccattcagagctgatagaaatgtaaacaaacataaagatgcagtattaaatcataactgcataaagttaattgtagtactacatggtgtactactataataatttcgtagccaccttttgttgctactgcggtgagcttttgtgttgtatctgcttaaaatgctgtgtgatggtaagcatctccatgtgagcagtccctgagcagttcctctctacagtatgactgtgtattgcaatagaaagtgatctgtcacagttctcacatatttgtcattgggcttagtgcaatactgtaaaatactataaacttttgttttttttttttgagacgaagtcttggtctgttgcccaggctggaatacagtggcatgatcttggctcactagcctctgcctcctgggctgaagtgattctcgttcctcaacctcctgagtagctgggattacaggtgcttgtgccaccacacccagctaatttttgtatttttagtagggacgaggtttcatcttgttggctaggctggtcttgaactcctggcctcaagtgatctgcccaccttggcctcccaaagtgctgggattacaggcatgagccaccgcgcccagccctgtaaaccttgaataacaccacagggtccacacagagtgattctggaagtggttccaagaagcagaaaaaagccatgatgctataagacaaagttgagttgcttgatatgtaccacagattgaattctgcagcttcagttgcctgccctttcaagaaagataaattcagcataaggactattgtaaaaaaataaaaaataaaaggaaatctgtgaaaccattgcttcagttttgccagctagcacaaacacttttcactttttgtgaaatacctttttattttgtattgaaaatgcagcttttatgtgggtgcaggattgctataagaaaggaatactagagactctaataagatttgagaaaaagtgaagtcattatgtgacaacttaaagcaaagagaagatgaaggatctgaaggtgaagaatttaatgccagcagatgatggtttgacaattttagaaagaggtttggcttaaaaaatttcaagagaacaggagaagtactttctgctaccaagaaactcatattagtcagcagatgagtttcctaggtgccattaagaaaattattgaggagaaaggatatctacctgaacagattttaagtgcagatgaaagtgccctattctggaaaaaaatgccaccaaggacatttattagcaaggaagtgatgagtgctcacagacctgtgccagatgataagaagtaggagaagcagtgccagaaaacaaatggacattgtacagtctggcagaagggttccagttattcaagattgcctttgacttttttttatgacatggaccatcctatgataggggcactgcattatttgaaataaatttcttggaaagactgaccagtctttgtatatgttaatggtcttgccaatttctgtttttccttatatttttggttgtgatttgataatgtgtttagataaataacttgtcaaaaaatacatacatttatagtttttaaaacatggcctatgtgtatgaaattaaaaggatataaaaagcacaattataggtaaatagtatgtatctttatattagattttttccctttaatttttttagaaagggcacaaagagcatttgacttgacatatgttaacaagcaagagagtgttggtccaatgagaacagaaagtttcctttgattgtgattttggaaaatttgatattttccacatggaattttatggtcagttggggtgaagttgtataggcaaatatgatgcatttccaattccctagtttaatgttttaaacttagtaaaatagtttgtttagtggtgtccaaatgagcatttacaactcattcttagcttattgcctttaaatttgatttttggttattggagaatatttctacatgacctatatctatgtcagaataattatattgacttttcctcagtatttggctttgcctgtgcacagcagtgggaaaatattatcctgtgacaacattctattctagtgacagcattttaaaaaatgtatctttctttcattatttttgtgagggagagtgaaagtcagtagtattctttgagttcaaaagaactctacgttgttaatgtatttttttttaaagcgaaatggcttggttagtaattattaaatttagcctaggttttctttttatgactacctttaaatttttttcttaactgtgttttgatgatttaatttctttttattttttattttattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccttgaaatgtaagaacaaataatcattggcggttcccatattcaaaagatcagatagtgcttaggttagtgacagaagaaaatttctaataatagcatcataatccccttgtatagcattttgtacttaactaagtttcactgcatacaggaagttttttgatactcacaaccaacctttgaaataaacaggttaggtatccttatttctattttatagatctggaaatggaggattagggaaggtgatatggtagacctagagagataaaatcgcttgcattggacatcttttatttattttattttattttatttttctatattttgagacagagtcttgttctgtcacccaggctggagtgtagtggcacgatctcgactcactgcaacctctatctcctgggttcaagcgattctcctgcctcagcctcccaagtagctgtaattacagatgtgtgccatgacacctggctaatttttgtatttttagtagagatggggtttccgcatgttggccaggctggtcttgaactcctgacctcaagtgagccacccgcctcggcctcccaaagtgcagggattacaggtgtgagccactgcgcccgccctagacatcttttgattaattgatgttggaactattaatagcatgttgattaatagctattaatagcaggttctagataagaactttgtattcttcattatgccttataacttaaaaaatactgccagcttcttagaagaatctgttaatacttaacattgttcagatttcaactgactaatgagtcatttattcattaaaaaaaaattttggtgcctatcatgttaaaactgttgtgttgtaggccttggagtgtgaataccacttggtctttgtgtttcctttcttgatactttaagaatttagacaggtgttcttaaatactgtctaactcatacatctgcagccaagtttgtttgtttgtttggcttgtttttggaagatctaattatgacctctttactagaatactttgcttcttacaatttatatggtaaagtttaaaagctttaaaatattctttgatgccctctatggtctggcccctgcttggctttctacactcatctgaaacgtcctcctctctgtcccctccttcttgcttttaaaaattttctctccttttaccaaattgttcactattattgttttactattctgtatcctaaataactgtaactgactccagatgctactccagttgatactttttctgacctggtcacttcccctctaaaatatgctttaaaatatgagataatgttcttgtttttcattgtacttttcatagaagtgattttacactgctttgtgtgattatttaatagcctttcccactcgttttattttaagctccataagaaacatctctttttctgtggggcacgtttatcgtgaaaacctcgcatctgttgtagacatgagtaaatatttattggcatgcgtctggctgtttctttaacaatttcaattttttttttggttttctgatttatgaggttttagattgtatacttttttgacaatcaagttctatctcctattagctcacattatacatgcaaaacttactcttggccaaagtgaaaatcagtgatgttaattacttaaattaaactaaaattttagtgacttttcctattcagagttctcaaggtaatatttgaaagttattaattacatatataaaatatattgtataaacacacttcatctcctttttttcctgagcagttacattcttattttaagtagatgaattgtctgttttaaattaacttgtctagaagatgagataatgtaaaggcatcttacttcttttgtattttgtttgtttgctaccacacatcagttaaccattatttaagctgttccatattccgtaatactagcaccactttttggctcatatcgagcaagtatagtatataggccattccctccagagacttacaactcatgctgcaactcatttataaatatttattgggtccatggtataattccagtcatcattctacatgctgggaatgcagtggtaaacaaaatagaccttgtctctgtttcatggagccaatattctgaagaggtagagccaacactgcattaagacaaatacatgcatttcagataatggtgagtaataagaaaaattatggccaatgggatagaaaatgaatgttttggggagtttatttgtctaaaatggtcagggaagttctcttacatggatgtgacttttgactccaacctaaatgaccagtcaatggcagccatacaaagattttgggaaattgtgttgcaagtgttgggaatagctggtgcaggtctcaaggtagaaatagatatagttcatatgaaggacagatagaagtcaagtgtgactgcaacatagtaaagggagatagataagagattaaattggagaggtggtctattcacaaataaaagcaacgtaagtaggtataacctgaacaatttttagccttaatagtagagaagtaaagatttaaacaatgtagaattaaccatcttttttgtgtactgttaaatgaatataatattcagaatgttaaggattgtgacaccagtggtggaaatttaatatgacagatccttacaacttttctgctgtacagcttgactatatccatcaaaatctgtaagcatgaatatcttttactcagcatgtccatttttaggagtttgtccttagatataattaagcgaatgaccaataattagttatgataaaatggaaaaatgtaaatagcaaataatgaaaaacaggttgtataaattatgttacactcataccagttagcaatatgtaggatagccattaaaattttgttgtagtatatgtttattggtatagaaatgttctcatgataaatatcgagtgaaaaaaggtcacagaacagagggatacagagttagtctattaatctgaacaaaaaatatgcttgcacaggtaaaaaggctgggctattgctaaactgtttgtgatggtgttatgtgagtggtaggtaatgtgtggtttatgtattatagtggttaggagcatggacctcagaactggattccttgcatttaaatataggctctgccacttcctagccttgtggctgagaaagtctttgtgtctgagtttcctcatttgtaaaaggggcaattcttaattcttaccttcgagttattttgaggcttaaatgagttaacaaatatgagctgctttgaatagtgcctgacacataacaagttctttatgcaagttagctgtgattattactattgcatatttacttttttctgacttttttcagtgaacatacatttataaaattgatgggtcacctttctctcaaagattgtataaagttttatttgacatgccaaaaaggaaaagtttgtttttaatcacatgtattaatataataggtataatctattaataaatttataaacttctataaagcagttaagaaaataaactgaggaacagactgagtaaaaagatgcacaaaacatctgaaaaaattattgtatacagaatatatgaaaatatcctacagttgaataagaaaaaatacaaccaattaaaaaatgggcaaaagacttgaacagacatttcacaaaggaagggtcaccaaacacataaaaaagaacccaacaactatacataagggaattgcagattaaaaccacgttgagaatgatcataacagctttattcaaaataatcccaaactgaaataaccctggagattaaataaattgtggtatatttaaacaacaaataccactcatcaataaaaaataatgaactactgatatatacagttgtgtttcctgagtgaaaagaactgggcacaacagaaacatggtatgattctatttatatgaatttctggaacaggcaaaattaatctgtagtggaaaaaagtctaaattgcctttgggaggatgaaggaggaaggattgattgggaagaacacagggaattttctggggagatggtgatttcagtatctttttggggtgagggttataacacagttatgagtatttgtcaagattcatgaaattctacagtttttagaatatataaaaagaatataaaattctttttatattttactgtttgtaaattttacctaaagaaaaaaggactgaaaacaaaattgaaatctgtttgcttttttgcagtggaatgagttagcaactaatgatatgagttaagcaattcttaaagcactttctgtgtattctaggcttgactaaataagtaggcttattcagagtaatggtatccaggtttttcacctgtggagaaggagttacaaatatgttaaagagaaagtctatatttatttatcgttttatttcttctttgagacggagtcttgctctgtcacacaggctgtagtgcagtggtgcagtctcagctcactgcaacctctttctcccaggttcaagagattcccgggcctcagccttctgagtagctgggattacaggaacccacccccatgtctggctaatttttgtatttttagtagagactgggtttcgggtttcattatgttggccagacttgaactcctgacctcaggtgatccgcctacctcggcctcccaaagtgctgggattgcaggcgtgagccaccgcacctggctgtggaagactatatttaatggtaggccgtcatggaaaaaaaagaggaggaagactataattcaccttggtattgtatttgaattggaggtatcagaatgaactcatggtttttaatacaaagatatgtcacatttacacctttttgttcatattgttgccgttttcttcttatttaacatcagtacttttgttgaatttagacactaggttgagacattatgccccgctgctgctctattgacggtatattgaagtttatataggttaatggggtttttgtttgtttttcttttttttgaagaattttttctttgcatgaaattttactctggagattaatatgtaaaaagttcaacatacatattgaaatgctcagatggaattggggagatatgcagcctagtagtttgcatttggtctctgcatggcagatgtttggataaacaatgaatatcttttggtatgttagatattaagttctcagtaagcacagagtggctttttaactgtattattgtgtagcatcgaatagtatctaatacttagtacttgcctaataaatgtggacttaaattgggtattttttcttttgaattgtagtgtttcagagtgttggaaaatcttagtaactaatatataaatatattttttcataaatgtagtattgaagtaataaaggtaatccttaagtaaactataagtattcatttttaaaaaatgactatattgaggtataatttacataccataaaattaatctgtttttaagcatacaattcaatgatttttagtaaatttaccaagttgagcattcatcaacataatcatgtcaccctaattagatcctctttgttacagttaatcctaattcttaccccaacttcaaggaactgtagatttactttctgtatctctagaaatagaaaatatctctagacatgttctgtccctggaatctataatatgttgtggtcttttgtttcagggttcatctaccttgtaacatgtattagtacttcacttctttttattgctaaatagtagtcaattggttggatagaccactttttatttatccattcaccagctgatagacatttgtgttgcttacacttttaaggctattatgaataatgctgccatgaacatgtagtctttgtgtggacttaatggtttcatttctcttgggtagatacctacaggggtatggttggattatatagtaaatttatgtttaactttttaagaaactgcaatctgttttgcaatatgatatcattttatattccttccaacaatgtatgaggttcttgttttttcacagccctgctgacatttgttattgtctgtctttttgattatgtccattccagtggggttgaaatagtatctcatggtagttttataagaattcatttttgtttgcttagttcattttaagattttggattttatgtatggtaataagacatttattacacttttattttagtggtaggcagcttttcttatattttcctatttttcatctaatattttaattcaaataaaactattccagaaatttgaaaaatgttaacatatttttatatctcgacaaacaggatataatttgtattttatttgcaaatgctaaaatcattgtaattaaaaatatatgacaaaagctggccaggcatggtggctcacacctgtaatcctagcactttgggaggcagatgctggtggatcacttcaggtcaggagtttgagaccagcctggccaacatggcgaaaccccgtctctaccaaaaatacaaaaattagccaggtgcagtggcacgctcctgtaatcccagctactctggaggctgaggcacgagagtctcttgaacctggaggcggaggctgcagtgagctgagatcgtgccactgcacttcagcctcagggacagagcgagactctgctttgaaaaaaagaaaaaaaatggcaaaagctaatggatgttgaaaaagatactccgatacactgctgacgaatgtgaaaattcagcgtgatatcatgtatgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctggatatgaggaataggcatgtgttaaagaaattattttatattcaacagcttaactgttaaaatggaaatttagtgatatttcaaaatattaggtaagtccagaagttagaaatttttggtatgaatttatattgaactattttgttttaagtaaagtttaataaatatgtagtagtctaaatcacaaggaaaaatacactttttattgtgcatttttattgacactttaatgactcccccaaatagtttaaataaagttgtaaaagctgttgatctttaaaaaattttttgaggtgaatatggtataatgttatgtcttgatgaattggtaatagatacattgagtatttgttattttctacatttgttaaccagttacaaatatttcaaaattgacaaaaacaaaagagaaaaacccctcttcattggtattgttacattaacagataattgtgtaagataccatctatacccaaatcattttaaatttatttatgtcagtttaaatactactggagtatctaacagaagtataaatagaatgtatttttatttgttgtgggttacagctgaaaaataaaccacaaagacatatcctgtgtgtataattggcgtgtttattattgaattctaacttttgtacaaagtaagcttctcctttgatattaaaataattaaggagagaatttttccctacccttgggcattactaaaatgtacaatatattaatctttctgaatttgcatgtgtttaagtttttattcaagtctatgttatccatttgggaacattttaggtgatataagctggcttgaaagggtaccatatacggtagctgaatttattatgaaatagtaaagacctgcttgtaaaaaaaatgaatcccatctataatattgccatacaaatacttactgctgtagttatatgaacatggctcttgctacacgataggacctcctaattgccacagagtgcctgaagatagattaattgtacattttcgtattataggagatattccaaatatctgtgttctttactacttatcactaataaaatgttgtgggttttttggtgcaggggcggggggcggttcaggaatttgaacagaaatttgagaacatagtggagagacctagttaactattttaaaatgcttatagaataaaaaggaaaatgagaaagaaaagaaaatgtctttaaaaatattctaaatgttggaaaagcgaaaggaaataataaggataattacattcagatttatgaattgagtcatatttgtttatccttctatttcttttgatctctactactttacctgtttggcataagggatcttttatttactgcatatttattttctggtccattcattccaatcctttggcttttatagccaaatatgatcagaattgtggattgagggacacaggtagtgtcacatgttgctattaaggatttgaaagttgttggatgggatagtggctttcttattgggcaactgtgtatttgattgatcttacatactaattaagagagatgggtaggccgggtgcagtgactcatgcctgtaatcccaacactttgggagggtgaggcaggatgattgcttgagcccaggagtttgagaccagcctgggcaactaagtgagatcctgtctctataaaaaaataaaaattagccgggcatgctggtatgcacccattgtcccagttactcgggtgactgaggtgggaggattgcttaagcctgggagatggaggctgcagtgaaccgtgatcatgctactgcattccaaccagggctagagtgagaccctgtcttaaaaagagagagagagagtgacggagacagagacagagacagacagaggcaggggtgaccctaggcttttgtttttgttgtttggacattttttttttttttttttttgtgagggaaggcattggtatttgaatcagttttgctaagaacagagttctaatactttagggacctagtttgttttcattgagctaaaatttacaacataaatttcatcattttaaagtgtacaattaagtggtttttactatattcacagttttgtgcagtcatcaccactatctaattccagaacattttcaaaacctcaaaaaagaaattctgtctctatgagtctagacattttataataacagaataatataatatgtgactttttggtctgacttctttcagttaatgtaatattttaaaggttcatccatgttatatagcatgtatcagtatttaattttttatcactgaataatattcctttgtatggatcgaatacattttgtttattcatcagttggggtacatttgtgttgttctcattttttggctaagaatagtgccgcaatgaacattcttgtgcaattttttggtatgaacatgttttcagtcctcttgggtatgtatatacctatgaatataattgctgggtcatatgataactcaatgttcatcttttttacaaattgccaaattgtgttttacatagtaactatacctctgtgcgtgatgttccaatttctacctattcaggccatacttgttattttctgcttatttttattttttaaaattacatcccttctgatgggtatgaagtggtatcttgtggttttgattttcatttccctgatgtctaataatgttgagcattttttcatgcgcttattggccatttgtatatcttctttgtcaagtgtcttttcaggtcctatgttcactttaaaaattgggctgtgtatcttgttcttgttgaattatgagagttatgaattatgagagcgatctcggctcactgcaagctccgcctcccgggttcacaccattctcctgcctcagcctccccagtaactgggaccacaggcacctgccaccacgcccggctaattttttgtatttttagtagagagggggtttcatcatgttagcccggctaattttttgcatttttagtagagagggggtttcaccgtgttagccaggatggtctcgatctcctgacctcgtgatccacctgcctcggcctcccagagtgctgggattacaggcgtgagccaccgcgcccggccaaagttcccttatattcttttaaggatgaattgtgcacataaattgactatgtatactaggctgttgtaaacagggtaggaaggataatagaaagtctgggaaattctggagaatttcattttacttcttcgtagctgcacattcctttatctatttgaatgcccatagaattttttccttatcatttttggagttcagtggctttactaggataatgatcattcagaatcagtattgtttgtgacacattgtgcacgttgtagtttaggtgtttattttagacaagatttttttttgataaatatttctgtatactatttcttttctatttgttttcctcttttctttaggaacactgattatgtatattttatattgccctttcctgttactgatatcagtgtccttttctaatattgttttataatttttcaaaattgttatttttgtatttctagattttatctaccacgttcctaatttgagttatattttatttgttgaacttctggctatttggagatttatacataactttatgatattagtttatagtttaaatccattgtgatcagcacatatattgtatatgatttcagcctttttcattctacttagacttgcttttatgttcttgtagtatgccttggtgaatgtgtactctgctgttgttgggtggggtgtcctacaaatgtcagttaggccaagttgattgatagtactgtttttgtttttaattctttacttacggtctatttgttttatcaattcctgagagaggagtgttgaaatgttcaggttttggatttgtctattcctgttttcagttctgtattttaaaaaatgtatgtatttcggagatgtgtagtgcctacaaacttaattaaccatgttatcattatgaaaaaaatctctctatatccatggtaatagtctttgttccagagtttactttgtctaatgttaatgtgtaactcttttttgattagaattatgtggtgtttgttttgctcgttcgtttactccttcatgcccctatccccttaatttttaacctatctactttattatttaaagtggatatatatgggtctttttttttttaatataatcgaagaatctcttccttgaattggtatgcttagacgtttgagacttaatactatattttggggtttagttctagtatcttgctgtttgttttctagttgtcccatctattgtttgttttcttttttcttttcataactttatttagattcattccgtttcatcctctctattccattcttattccactctgtctacactattgcctttattagttttaccttttagttttatggctttagttgttctagggtttacagtttacatcttttacttatcacagctaccttcaaataatgttatactgtgtcatacattgtgtaagaacctccatttccctcttcctgtccttggctattgacattgtgcattctacttttacatatgtcataaactctgaactatgttgttatgatttttgctttaaacagttaattcttaatcttattagaagataatgtttctttcttcttcttttttttttaaaaaattcacccatatatttaccattcccattctcttcacatttctttgtgtagagccacaaatatttccatctggtatcacattcatttagcccgaagaattttctttaacattttttgtagtacagatatgctggtgaggaattcttcccagcgtttagtcataaaaaagctcttttgctaacatttttgaaagttttttttttcctgaattttggattctaggctgacagttttcctttttctttcagcatttcagtcatggtattctgttgtcttctgttctgcatgatttctgatgaggagtctgctttcattttgtagctttgtttctttacatgtgatgtgtttttctccttaacactagttttcagcaatttgattataatatgccttggtatgtttttaattctcttctgcttggggtttgctgaatttcttggatatttgggtttatagttttcttcaaattgcttgatagtgtcccacgtcccattaaagctttgttcagttattttagtctctctctctctttttttttttttttttttttttttgagacggagtctgtctctgtcgcccaggctggaatgcagtagcgcgatctcggctcactgcaatttctgcctcctgagtttaagcaattctcctgcctcaggctcctgagtagctaggattacaggcacatgccaccacgcccagctaatttttgtatttttgctagagacggggtttcaccatgttggtcaggctggtctcgaactcctgaccttgtgatccgcccgcctcggcctcccagagtgctgggattacaggtgtgagccaccgcgctgggcctattttagtgttttatctttcctggtcctcgatttcctgggaactcctcagagactagtcagctagtgggagaagagagggaagcatttgttcctacatttccatcttctgcatatatgattgcaaagtagtttgctggtgtctcatgctgcatggtggctttaggcaatgcaaatgaaagtgtacattgaattggtctccatagcagcggccagaatatgaggtagggtgatatacaagagaagttctgtactctccatgtgtggttacagttgggaaaatgacaaatggtggagggtttgtggggttaaggaaagagcaggttacatacagtatactatagtagcatcctgattttttttaatctatttttgttttattgttcttctattttatcttgcatgtttattaaccttcagtataaacttgttgctcacagacatattgaaatgttttcttactttgaggctttgttatttagaaaatttaattacataattcactttattcatagacaaaaccaaatgaataagggatcaacaaattagatattccagggcagaaattttaaaaataattttccatgttactatcaagtagagtcctgcatgtaatgtaaatacttcataaatacttctgagagaaagtattaggatagagggctgtggatcaggttgcctggatttaaattctaatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaatgaaataaattcttactcataatatttggttagtttggtaaacaatttttgtgtgtgtgtgtgaaaagcattaatctggcacccttaaggagttaattaactactaaaaatacaaatttctgctttcatatcactataagagatatcttcatcttatcactcagtttgcatgtaaacaaaaaattatagaagctttttaaagttgtttcagttcaaaataataatgttatgtttgtcagtaacacaaaagtagtttttaaaggttataatttaagtgtaattatgcttaaagtaacattatttttaatttatctgttaaaataaagcgacttttgttcttatatgatgcttttgaaggttttaatttcagacctgacatcataattagagttttcttatttggcctagccattaactaatgtaaaatacaggttgattatcccttatccaaagtgcttggtaccagagtgattcaaatttcagatttttttcagatttggaatgtttgcacatacataatgagatatactggagatgtgactcaagtctaaatatgaaattcatttacatttcatatacaccttatacacatagtctgaaggtaattttatacgatatttttaataattttgtgtgacttaatcacatgaggtcaggcgtggaattttctacttgtatcatgtcagtgcccaaagagttttgaattttgaagcatttcagattttgggttttcagattagggatgttcaagttgtagtagttttggtgctggcttttagcattatataaagaataacaagataaatgttgcagtaggctagaggttcttcactcggagcttatgaaaagacttagagttttctgaaccccctgaagtagtatgcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattctactctctacttctatgagtttgacttttttagataccacatttaagtgagatcctgcagtacctggcttatttcacttagtataatgtcctccaggttcaactgtgttgtcttaaacgacagaatttccttctttatttaaggcagaatagtaatctattgcggatatatgccatattttctttatccattcatcccttgatggatacttatactgatttcatatcttggctattgtacagtgaacatggctgtgcagatatctctctaacatgatttcattttctttggacatatacccagaagtgggattgcttatatttttagatttttgaggagcttcaataccgttttccataatggttgtattaattttcttttttcttttttttgtgagatggagccttgctctgttgccaggctggagtgcagtggcgcgatctcggctcactgcaacctccgcctcccaggtacaagcaattctcctgcctcagcctcccgagtagctgggactacaggtgtgcaccaccacacccagctaattttttgtatttttagtagagacggagtttcaccatgttgactaggatggtctctatctcttgacctcatgatctgcctgcctcaacctcccaaagtgctgggattataggcgtgaaggttgtattaattttcattcccaccaatggtattctctttttctccacatccttgctaacacttatctttcatcattttgagaatggccattctaacaggtatgtggttatatctcattgtgaatttaatttacatttctctagtaattaatgatgttgagtatgttttcatatacttgttggccatttgtatgaaccatttatatgttggccgtttgcattgttcaggaacccgttggccatttgtcatcttttgagaaatgtctgttcaggtcctgtgcccattttaaaattgagttatttgttttcttattattgagttgagttccttagatattttggataacaactctttatcagagggatggtttgtaaatttttctcccagtttctgtgttcttccttcattctgttaattgtttcttttgccgtgcagaagtttttgtttgatgcagtcccatttttctgttattgctttcatttcctgtgcttttagggttatagtcaatgcccagaccaatgaagctttgtccataagtttcttctagtagatttacgtttcagatcttatatttaagtctttaatcccttctgaattggtttttcctcatggtgttagataaagattcaatctcattgttctgcatgtagatatccagtgttcccagcagcatttattgaagaatctgttctttccccattgtatattcttggcatcttcatcaaagatcaattgtccataaatgtgtgggtttattttggattctgtcttgttttgtaggttgatgtgtctgtcttcatgccagtaccatgctgttttgattgctatagcctgttagtataaagtcagatagtgtgatttcttcagctttattcttttttgtttaatattgcttttgttctttgaggtcttttattccatatgaatttaaggatttttttactgtttttgtgaaaaatgacattggaattttgataggggtcgcattgaatttgtatattgctttgggtaatatggacattttaacattaattctccaagttcattagcacagaacatctttccatttatttgtgtttttttttagtttcttttatcagtgttttatactttttagtatacagacctttcatatccttggttaactttatatccacatatttttgtttttgctgttataaatgggattgttttcctaaattttttttggatagttttagttttggacatgttaatgcataaaaatggtactgatttttacatgttgattttgtatcccacacctttactgaattcacttatcagttctaaaagtttttggatggagtctttaggggttttttttttttttttttgagttggagtctccatttgtcacccaagctggagtgcagtggtgtgatcttggctcactgcaacctccacctcctgggtttgtaactgagattataggcacgtcaccacacctgggtaagttttttgtattttagtagagacggggtttcaccatgttggtcaggctggtcttgaactccttacctcaagtaattcacccacctcgtcctcctaaaatactgggattacacgtgtgagccactatgcctggctgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgccttttctgcatctattgagatgatgatatgacttttgtcctttattttgttaatgtggtgtatcatatttattgacttgtatttgttgaaccatccttgcatcccaaggataaataccactgtatcatggcaaaagattattttaatgtgttgttgaatttcatttaatattttgttgagaatttttacatctatgttcaccagagatattggtctgtaagtttgttttcttgtagtgcccttgtctggctttggtatgaggataatgctagccttctaaaatgagtttgaaagtattctctcttcagatttttggaagagtttgagaagtgatcaatattagttgttctggtagaattcatccagtccagaacttttctttgatggggactttttgttactgattcactcttcttactcattattggtctactcgtattttccattctttcatgattgagtcttgataggttaaatgtgtctgggaatttattaatttcttttagcttatccaatccattggtgtagcattgttcacagtagtcgattctgatgagtctctatatttctgttgtttctatcagctgtaatctctccacttttatttttaattttatttatttgagcatgctcctttttcttagtctattgaagggtttatcttgtcaaaaaaccaaatcttatacttcagctgcatttgataggttgtgtattttgtgtttccattttcatttgtctcaagatacattttgatttcatcttttacctgttggtaatttaggaacatgttgtttaattttcacatatttgtggttttccccaagatttctttttggggtggtgaaaatattctgtaattatatagttgtgatggattcacaaccttgcgttaggtaatcaccattaatttgaatggcaaaaaacacgattacatttgcaccaacctaatatatatggtaaaatccacttaattacacactttgaaaaaatgagggttatgttatatgaattttatcttcaaaaaacgttttaatttgatgattatttaagtagactgtgttattgccaatcttgtggccgttattttatatggatttactattcaaaatcttacctttttgatgccagcccatctataagttaactctacagtaacatcttccttggcattagcacttatcactgtgtgaaactgtctaattcatttatttgtttatttgctaaatttctatttcctgtgatattttcttcagagtattttttggtttattgtctcacaatattaatgttttttttaaattttaaacttttatttttattaattggcttagatagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgtacaccacctttcatcataatctcatgcctctagcctaccctcctacttgctgtcttaattcatattattgatagttacctaccaacaatatccagttttttcctgtgtatggctttttcttctatctggaacctaattctgtttgattacattctcctacagtttcctctcttctttgagcactagctttattttaacattagtctttttcctttaatttaacactatgctaattacagtctacttgtacttcagaaaaattacgttctcttacacattcctacctttttttcaggtattctcccctcttccatgtcagaaatattttattctttcttttcctttcccttccttctgttaagtttttaaaaacagttttatttatataaaatttttgtaccacactatttattccttttcaggtatgcagtttagtggcttttaatatattcacagagttgtatatccattaccataatcaattttagaacgtttccagcatccctgaatgaatccttgcattccctagctatcactcctggagcctcccattttcccagcaataggcaaatactaatctactttttgtctgtatggatgtgcctattgtggatgcttcatataaatgaattacataaaatgcagttctttgtgactgcatattagtgcatttttccacttagcatactatttcaaagtttgcccatattatagcatatgtcggtgctcattcctttttattgccaaatagtattccattttatccatataccatattttgttaattcattcatcagttgatggacctttgcattgtttctacttctgaatattgtgaataatgttgctttgaatattcaagtacaggtttttttttgtgaatgtatgcttttatttcttttgtgtatatatacctataaatataattgctgggtcatatggtaattttatttgtaaccttttgaggagctgccagactgttttccaaaccagctgtaccattgtactttccattggcaatgtgtgatggttctaatctctccacatcctcctcatattgttatctgtcttttgtgttccagccatcattgtaggtgtgaagtggcatcattatgattttcattttcatttccctcatggctaatgatattgagtatctttttgtgtatttattagctatttctatctcttctatggagaaattattcaaatcctttgcttattttaagatctgcctctttttcttttaaattgtgagatttctttatatattttagataaaagtttcttatcagatatgatttgcaaatgtttcctgtaattttgtgggttgtctttttacttttctgatggtgaccttttgtctaatttttttcattaccctcaagtacatcttctttacattggaccttgttatcatttagaaatggtttatccctttgatactgatattgattcttggtcatcatcattacttttagtccttttatttttttcattttttttaatatcacagaatccttcttggtcttattctttagcttcattcccattggccaacattttctatgacactataattttagactatttttctttcctttctctgtttatctttgttttctccatgcctgttctgtcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgttattttggttgcaaggatgatagagtgaaggtaaattcaaagagtaagccaagaaagaaaataggataatgaatagatattgatgagaaaagaataaaattcaagacattggttaggtctggttgtttgaacttagtgaagaaagtgtacatttgtgccctgttaatgtagctatttacaagaggcctcactaggctcacagaaatgtatgatgaataaatattttcagttctacagattcccaaggggagggagtcaatagacctgtgaatggatgtgacaatgcaatgggatatctagaagaaatgggtaaattcctggacacagcctcacaaaactaagccagaaagaagtcaaatccatgaatagacccaataacaatttctgaaattaaggcagtaattaacagcctaccaatcaaaaaaagcccaggaccagatggattcacagctgaattctaccagaggtacaaagaggagctggtaccattccttctgaaactattccaaacaacagaaaaagagggactcctccctatctcattttatgaggccagcatcatcctgataccaaaacctggcagagacacaacaaaaaaaaatgggcgtggtggctcatgcctgtaatcccagcactttgggaggctgaggcaggtggatcacgaggtcaggagatcgagaccatcctggctaacacggtgaaaccctgtctctactaaaaaaaaaatacaaaaaattaactgggcgtggtggtgggcacctgtagtcccagttactctggacgctgaggcaggagaatggcgcgaacccaggaggtggagcttgcagtggagcttgcagcttggagccgagatcacgccactgcactccagcctgggcgacggagcgagactgtctcaaaaaaaaaaaaaaaaggaaaatttcaggctgatatccctgatgaacatccatgtgaaaatcctcaataaaatactggcaaactgaatccagcagcacatcaaaaagcttatccacgacgatcaagtcggcttcatccctgggatgtaaggctggctcaacataatgcaagtcaataaacataatccatcacataaacagaaccattgacaaaaaccacgtgattatctcaatagatgcagaaaaggccttcaataaaattcaactccccttcatctaaaaactctcaataaactaggtattgatggaacgtatctcaaaataataagagttatttatggcaaactcacagccagtatcatactgaacaggcaaaagctggaagcattccctttgaaaactggcacaagacaagtatgccctctcttagcactcctattcaacatagtattggaagttctggccaggataatcaggcaagaataagaaataaagggtattcaaacaggaagagaggaagtcagattgtctctctttgcagatgacatgattgtatatttagaaaaccccatcgtctcagcccaaaatctccttaagctgataagcaacttcagcaaagtctcaggatacaaaatcaatgtggaaaaatcacaagcattcctatacaccaataatagacaaacagccaaatcatgagcaaactcccattcacaatttttacaaagagaataaaatacctaggaatccaacttacaagggatgtgaaggacctcttcaaggagaactatgaaccactgctcagggaaataagagagggcacatacaaatggaaaaacattccatgctcatggataggaagaatcaatatcgtgaaaatggccatactgcccaaaataatttatagattcagtatatccccatcaagctaccattgactttctcaacagaattggcaaaaactactttaaatttcatatagaaccaaaaaagggcctgtatagccaagacaatcctaaacaaaaggaccaaaactggaggcatcatggtacctgactttcaaatatgctacaaggttactgtaaccaaaacagcatggtattggtaccaaaacagatatatagaacaatggaacagaacagaggcctcagaaataacaccacacatctacaaccatctgatctttgacaaacccgacaaaaactagcaatggggaaaggattctctgcttaataaatggttttgggaaaactggctagccttatgcagaaaactgaaactggatccattccttacatcttatacaaaaattaactcaagatggattaaagacttaaatgtaagacctaaaaccacaaaaaccctagaagaaaacctaggcaataccattcaggacataggcacaggcaaagactttgtgacttaaacaccaaaaggaatggcaacaaaagccaaaattgacaaatggaatctcatcaaacgaaagagcttctgcacagccaaagaaactctcatcagcgtgaacaggcaatctacagaatgggagaaaatttttgtaatctgtttatttgacaaaggtctaatattcagaatctacaaggaacttaaacacatttacaagaaaaaaaaaccctatgaaaaagtgtgcaaaagatatgaacaaacatttctcaaaagaagacatttatgtggccaagaaacatatgaaaaaaagctcatcatcactagtcattagacaaatgcaaataaaaaccacagtgagataccatcttataccagttagaatggtgatcattaaaaagtcaggaaacaacagatgctggagaggatgtggagaaatagaaatgcttttacactgttggtgggagtctaaattagttcaaccattgtggaagatagtgtggcaattcctcaaggatctagaaccagaaataccatttgacccagccatcccattactgggtatatacccaaaggattataaatcattctacataaagacacatgcatttttatgtttattgcagcactattcggaatagcaaagacttggaaccaacccaaatgtccatcagtgatagactggataaagaaaatgtggcacatatacaccatggaatactatgcagccataaaaattgatgagttcatggtttttgcagggagatagatggagctagaaaccatcattctcagcaaactaacacatgaacagaaaaccaaacaccacgtgttctcactcataagttggagctgaacaatggaaacacatggacacagggaggggaacatcacacactggggcctgttgtggggtagggggataggggagggatagcattagaagaaatatctaatgtagatgacgggttgatgggtggctcgaaccaccatggtacgtgtatacctttgtaacaaacctgcatgttctacacatgtatcccagaacttaaagtataataataataaaaacacgaaacttatactttcatttacttttcacatactttacagctgtctgcttagcatttttcatctagtgagctgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaa
